United States Patent 8,344,211 (PLANT NUCLEOTIDE SEQUENCES AND CORRESPONDING POLYPEPTIDES) - sequence listing, part 16

SEQ ID NO: 61136 - DNA, 634 bp, Zea mays
  misc_feature: Ceres CLONE 1522408
atagctggagctccccgcggtggcggccgctctagaactagtggatcccccgggctgcaggaattcgtctcacccctagaaaaaaccaccgcttcaccatccccgccaggcccaccaccaccatggcctctccttcccccgcccgcgcctccggtcggcgcgtgccgcccccgtgctggacgaccgacgagaccctcgcgctcgcgcgggcctacaccgcgcgccgcctcgccgtcggccgggagcacctgacctccgctgactgggccgccgtcgccgcggccgccccgtccaagacggccaggcagtgccgccacaaggtcgagaagctccgccgacgcctccggtccaaccgccgccgcccgtgcccgctcctcgaggcgatcgacctcctcgacgtcccttccccgcccttcttctccaagtcccagtcccgatccacgtcccggtcctcgtcgccgccgccgccgctggcggcggtctcttcgccgtctcccccttcccttccgcatccccgctcagatagaggcggcgggacgatgccggggacgatgacggtgtgagcgatgtggtgggggctctgatggccttcggaaagggttcctgcgaccggaaaaaatgaggatgggagccc

SEQ ID NO: 61137 - DNA, 639 bp, Zea mays
  misc_feature: Ceres CLONE 1522409
  misc_feature: Encodes the peptide sequence at SEQ ID NO. 61138
  misc_feature (400)..(400): n is a, c, t, g, unknown, or other
  misc_feature (522)..(522): n is a, c, t, g, unknown, or other
  misc_feature (531)..(531): n is a, c, t, g, unknown, or other
tggcggccgctctagaactagtggatcccccgggctgcaggaattcgtctcacccctagaaaaactcccggctcagacttctgctgcagcgcctccgccgccgccgccgcatctaacgcagttccctccccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaccccacagaggaaaggcaggctcactgagggctgctctttccgcagaaggnagactagagcggatgtggtctttcagttttgctctatgccagatactagcgtcatgacctgccttttagctagatttttcataagttgttctcaagccactatgtggtgcatggtggctacntccaaactnatatctgggttgggttggaattggaatgaacctatgccccctggaatttaaattagaaggttggaagatttttgggggaaaaaaaaaaaaaaacaaaacccctcgggg

SEQ ID NO: 61138 - protein, 75 aa, Zea mays
  misc_feature: Ceres CLONE 1522409
  misc_feature (30)..(73): Pfam Name: Ribosomal_S27e Pfam Description: Ribosomal protein S27
MVLQNDIDLLNPPAELEKLKHKKKRLVQSPNSFFMDVKCQGCFSITTVFSHSQTVVVCPGCQTVLCHPTEERQAH

SEQ ID NO: 61139 - DNA, 547 bp, Zea mays
  misc_feature: Ceres CLONE 1522410
  misc_feature: Encodes the peptide sequence at SEQ ID NO. 61140
tggcggccgctctagaactagtggatcccccgggctgcaggaattcgtctcacccctagaaaaaatcttatcccaaacacaacccacactactaccctacccgtccgcctctctcgaaagcgcagcaccagcgagcatgtcgcctgtcaccgcactcctggcgggcacggtggtgccgccggcctcggccccgtcgccagcgaggcacgcccgccattactccgtcggcttctccccgctccacggcggcgggcgcgcggcgctggcggtggagtgctcgtcgcggccgcagaagaaggggaccaagcaccacatgaagacgcggccccagaagacgcagccgtgggacatcaagcgccgcccacgcagtacccgcgctgccgcgctcccgcggactggagctcgtcgcctcggcgccacgtggacgtgagaaagcgagcccgggaccgcgcgatctcgtcctcaagtggcgcggcaccgattgagccgcccgcgtgccccaaattgtcccctgaacctcgccaaacctgttttcttttaaatttac

SEQ ID NO: 61140 - protein, 97 aa, Zea mays
  misc_feature: Ceres CLONE 1522410
MSPVTALLAGTVVPPASAPSPARHARHYSVGFSPLHGGGRAALAVECSSRPQKKGTKHHMKTRPQKTQPWDIKRRPRSTRAAALPRTGARRLGATWT

SEQ ID NO: 61141 - DNA, 641 bp, Zea mays
  misc_feature: Ceres CLONE 1522411
  misc_feature: Translation starting site: 143
  misc_feature: SWISSPROT Homolog: EC 6.3.2.19 Ubiquitin--protein ligase
ggtggcggccgctctagaactagtggatcccccgggctgcaggaattcgtctcacccctagaaaaagaaaatggcaacaccggcgaatagcggtttctctgattctctccgtcgcttgacgtcgtctccgcctccgtctttcatgaagatgtctattcccatccccgagaaccaaaacccctactttgaaaaggtactcctctcattcccgagaggaggtgaacgagatcacttgcgatcggatgcgcaacgactcgacgagtggggctcatcctcccctgctggattctcgcacgaggtctccgatctcctacaataggtggttaattagaggtcactggatcggcgtgcagcctttactccggggagacctaccaattgcaagtagaattacctgagcattatcctataggagcacctcaagtcatttttcgcgatcctctgccagtgcatccatccatctagcggaacaggcacatctgctgagatattttgtatgactgcgaggtctccaccgatgacggtgagctctgtctgtatcggtatactgtctatgttgtctagatcgccagcagagcagcgtccactgtgacaagaccgctatgtcgtgatctgccgcaacgataggtttaccaggagac

SEQ ID NO: 61142 - DNA, 774 bp, Zea mays
  misc_feature: Ceres CLONE 1522411-R
gagcgtctcgtttttttttttttttttgcaaaagtaattcctctctgaatcaggggtaccattctgatagataacactgctgcattttagtttctacctctgacagatctgaatgagatacaatttgagtaacccacactcttaatgcctgataggttggcaggataaagcaaatcggggcaagccattacgccttctgggggtacacataagtgaggccgcaccttccccaatatcggctggacaagaggttcgccatcaaggaacgctgtccggaccccaagttgagggcagtcctcatggaagcaccatcaccgtgtcattggggtactccaccttatagaactgcatgacagagagctcatcgtccacgtggactgtgcttgatctggcttaacgcttacgacatagactggatactgatacagacagagcccacgcgtgatgcggtagagaccacggagacggtcgaacacatctaagcaagatgttaccccgttgcagggtgaataacctgcactccatttggcctctgccaattgaaaaaaaaagcaccctgacggtgcccccggggggaaaaacaaatgcctccaggggcaaaaaaaaacccgggccaaaccgggaaaggggcccacgggccgggcccctaaaaagagggtcacccccccccccaaaaccgagttggggcccttttaaaatttaaccccaaaaaatttttttttaaagggtaaatatatcgcgggaaaaaaccccttgggggcccggctgaaaaaa

SEQ ID NO: 61143 - DNA, 465 bp, Zea mays
  misc_feature: Ceres CLONE 1522414
tggagctccccgcggtggcggccgctctagaactagtggatcccccgggctgcaggaattcgtctcacccctagaaaaaactgccagcaggtgccaccgccatctctgctctgctctcgcaacgcaagcacacgcccggccgcctgccacagttgccatggcgaccatagccacgatggcgctgctgaagcccgccgccaaggccgcgggcgcgggttcggcgcccgtcacccaccaaccggaaggcgtcttcgtttgccgcgttcccggaaaagggggaaaaggcccccccaaaaaaaaggggggccctttttcccgggtttccccccttttttcacaaaaagtttggggggggggggggggccctttctttttttcctccgggggggattttttgggggggggatttttttcccccccccccaaaaaaaaaaaaaatatttttttttttgtgggggggggggg

SEQ ID NO: 61144 - DNA, 672 bp, Zea mays
  misc_feature: Ceres CLONE 1522416
  misc_feature: Encodes the peptide sequence at SEQ ID NO. 61145
  misc_feature (561)..(561): n is a, c, t, g, unknown, or other
ggagctccccgcggtggcggccgctctagaactagtggatcccccgggctgcaggaattcgtctcacccctagaaaaacacaatcaagaccaagcgcaccatccagttcgtggactggtgcccgactggcttcaagtgcggaatcaactaccagcctcccagcgtcgtccccggcggtgacctggccaaggtgcagcgtgccgtgtgcatgatctccaactccaccagtgttgtggaggtcttctcccgcattgaccacaagttcgacctcatgtacgccaagcgcgccttcgtgcactggtacgtcggtgagggtatggaggagggctagttctccgaggctcgtgaggatctggctgcgctcgacaaggactactaggaggtcggtgctgagtttgactagggtgaggacggctacaagcgtgacgagtactatacgctctactggcgcgccgtcgtcgggcttgtgtgccaatgctatccctgggatttgccatgagtgctcccaaccgggttacgtttctgcccggttcttaaaagaaaaaaaaagggggaattagntttaaaaaagtgcccgcccccccgaggtacccatttcccctataggggggcattttaccccgcctccctgggccctctttttaaacaccgggggggggaaaaaccctggtt

SEQ ID NO: 61145 - protein, 40 aa, Zea mays
  misc_feature: Ceres CLONE 1522416
MISNSTSVVEVFSRIDHKFDLMYAKRAFVHWYVGEGMEEG

SEQ ID NO: 61146 - DNA, 676 bp, Zea mays
  misc_feature: Ceres CLONE 1522417
  misc_feature: Encodes the peptide sequence at SEQ ID NO. 61147
  misc_feature (347)..(347): n is a, c, t, g, unknown, or other
aaagctggagctccccgcggtggcggccgctcctgaactagtggatcccccgggctgcaggatattcgtctcacccctagaaaaaatgcccatccatcatcacacgacgacgcacacaagtcgcagctagctagctcccaaccgagccaggaaaacggacgccgtgcagctcgctcgcgcgcgccccacggaaagagagggcaggtaggaataatgtaccaggccatcccgtacagcgccggccagccgtggccgcggccggccccgacgatcggtcctgacgtggcggaggtaggaggggttgctggcggcttcgcagcagcaggcgtcgacgccagcggaggcgnggcgtagggtggaggaactacgaggtgaggctgaacgaggggcggagtccccagccctcgcggtggacttgggcgtggagcagccccaggcgatggactgcaaggcctgctcgcggccagtccgggtcgaaatccgtcgtcccacacagactgccgggcggccatcatgggaccacgaaggacggcccgcgcgggaagagcctcccgagggaaggttcctagggttccttccattcaaggaaggcttataatctttgtttggggccctgccctgcctgtgcttaccctccttcacacttaaaagtaccgagtctatgttaaccttgaat

SEQ ID NO: 61147 - protein, 46 aa, Zea mays
  misc_feature: Ceres CLONE 1522417
  misc_feature (45)..(45): Xaa is any aa, unknown, or other
MYQAIPYSAGQPWPRPAPTIGPDVAEVGGVAGGFAAAGVDASGGXA

SEQ ID NO: 61148 - DNA, 601 bp, Zea mays
  misc_feature: Ceres CLONE 1522419
  misc_feature: Encodes the peptide sequence at SEQ ID NO. 61149
  misc_feature (389)..(389): n is a, c, t, g, unknown, or other
  misc_feature (398)..(398): n is a, c, t, g, unknown, or other
ggagctccccgcggtggcggccgctctagaactagtggatcccccgggctgcaggaattcgtctcacccctagaaaaagctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccntttttgacnagaaatcattttgtgtcttacatcaaaaaatacattcaagaatctcaactgctgtgtttggagccaagagaaagcgggatgaagttcaaaaaagggtgtcgaaggggtgcaaccccaagttttctccttaagcaagctgaaaggacctccatttttttgttggtgagtccatgaaggatgatgcctccgggggaatccgctat

SEQ ID NO: 61149 - protein, 140 aa, Zea mays
  misc_feature: Ceres CLONE 1522419
  misc_feature (1)..(139): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDIVDTFRLQEQPPFLTRNHFVSYIKKYIQESQLLCLEPRESGMKFKKGCRRGATPSFLLKQAERTSIFLLVSP

SEQ ID NO: 61150 - DNA, 654 bp, Zea mays
  misc_feature: Ceres CLONE 1522424
  misc_feature: Encodes the peptide sequence at SEQ ID NO. 61151
aaagctggagctccccgcggtggcggccgctctagaactagtggatcccccgggctgcaggaattcgtctcacccctagaaaaaattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctgcgctcgcaagtacaaccaggacaagatgatctgccgcaaggtagaagtggtgggaggggtgtttttgcaaaaaatacagggcagcgagatggctgttggatccagaatgaattgtcgcaatttaatatatgtaccatgtacaccaaaggtgacacagatgctatgcacggctgcacccctagggctgtcaactgccgcaaagaagaagtgtggtcacagcaacccagctgaaggccaagaagaaaa

SEQ ID NO: 61151 - protein, 161 aa, Zea mays
  misc_feature: Ceres CLONE 1522424
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGIIEPSLQALRSQVQPGQDDLPQGRSGGRGVFAKNTGQRDGCWIQNELSQFNICTMYTKGDTDAMHGCTPRAVNCRKEEVWSQQPS

SEQ ID NO: 61152 - DNA, 590 bp, Zea mays
  misc_feature: Ceres CLONE 1522426
  misc_feature: Encodes the peptide sequence at SEQ ID NO. 61153
ccccgcggtggcggccgctctagaactagtggatcccccgggctgcaggaattcgtctcacccctagaaaaaatctcacggctagctagcacaagcatagtgaaggggcttgccacctaagtaaggcccgcctgagagccatggcatccaaggccgtcctcttcttggctctcaacctcctgttcttcacatgtggccaacgcctgctggcaactgctccgaccccatacgccccctggtcgagccaccgcctgcctgcctcctgactgcgtaccccaccccctttcgttccagcggggcaatggggccgcctttaaacgcccctaaagggtcgggggggtgggcccccaaattttttcggcccccccccaaaaaggaaaggtttttaaaggggccccccccaaaaacaattattgtccccccccccaaaaaaaaaaggcttccttgggggaaaaaatattggggggggggcgcctcttttattctctttttttttagaatagaatactttttttggtggtgtgttcacgaagaaagagcggcgcgcgccgtcttttcccactcctaaaactattgcttttctccccccc

SEQ ID NO: 61153 - protein, 41 aa, Zea mays
  misc_feature: Ceres CLONE 1522426
MASKAVLFLALNLLFFTCGQRLLATAPTPYAPWSSHRLPAS

SEQ ID NO: 61154 - DNA, 603 bp, Zea mays
  misc_feature: Ceres CLONE 1522428
  misc_feature: Encodes the peptide sequence at SEQ ID NO. 61155
tcaccgcggtggcggccgctctagaactagtggatcccccgggctgcaggaattcgtctcacccctagaaaaaacaggcaacaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcaactgcaactgaacccggcccgcccggcccggcgaaggggcacgaaagtcgagaggacaacaacgaagtaggcgtaataaatataataacagcgtcaaaaaaaaatcctgtcaacggcaccccccattaatcattcctggtccgctcccgggggttcaaggtcaactggagaaaggggcttccgggtcctgggcccgttttataagcccggaaactaaa

SEQ ID NO: 61155 - protein, 80 aa, Zea mays
  misc_feature: Ceres CLONE 1522428
  misc_feature (1)..(79): Pfam Name: Metallothio_2 Pfam Description: Metallothionein
MSCSSGKCNCGSSCSCGSSCNCMSPDVETAAASSIKTMVLAAPTTKASAGGFEAATEGGGCDCNTCNCGTSCGCSCCNCN

SEQ ID NO: 61156 - DNA, 536 bp, Zea mays
  misc_feature: Ceres CLONE 1522430
  misc_feature: Encodes the peptide sequence at SEQ ID NO. 61157
  misc_feature (298)..(298): n is a, c, t, g, unknown, or other
ctggagctccccgcggtggcggccgctctagaactagtggatcccccgggctgcaggaattcgtctcacccctagaaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtggcccnaaatcccccctcccccccagaggggggggaaaaaaaacgttttaaaccccccggaagggggggaattttggaacatcccccccaaagaaaacccctttgtaaaaaaaatttgtgtttttccccaaaaaaaaaccaaaccccccccggggggggggcccaaaaaagggggtttttttaggggggggggggggggggaaaaatttttttttttaaaaaaaaagaaaaccacctttttttt

SEQ ID NO: 61157 - protein, 62 aa, Zea mays
  misc_feature: Ceres CLONE 1522430
MLVYQDLLSGDELLSDSFTYKELENGVLWEVEGKWVTQGPVDVDIGGPKSPLPPRGGGKKTF

SEQ ID NO: 61158 - DNA, 590 bp, Zea mays
  misc_feature: Ceres CLONE 1522436
  misc_feature: Encodes the peptide sequence at SEQ ID NO. 61159
  misc_feature (315)..(315): n is a, c, t, g, unknown, or other
  misc_feature (324)..(324): n is a, c, t, g, unknown, or other
ggagctccccgcggtggcggccgctctagaactagtggatcccccgggctgcaggaattcgtctcacccctagaaaaactcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaangcacagaanggcgcgattggggggctcgggtctgaaagaaaatggaaagaaatgagactggtcacccgtctccaatacctagaggatgatgaagcagctgtctatctgtgttgcgcttcactaagtgtgattgtaacagtggtaccttctgtggttctgtgtccccgatgttccaattggttgcttgattcaaagatgtttcaacctcccatctgctagctatgaccagaagggtcccctgaatataatgatgacggaaaaaaaaaaaaaaacag

SEQ ID NO: 61159 - protein, 117 aa, Zea mays
  misc_feature: Ceres CLONE 1522436
  misc_feature (1)..(62): Pfam Name: TMA7 Pfam Description: Translation machinery associated TMA7
  misc_feature (45)..(45): Xaa is any aa, unknown, or other
  misc_feature (48)..(48): Xaa is any aa, unknown, or other
MSKQGGKAKPLKAPKADKKEYDETDLAYLQKKKDEEKALKELKAXAQXGAIGGLGSERKWKEMRLVTRLQYLEDDEAAVYLCCASLSVIVTVVPSVVLCPRCSNWLLDSKMFQPPIC

SEQ ID NO: 61160 - DNA, 704 bp, Zea mays
  misc_feature: Ceres CLONE 1522437
  misc_feature: Encodes the peptide sequence at SEQ ID NO. 61161
  misc_feature (476)..(476): n is a, c, t, g, unknown, or other
  misc_feature (477)..(477): n is a, c, t, g, unknown, or other
  misc_feature (562)..(562): n is a, c, t, g, unknown, or other
  misc_feature (594)..(594): n is a, c, t, g, unknown, or other
  misc_feature (603)..(603): n is a, c, t, g, unknown, or other
  misc_feature (621)..(621): n is a, c, t, g, unknown, or other
  misc_feature (622)..(622): n is a, c, t, g, unknown, or other
  misc_feature (702)..(702): n is a, c, t, g, unknown, or other
ctccccgcggtggcggccgctctataactagtggatcccccgggctgcaggaattcgtctcacccctagaaaaagtcttccactcgggggccgtcgtcttctctgcctccatctactcgggggccgccgtccctgtcgtcttccgcccatcactgtcttcttcgttccaccacacttgggaaacgcagcgatggatggccagccaggtgctgcggcgtcgtctagtcctggtcggagagtaaaagcaagcctggtcctaggatccgaatcgttcactatcaactccgagtccggtaccctgtcggagcatctggccacggtgaaggagaagaacatggggggtcctttttgaacccccccccagggcagggggggtggcgaacaacgtcccccgacgaaggccccccaagggcggaggctgaaaatcaaagaaaaaaacggggcttgggcgaacaacccggccggaagaaatcccnnagagaccataaagtgaatagtactataaatgtcgccgcgtaaagttagtattttatttttgttggccaaacacgtgcggcctaanattatccaatagggggtgttattctcacatanacacaattnagacacgagtatatagannagaatatttataatatcaataaggaccatgtagttaagtatatataacacccccggaaaacaagaacgacaaatatatangc

SEQ ID NO: 61161 - protein, 53 aa, Zea mays
  misc_feature: Ceres CLONE 1522437
MDGQPGAAASSSPGRRVKASLVLGSESFTINSESGTLSEHLATVKEKNMGGPF

SEQ ID NO: 61162 - DNA, 672 bp, Zea mays
  misc_feature: Ceres CLONE 1522439
  misc_feature: Encodes the peptide sequence at SEQ ID NO. 61163
  misc_feature (412)..(412): n is a, c, t, g, unknown, or other
  misc_feature (413)..(413): n is a, c, t, g, unknown, or other
  misc_feature (429)..(429): n is a, c, t, g, unknown, or other
  misc_feature (480)..(480): n is a, c, t, g, unknown, or other
  misc_feature (533)..(533): n is a, c, t, g, unknown, or other
  misc_feature (534)..(534): n is a, c, t, g, unknown, or other
  misc_feature (577)..(577): n is a, c, t, g, unknown, or other
  misc_feature (578)..(578): n is a, c, t, g, unknown, or other
  misc_feature (626)..(626): n is a, c, t, g, unknown, or other
  misc_feature (627)..(627): n is a, c, t, g, unknown, or other
  misc_feature (629)..(629): n is a, c, t, g, unknown, or other
  misc_feature (630)..(630): n is a, c, t, g, unknown, or other
  misc_feature (645)..(645): n is a, c, t, g, unknown, or other
  misc_feature (667)..(667): n is a, c, t, g, unknown, or other
  misc_feature (668)..(668): n is a, c, t, g, unknown, or other
  misc_feature (670)..(670): n is a, c, t, g, unknown, or other
gctccccgcggtggcggccgctctagaactagtggatcccccgggctgcaggaattcgtctcacccctagaaaaaacatgtgcaccggagcttgacgcaaaggggagccgtagcctgtagagtgcggggagcaggagccggcggagccatggcgaccactctttcgttatcctctcccctcttcctcggagctccggccagagctagagatgtggttccgtacggagtgacttgggctagtgtatcactgaggactctaaatgtgccaggcaagggttacaccagtagagttcgttgtcgggagcaccagtgacgaacggcaataacatctatgcttggaaggaaatcaacggcttgagcccctgttggggcggagggcgaccatttgttgccaatccccatacttgggganngctagtgcttttggantttgccggaaaatcttcctaggaagttggacctgttaagaattgctagggntttcttacttttgttgcataaacaacaaaaaagaggggccgtcttttcttaannaaggccctcgcaggttacatgtctggagaacctcttcccgggnntcttgtgaaaaatattttctgccgtccgtctctattccgttttttagnnannttatattctctacangctctcaacatggtactgcccnnanat

SEQ ID NO: 61163 - protein, 54 aa, Zea mays
  misc_feature: Ceres CLONE 1522439
MATTLSLSSPLFLGAPARARDVVPYGVTWASVSLRTLNVPGKGYTSRVRCREHQ

SEQ ID NO: 61164 - DNA, 804 bp, Zea mays
  misc_feature: Ceres CLONE 1522451
  misc_feature: Encodes the peptide sequence at SEQ ID NO. 61165
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (245)..(245): n is a, c, t, g, unknown, or other
  misc_feature (453)..(453): n is a, c, t, g, unknown, or other
  misc_feature (456)..(456): n is a, c, t, g, unknown, or other
  misc_feature (747)..(747): n is a, c, t, g, unknown, or other
nnnnnnnnnnnnnggggnnnnnnnaaaaaaccgttnnnnnnnnnnnaannnnnnnaaatactggggctccccgcggtggcggccgctctagaactagtggatcccccgggctgcaggaattcgtctcacccctagaaaaaacaggcacgccagcctcactccccagaccacctcacacgcacgaagcatcagcagtggactggactagctctaggtgggcaacatgaagcttcagaccaccgtcnccgttgctggcctcctcctcttcctcctcctcctggggctgccttccctccgcgtctcctggggtggatcagggttctgcgaccgcaaattctctttcgaccgcgctcaaaggggaacccggcccaacaactttcttctgtattgggggaatcggctggcgcccttgctttttttttcccccccccggagggggggagaaggggggancantttcccttttttttcccctatcatttctccacagaaaaaaaaaaacccctccaattctcaggggggggctgggggggggggggcgattcctctctccctaggcatattagctaaagataaatcattcacgggctacggcgtgatcttcgggagtggcgtccgtttctcgtaccgggggggggaccccctcctccccggggtcggggccgctgtcccccgcacctccccttcttcccggggaggttccgggcccacgcagtcttgtgctgtgtttgctgcagaaatgtgacngcggatggcgccaggggggagcggagggctgtcagggcgggggaggatggtcttcgg

SEQ ID NO: 61165 - protein, 173 aa, Zea mays
  misc_feature: Ceres CLONE 1522451
  misc_feature (8)..(8): Xaa is any aa, unknown, or other
  misc_feature (77)..(77): Xaa is any aa, unknown, or other
  misc_feature (78)..(78): Xaa is any aa, unknown, or other
MKLQTTVXVAGLLLFLLLLGLPSLRVSWGGSGFCDRKFSFDRAQRGTRPNNFLLYWGNRLAPLLFFSPPRRGGEGGXXFPFFSPIISPQKKKNPSNSQGGAGGGGAIPLSLGILAKDKSFTGYGVIFGSGVRFSYRGGDPLLPGVGAAVPRTSPSSRGGSGPTQSCAVFAAEM

SEQ ID NO: 61166 - DNA, 647 bp, Zea mays
  misc_feature: Ceres CLONE 1522452
  misc_feature: Encodes the peptide sequence at SEQ ID NO. 61167
atagctggagctccccgcggtggcggccgctctagaactagtggatcccccgggctgcaggaattcgtctcacccctagaaaaaagtgacgaactcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcaccaccaagtacaggtgccgcgacttcctccccgaaaactgcggctgcaagatccactagactcatccacagcggcacagccgatggatccttccatgctcctccgtccgtccgccttgctataagcaggcaggcagccaccaataagctagctcttgctgttgttttgcatgtttgattgggtgtcccttccagtcgagatggaataaaaaaatgtcaggcggcaaaaaaaaaaaaaaacgaaaccctcggaggacccaattcgccccataagagaggcgt

SEQ ID NO: 61167 - protein, 89 aa, Zea mays; identical to SEQ ID NO: 50292
  misc_feature: Ceres CLONE 1522452

SEQ ID NO: 61168 - DNA, 739 bp, Zea mays
  misc_feature: Ceres CLONE 1522454
  misc_feature: Encodes the peptide sequence at SEQ ID NO. 61169
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (234)..(234): n is a, c, t, g, unknown, or other
  misc_feature (237)..(237): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (428)..(428): n is a, c, t, g, unknown, or other
  misc_feature (429)..(429): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (436)..(436): n is a, c, t, g, unknown, or other
  misc_feature (437)..(437): n is a, c, t, g, unknown, or other
  misc_feature (439)..(439): n is a, c, t, g, unknown, or other
  misc_feature (441)..(441): n is a, c, t, g, unknown, or other
  misc_feature (451)..(451): n is a, c, t, g, unknown, or other
  misc_feature (452)..(452): n is a, c, t, g, unknown, or other
  misc_feature (486)..(486): n is a, c, t, g, unknown, or other
  misc_feature (522)..(522): n is a, c, t, g, unknown, or other
  misc_feature (544)..(544): n is a, c, t, g, unknown, or other
  misc_feature (574)..(574): n is a, c, t, g, unknown, or other
  misc_feature (617)..(617): n is a, c, t, g, unknown, or other
  misc_feature (650)..(650): n is a, c, t, g, unknown, or other
  misc_feature (691)..(691): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (717)..(717): n is a, c, t, g, unknown, or other
  misc_feature (723)..(723): n is a, c, t, g, unknown, or other
  misc_feature (724)..(724): n is a, c, t, g, unknown, or other
nnaatctnnnnnccccaactaggaatcccccccgtggcgggcgctctagaaattatggatcccccgggctgcaggaattcgtctcacccctagaaaaaaatcagtcgcatctccctctccgaaatcaaggtagcgtacaccgctgcagtttctagagccctctctgccactcgtgatcccactagtgaaaatgcctgccctcgccaagcccgcctcccgcaccgccaagcccgncgnggctcctaaaccgaagcctgccgccgccaaacctaaagcgggcaccgctggtccctcccccccccccctaatacaaaagtgaaccttgtccaccttttttttttttttttaaaaaaatggaaatatggatttgggtgttttttttttccccccccccccaaaaagaggaaagaaaggggggggnnnnnntnntcnnntnntntnttttcccccnncccctaaaaaaaaaaaaaaaaaaaaactcccccncgccccggggggggggggggcccattaatactatcncaaaaacaaaacaaaaaacacnaaccagacgacaacacccaagcatccaganaacaaaaataataagaaacacaaactcccctaccacacaccantaaagcatcagaaagataaaaccaaataagaancaaaaagatccatacacatccaataacaaacacgacccccncacaaaaaaaactatgnnncatagcncacacnnactcgccaccaccac

SEQ ID NO: 61169 - protein, 42 aa, Zea mays
  misc_feature: Ceres CLONE 1522454
  misc_feature (15)..(15): Xaa is any aa, unknown, or other
  misc_feature (16)..(16): Xaa is any aa, unknown, or other
MPALAKPASRTAKPXXAPKPKPAAAKPKAGTAGPSPPPLIQK

SEQ ID NO: 61170 - DNA, 570 bp, Zea mays
  misc_feature: Ceres CLONE 1522455
  misc_feature: Translation starting site: 163
  misc_feature (373)..(373): n is a, c, t, g, unknown, or other
ccccgcggtggcggccgctctagaactagtggatcccccgggctgcagggaattcgtctcacccctagaaaaactctagccaaaaccctagcagccgcccggtgctccctctctgcagatctcccttcgcagccgccgaggaaccccttcacagcgcggaagatggctgaacaggaggccccagtcgcggttgaggcaccaaccccagttcttggggagcctatggacttgatgactgctctgcagctcgtgatgaagaagtcaagtgctcatgacggtcttgtgaagggtctccgtgaggctgcaaggccatcgagaacacgccgctcagctttgcgtgcttgctgaggactgtgaccagccagattacgtncagttggtgaaggcactctgcgctgagcacaatgttcacctggtcactgtttctggcgcttaaactcttggccaagggggccgggcttttgcaagattgactctgaagggcaagggcaaggaagggttgtagggttgctccctggggtcggtcgttaaagggattaccggggaaaaaatctcggaggggccctttaa

SEQ ID NO: 61171 - DNA, 735 bp, Zea mays
  misc_feature: Ceres CLONE 1522458
gctctataactactggatcccccgggctgcaggaattcgtctcacccctagaaaaaagaacgatctcaatctccctagcaatctctagcagcagatcctcgtgcgaagcaaagcgctagcccccttcgtactgtcccgatggcccgcacgaagcagacggcgaggaagtccactggcggcaaggcgccaaggaagcagctggccaccaaggcggcgcgcaagtctgtcctcggccaccggcggagtgaagaaccccccccgtttccgccccggcaccgtccagctcctggagatccgccatgtaccataacacactagaacctgctgatcccctaacctggccgttccacgcggggtgggggcggcgagatttccctacaatctattaagaaccccccacccgtttccgagaagacccgacctccccctaatacggcttatcaggccatctcaaagcccctctcttccttttccgtttatttcctatccctttccaactcctttgtccccccttcacccattatacccttttttcctctctcttgtttccagcggtcctttctccgtttctcgcttccctaaccccctgtgcgctcacgtgccctacccccttctcttaccttcctttatttctcgtaatttatccccccctctatatatatccactttctcccagacacttgcaccaatgcagtagggtttattttcacaccctattacaaccctccctctttg

SEQ ID NO: 61172 - DNA, 793 bp, Zea mays
  misc_feature: Ceres CLONE 1522459
  misc_feature: Translation starting site: 173
  misc_feature: Pfam Name: AIG2 Pfam Description: AIG2-like family
  misc_feature (41)..(41): n is a, c, t, g, unknown, or other
  misc_feature (42)..(42): n is a, c, t, g, unknown, or other
  misc_feature (793)..(793): n is a, c, t, g, unknown, or other
atttttttctttactctacccccatgcatttgatttaatannccccgccccctcaaaactgggactccccgcggtggcggccgctctataactagtggatcccccgggctgcaggaattcgtctcacccctagaaaaagtcaaaccaactagagcacccggaccagacgcccatgtcgaccgctatggcgatgaagccgggggcggcggtgtccccctaccccggccgcggtgcacagcgtggtcatctacgggagcttgatggcgctccagatggtctgaaccagcctcaagcgcgtgccgacagccgccccggccttcctcccatactacttaccggttttacaaccacgggcgcatttccccggagatcctgcctgttgataccaacatagttgctgggagggttatcatgtgtgttactggtgaaaagctccctcttcttgacccgtttgaagacccccacccccctacgacattagttgacatgtcatatggtttactcttctccaaaacatgcttggctgatacttgacccgagcgggttgtgacaaagggatccccagttttcttgtaaaagaggggggcattagggacgtgggtaaatgccggttcttttgaacccacttctcgtgtctgcccaccaaatcgcttttccgggccccttaatgtccgccccccatccttgaatcccctatcaaccctgaggaggggccgaccattaatcatgtgaacttttattgcgcttcttgcccagggaataacatggcctgtggccccttcggttttaaccn

SEQ ID NO: 61173 - DNA, 553 bp, Zea mays
  misc_feature: Ceres CLONE 1522460
  misc_feature: Encodes the peptide sequence at SEQ ID NO. 61174
  misc_feature (245)..(245): n is a, c, t, g, unknown, or other
  misc_feature (366)..(366): n is a, c, t, g, unknown, or other
  misc_feature (367)..(367): n is a, c, t, g, unknown, or other
ctggagctccccgcggtggcggccgctctagaactagtggatcccccgggctgcaggaattcgtctcacccctagaaaaaaaaaagccgccgccgccgccaccgccacctgccccagcgcgccgccgccgcagccaccatgggtcgcgtccgcaccaagaccgtgaagaagacctccaggcaggtgatcgagaagtactactcccgcatgaccctcgacttccacaccaacaagaaggtgctctngaggaggtcttcgatttcttgccccttcgaaaaggcccttccccaaaacaaggggggggtgggggttcttaaacccccccctggaagggccgccataaccggggggggcccccaatctccnngggggttttttttttggggggggaaagaggggggggccccccagggtttttcccccaaaaaaacttccccccttaggaaaaaaaaaaaccccctcccccccaaaaaaccgcggggggttccctttcctcctccctaggggaaacaccccccccgcggtgaaccccccccgggtgagtggtcccccc

SEQ ID NO: 61174 - protein, 121 aa, Zea mays
  misc_feature: Ceres CLONE 1522460
  misc_feature (36)..(36): Xaa is any aa, unknown, or other
  misc_feature (77)..(77): Xaa is any aa, unknown, or other
MGRVRTKTVKKTSRQVIEKYYSRMTLDFHTNKKVLXRRSSISCPFEKALPQNKGGVGVLKPPPGRAAITGGGPQSPXGFFFWGGKEGGAPQGFSPKKTSPLRKKKNPLPPKKPRGVPFPPP

SEQ ID NO: 61175 - DNA, 807 bp, Zea mays
  misc_feature: Ceres CLONE 1522461-R
tggggtcctcgagcgtctcgtttttttttttttttttggattatgcgggcgtcaaattcctcaatggagttgtttttatccatccggtattagttacccattgatatttcttatctttgcagacggcgattccggaaaggagactgccttctgtctaggcaaaaggaacaccttattttgtaaggggaaccctggactgctataacatacatacccaagagtcgcatatgtgactcaatgtgaagaaaggtgcacacatacatccctcaatccatggatatgcagacattgccatggtgatggagctgagcaagaacacctgccatgtctcatgcacccgggattaacctaaataaaacgactctaacggagctcaacaggagaaggcttgtcaacaggtacttgatttcaaccctgcctcttgcgcgttgcttccactttcgccccagtcttctttttgaaagccatcggggcactccagatcctttgaaaattttttcggctcttttccccagggagctttcccccaattcaatggggcccttataggaaattggaaaccccccggcgaagatttcccttcccctgaaatttgaaacattttcaagggcccaaaattttttttttgtccaaccggggcttaacccggatgaaacccttcccaaaaaattaagggcccatgggggctccataacctcggggtgccaattttggggaaattccccccaaaaaaaagggggataaaaggggggcccccccatttctgtgggggggggcgttttatgttggtgggctaatttaacaccc

SEQ ID NO: 61176 - DNA, 732 bp, Zea mays
  misc_feature: Ceres CLONE 1522464
  misc_feature: Encodes the peptide sequence at SEQ ID NO. 61177
  misc_feature (533)..(533): n is a, c, t, g, unknown, or other
  misc_feature (534)..(534): n is a, c, t, g, unknown, or other
  misc_feature (541)..(541): n is a, c, t, g, unknown, or other
  misc_feature (542)..(542): n is a, c, t, g, unknown, or other
  misc_feature (585)..(585): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (615)..(615): n is a, c, t, g, unknown, or other
  misc_feature (616)..(616): n is a, c, t, g, unknown, or other
  misc_feature (687)..(687): n is a, c, t, g, unknown, or other
  misc_feature (704)..(704): n is a, c, t, g, unknown, or other
  misc_feature (725)..(725): n is a, c, t, g, unknown, or other
aagctggagctccccgcggtggcggccgctctagaactagtggatcccccgggctgcaggaattcgtctcacccctagaaaaaaccaagcccactcctctgctgccgcattccaagtttccagccccttcccattcctctcaacggtcaacccagagccaccagcagcgccatcagcaggagagagatcgccggagccatgacaaggggcggcggaggcgacatgaagtccttcttccgtctgcagaagacgcaagccgacgccgccaatactaagaccactggttgcgtctccaaaaaagcgggggaggcttaccgcaagaaagtcggatttctcagcgacatatcatccggccccagataactgcgcctgtcacctgcagcacgggggagggggtatgcgggagcaataccgtagaggggggggcctacgagctgtcaacatggacacgctctcttaccaaggcccatgccttcgcgtcacacaccaccccccgggcggtgtggggtgacttcgacttgcgagctttgggnntccttgnntaaccgccgccccgggggaaatcttcctcgactctggcgagancacgccnnnnnncctgatcttgggaagggnnccgcgtccagatggatgacatcccgtccgcgctgatcaccgaatggctacattcagagtacagcacgagtnctgaagtccggagaggncgcggtctcagtcatcccaancagcatc

SEQ ID NO: 61177 - protein, 54 aa, Zea mays
  misc_feature: Ceres CLONE 1522464
MTRGGGGDMKSFFRLQKTQADAANTKTTGCVSKKAGEAYRKKVGFLSDISSGPR

SEQ ID NO: 61178 - DNA, 695 bp, Zea mays
  misc_feature: Ceres CLONE 1522468
  misc_feature: Encodes the peptide sequence at SEQ ID NO. 61179
aagctggagctccccgcggtggcggccgctctagaactagtggatcccccgggctgcaggaattcgtctcacccctagaaaaaatctgagttcctgattgttgtattccagtttcttctgtgagttttgtgggatcgcgaggaagaactagaaggatgtcgtgctgcggaggcaactgcgggtgcggcgccggctgcaagtgcggcagcggctgcggagggtgcaagatgtacccggacatggctgagcaggtgaccaccactacccagactctcatcatgggtgttgcaccgtccaagggcgggttcgaggcggccgccggagctgagaacggcgggtgcaagtgcggcgccaactgcacctgcgacccctgcacctgcaagtgagacgacggcgatgacgctgcagggcgtcatgggatcggaaggactcttttatcttaagctctagtataatattctagcagtgtcgtttgtgttttgttcgagtcagtcagacagtcagccgcgtgccatgggccatggcatagcatgccattgcctcgctctatctgctccatcgcctttttctagtggtggtactgatgggggaacgaataattgtaccgagatgttggcgccgtgtcgtgtcgtgtcctgtcctgtccttcctgggactcatctagctagcagtcagactgtgttgtgttgtgttgt

SEQ ID NO: 61179 - protein, 76 aa, Zea mays; identical to SEQ ID NO: 6267
  misc_feature: Ceres CLONE 1522468
  misc_feature (1)..(75): Pfam Name: Metallothio_2 Pfam Description: Metallothionein

SEQ ID NO: 61180 - DNA, 712 bp, Zea mays
  misc_feature: Ceres CLONE 1522470
  misc_feature: Encodes the peptide sequence at SEQ ID NO. 61181
tggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaagtgtggccggcctacagcaacaagaagttcgagacgctgtcctacctgccgccgctgtcgacggaatacctgctgaaccaggtggattacctgctgcgcaaccgccggaaaccccccccccagattagcacggtcgggcttcccgtaccggaaacaactccaccccttcgcggtactcctaccggcccgttcccggcccaatgtaaaaaactcccccatgaccgggctgcaacaaatatccccccaggtgttattatcccctctttatggaggcccttaaaaccccccccctaaatcgccccccacaaaataccaaaaccgcctctgataaacccccccccataaaacccccgccgccaatatctataccgcgctaaaccgattctcctcttatatcaaccccacccacccttattctacccctcgacctttttccccc

SEQ ID NO: 61181 - protein, 146 aa, Zea mays
  misc_feature: Ceres CLONE 1522470
  misc_feature: SWISSPROT Homolog: EC 4.1.1.39 Ribulose-bisphosphate carboxylase
MAPTVMMASSATAVAPFQGLKSTASLPVARRSSRSLGNVSNGGRIRCMQVWPAYSNKKFETLSYLPPLSTEYLLNQVDYLLRNRRKPPPQISTVGLPVPETTPPLRGTPTGPFPAQCKKLPHDRAATNIPPGVIIPSLWRPLKPPP

SEQ ID NO: 61182 - DNA, 736 bp, Zea mays
  misc_feature: Ceres CLONE 1522472
  misc_feature: Encodes the peptide sequence at SEQ ID NO. 61183
aaagctggagctccccgcggtggcggccgctctagaactagtggatcccccgggctgcaggaattcgtctcacccctagaaaaaatagccatcttccttccgcggactagttttttctcaagattccccgatggcggcgacgatccagtccgcgaaggcgcgccagatctttgagcgccgcggcaaccctgcagccgaggtcgacctgttttgctcagatggagcctttgccagggctactgttcccagtggagcatcaactggtgtacatgaagctctgaagttgagggatggcggctctgactatttggggaaaggcgtctccaaggctgggaccaatggggaatccggtcatgggacctgccccgaatgggcaagaaccccccgccacagaccggagactgaaaaatttggggggttcaaaccccgggtggggccccccaaatcacggggcgcgtggtgggaagaaaaaaccttggggggcaaagggaaaaaacgggctacccccccaatgggggtttctttccaaaacgggggcccctatcccacgcgggagagatcctttttttaagaagggggtggattttccccccctaacccatttgtttggcggacaacaacaaacccatatatttttgggtttgccgccccttccccctccctccccgtttttgcggggggaggggccctctcccttagggcggcggggccgccccccattttttctcgaaataaa

SEQ ID NO: 61183 - protein, 146 aa, Zea mays
  misc_feature: Ceres CLONE 1522472
  misc_feature (4)..(146): Pfam Name: Enolase_N Pfam Description: Enolase, N-terminal domain
  misc_feature: SWISSPROT Homolog: EC 4.2.1.11 Phosphopyruvate hydratase
MAATIQSAKARQIFERRGNPAAEVDLFCSDGAFARATVPSGASTGVHEALKLRDGGSDYLGKGVSKAGTNGESGHGTCPEWARTPRHRPETEKFGGFKPRVGPPKSRGAWWEEKTLGGKGKKRATPPMGVSFQNGGPYPTRERSFF

SEQ ID NO: 61184 - DNA, 461 bp, Zea mays
  misc_feature: Ceres CLONE 1522473
  misc_feature: Encodes the peptide sequence at SEQ ID NO. 61185
  misc_feature (182)..(182): n is a, c, t, g, unknown, or other
  misc_feature (252)..(252): n is a, c, t, g, unknown, or other
  misc_feature (278)..(278): n is a, c, t, g, unknown, or other
tggagctccccgcggtggcggccgctctagaatagtggatcccccgggctgcaggaattctctcacccctagaaaaagcaaacatcgaatcgtctcactcgtgtctgccctgctcatactgcttgccctcgccgtatcgtccacccgcaacgcacaggaggattccatggccaacaacaccngggacgattggtgggcggcatccaggacgtgccggggaagcgagaacgaccttcacctcccaggagctcngcccgcttcgccgtcgatgagcacanccaggaaaggcccattgctctttctgggggtcaaaaaaccttttgtaaaggccaaaaacccaaattgggtttcttggggcccccaagggccctttcccccccttttttaaaaaggaagagggggggggaaaatctcaaaaaaaattctcttttcaaaaaaatttaaagggggggtgggggggg

SEQ ID NO: 61185 - protein, 128 aa, Zea mays
  misc_feature: Ceres CLONE 1522473
  misc_feature (61)..(61): Xaa is any aa, unknown, or other
  misc_feature (84)..(84): Xaa is any aa, unknown, or other
  misc_feature (93)..(93): Xaa is any aa, unknown, or other
GAPRGGGRSRIVDPPGCRNSLTPRKSKHRIVSLVSALLILLALAVSSTRNAQEDSMANNTXDDWWAASRTCRGSENDLHLPGAXPASPSMSTXRKGPLLFLGVKKPFVKAKNPNWVSWGPQGPFPPLF

SEQ ID NO: 61186 - DNA, 700 bp, Zea mays
  misc_feature: Ceres CLONE 1522474
  misc_feature: Encodes the peptide sequence at SEQ ID NO. 61187
caagctggagctccccgcggtggcggccgctctagaactagtggatcccccgggctgcaggaattcgtctcacccctagaaaaaggattgcagagtcacgcgtcagttcgttccctcctctgtgtaccggccagtaaaatccgaacccacagcgagaaatggcggcggcagcgctccgtccggcgatcctccgccgcatccgcctctccccctccccttcgctcgccctcgccgccgctgggacaggtgcatcccacccgcacgcgctggggcggtggctcgcgcggcccatgtcctcccacgacgcgcacctcacccgcgacgaagtcatcgaccggatcctcgacgtcatcaagagccaccccaagatcgacccctccaaggtgaccccggaggctcacttccacaaggatctggggctcgacagcctggacaccgtcgaggtgggcatggccatcgaggaggagttcaagctcgagatcccagacatggaggctgacaagatcgactcactccctctggccatcgagtacgtcgccaaccaccccatggctggctgagcctctgcttccccaagaggaggtgagtttgagtgaggcttccgctgggtttggtttccgagggcaaataatctgttggagtggcacaaaaaaactttgtcctgggggctctgattggcttcccgggggacgaatgatga

SEQ ID NO: 61187 - protein, 133 aa, Zea mays
  misc_feature: Ceres CLONE 1522474
  misc_feature (59)..(126): Pfam Name: PP-binding Pfam Description: Phosphopantetheine attachment site
  misc_feature: SWISSPROT Homolog: EC 6.1.1.13 D-alanine--poly(phosphoribitol) ligase
MAAAALRPAILRRIRLSPSPSLALAAAGTGASHPHALGRWLARPMSSHDAHLTRDEVIDRILDVIKSHPKIDPSKVTPEAHFHKDLGLDSLDTVEVGMAIEEEFKLEIPDMEADKIDSLPLAIEYVANHPMAG

SEQ ID NO: 61188 - DNA, 665 bp, Zea mays
  misc_feature: Ceres CLONE 1522479
  misc_feature: Encodes the peptide sequence at SEQ ID NO. 61189
  misc_feature (549)..(549): n is a, c, t, g, unknown, or other
aagctggagctccccgcggtggcggccgctctagaactagtggatcccccgggctgcaggaattcgtctcacccctagaaaaagtctttcctgaacaatgccaagggagctacagtgggagatgctgttaagaagcttggtctctggggtctcttcactagaggacttcctcttcgtatcgtcatgattggtacccttactggtgctcagtggggaatttacgatgcattcaaagtgatggttggactcccaacaacgggaggtgttacacctgccccagcagcagaggctgaattgaaagccagtgcttgattttttttttctgtgttccctgagatcatatttggtagagtggaattgtatcagccactcaagagcttagttcccgaatctttttttaatccccaccgaaaatttgtccgtcatccttctgatgagaggaactcattaaacaggcgaaataggtcttttttgcgctgggaaaagtttgcgcttgatgcataataatttttaggacggcaacgctcttaaagcgcaagttatgtttcnccccctgtaccgagaaatggttactaggtcccatttcacattaatggtctttttaaaaaaaaaaaaaaaaaccaaaacgttccggggtaaccaattttccccaaaagggagtccca

SEQ ID NO: 61189 - protein, 42 aa, Zea mays
  misc_feature: Ceres CLONE 1522479
MIGTLTGAQWGIYDAFKVMVGLPTTGGVTPAPAAEAELKASA

SEQ ID NO: 61190 - DNA, 613 bp, Zea mays
  misc_feature: Ceres CLONE 1522480
tggagctccccgcggtggcggccgctctagaactagtggatcccccgggctgcaggaattcgtctcacccctagaaaaaattcctcggagagggagaagccgccgccgcagcaatcacagcagcccggagaaagcccaggtccgacaagatgcagatcttcgtgaagacgctgacagggaagaccatcaccctcgaggtcgagagcagcgacaccatcgacaatgtcaaggcctaagaatctcaggacaagggaaggggatccctgcctggactcagcagcgggctgatcttttgccgggaaagcagcctgggaggatggctcgcaccctttgcgggactataaccatcccaaaaggaaggtcctacccttttccccctccgggggctaaggggggggggggggggggccttttttttgggggcctctctgtggaagggccttcttttggtgagaggcccacccccggaaaaaaagggttttcttctgccggcaaaatggttttttcccccccacaggtggtccccccccgggggggggggggaaaacccgcgccccccccaaaaaaaaaaaaaatgatggggttgggttctcacaaagaacaccccgggggg

SEQ ID NO: 61191 - DNA, 623 bp, Zea mays
  misc_feature: Ceres CLONE 1522481
  misc_feature: Encodes the peptide sequence at SEQ ID NO. 61192
  misc_feature (438)..(438): n is a, c, t, g, unknown, or other
aagctggagctccccgcggtggcggccgctctagaactagtggatcccccgggctgcaggaattcgtctcacccctagaaaaacagccccactctctccatctagagctccctaactgcaccggccgccacaccaccgtaccccgacccctcgacaacaatggccaccgtcctaggcagcccccgcgcgccggccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcngggtcctgctcctcctgcgccgggcaggtcgtctccggctccgtggaccagtccgaccagagctacctcgacgacggccagatcgccgccggctgggtgctcacctgccacggctaccccacctctgacgtcgtcatcgaaacgcacaaggagggaggagctcaccggggcaaaaatctttcttg

SEQ ID NO: 61192 - protein, 154 aa, Zea mays
  misc_feature: Ceres CLONE 1522481
  misc_feature (60)..(135): Pfam Name: Fer2 Pfam Description: 2Fe-2S iron-sulfur cluster binding domain
MATVLGSPRAPAFFFSPSSLRAAPAPTAVALPAAKVGIMGRSASSRGRLRAQATYNVKLITPEGEVELQVPDDVYILDQAEEDGIDLPYSCRAGSCSSCAGQVVSGSVDQSDQSYLDDGQIAAGWVLTCHGYPTSDVVIETHKEGGAHRGKNLS

SEQ ID NO: 61193 - DNA, 690 bp, Zea mays
  misc_feature: Ceres CLONE 1522484
  misc_feature: Encodes the peptide sequence at SEQ ID NO. 61194
agagctggagctccccgcggtggcggccgctctagaactagtggatcccccgggctgcaggaattcgtctcacccctagaaaaaagcagcctcccaaatccccaaagcctccgacccccttcctctctccctccgccgccgctgcgcacgcagggaacaagcgacatgggcgtctacacctttgtgtgccgcaacaacggcggcgagtggaccgccaagcagcactccggcgagatcgaggcttccgccgctaccccatacgagctgcagcgccgcctcgtcgctgccgcctccgcggccgactctgcctacggcgtccagtcgtccttctccatggtcacccccagctccgccgtgttccaggtgatcgtcggtgctgtcggtggtggtgcaatgatggtgagcggaggtggcggcggcggtgctgctgcatctggtggtgctgctgccgaggctcccaaggaggagaagaaggaagaggagaaggaagagagcgacgacgacatgggattctccctgttcgactagagttgtgtgtgtcatctggatctcagaagtggtggtttggtcctgttgccgtagttaattttgctgtcctgtctgtgaacctgaagaactcttggtaattgttacaagcgacctgttccagtttatgtgagaatttgatatgttgtttggaatcatatattc

SEQ ID NO: 61194 - protein, 120 aa, Zea mays; identical to SEQ ID NO: 10743
  misc_feature: Ceres CLONE 1522484
  misc_feature (41)..(119): Pfam Name: Ribosomal_60s Pfam Description: 60s Acidic ribosomal protein

SEQ ID NO: 61195 - DNA, 684 bp, Zea mays
  misc_feature: Ceres CLONE 1522486
  misc_feature: Encodes the peptide sequence at SEQ ID NO. 61196
aaagctggagctccccgcggtggcggccgctctagaactagtggatcccccgggctgcaggaattcgtctcacccctagaaaaactggcgtcgttcaaggtgcccaagaaggtgttcatcacggacgacctgcccaagacggccaccggaaagatccagcgccgcatcgtggcgcagcacttcgtgcagccgaccagtgcctgatcgttgatcctggtgcttgccaagtcatgggtcgacggattggaatttcgctacactagctagcattttgccgttgttcccgcattgcgaggtggacatggcctgactgaacctgaataaacaaacacatgcatcgtctctctctcgtcgtcgttctttgcgttccgcgtatgtgtcggctcatctcctgtcgtttaccggacggcatggtgccaacaatcggtgggcaggtgtcatcaggcgtgcattgtttttttctttttattaccggttgatttggaaccgtaatttaggtttatcgattagaaaaacgtttgggaaaagtgccacatgcctttgttgaaaaggacttctttctgttaaaaaaaaaaaaaaaacgagacgctcgaggtacccaattcgccctatagtgagtcgtattacgcgcgctcactggccgtcgttttacaacgtcgtgactgggaaaaaccctggcgttac

SEQ ID NO: 61196 - protein, 67 aa, Zea mays
  misc_feature: Ceres CLONE 1522486
  misc_feature (29)..(60): SWISSPROT Homolog: EC 6.2.1.26 o-succinylbenzoate--CoA ligase
  misc_feature (27)..(57): SWISSPROT Homolog: EC 6.2.1.1 Acetate--CoA ligase
KAGAPRGGGRSRTSGSPGLQEFVSPLEKLASFKVPKKVFITDDLPKTATGKIQRRIVAQHFVQPTSA

SEQ ID NO: 61197 - DNA, 581 bp, Zea mays
  misc_feature: Ceres CLONE 1522487
  misc_feature: Encodes the peptide sequence at SEQ ID NO. 61198
gtccccgtctcaccgcactgccttgccccctactctgcctcgcttagcttagccgccgctgctacacactctcgccgtccttgttcccgcgtcgctctgctcgcgatggcgtcccgcgttgcagtgctgctcgtggccgtggcggccgtgctgttcgccgcggcgtcggcgcacgagatggacctgggcgtgccgcccgcgccggcgcccgacacaggcgcggcagctgaggccgcggcgtcggtcctggccgtggcttgctctgccgtcttcttcatcctcgtcgacggtggcctcgagcaataggcgctgccgtcgacgtggtggctaactgctggttcagggtcaggcggagccctgttcgatcgttttcgccttaggtagtagtagaagtagcactcatgggctgtgttgattgtgaccctgtctccccctggagggcgttgtgatcttgtgctaatgcttattctttttgtaccatactgatttgttcgacctataccttgtgatgaggcgtgtgttgtatgaataaagactatggatctcgttcgacaaaattgacatctggatactggtaaaaa

SEQ ID NO: 61198 - protein, 66 aa, Zea mays
  misc_feature: Ceres CLONE 1522487
MASRVAVLLVAVAAVLFAAASAHEMDLGVPPAPAPDTGAAAEAAASVLAVACSAVFFILVDGGLEQ

SEQ ID NO: 61199 - DNA, 682 bp, Zea mays
  misc_feature: Ceres CLONE 1522496
agtggatcccccgggctgcaggaattcgtctcacccctagaaaaaggcgctcctcattcaaatttccatgagagacatagatggcgtgtggatttgggggagcttcttcgctggatagtggagagctcgggtagcgaggcgaaggaatgaagagggaggaggggaatccgagaggtctccccgatggcagactgaggccccgtgatcgtagcgacggcgctgttcgtgggcctcacgccggggctgctctgcacgctgacgggacggggccgcgtcgcagaggtcggcagcatgtacaccatcggcctggggattttcgtatacgctgccctctacttcacgctcgtcacgatcgtgatcatcgcggcccctttccacatctacgcgggatactgcccgcccggagcatgatgcaatataaggattagaaggttgcgccgacgtcgagatccacataaagactcgtactttccctccttgtcctcatttcgctctccctccctctatgccctcctcctcggacttgctgttatcatggagcgaatccttggttatggccttgctcctctgtttggtaattccccccgatttgtcgtctctccgcctgttgtcttcctgtattgtgtttaattcctatgtgccctttatacacgaaaaaatcaatattgatgcttctccattt

SEQ ID NO: 61200 - DNA, 590 bp, Zea mays
  misc_feature: Ceres CLONE 1522499
  misc_feature: Encodes the peptide sequence at SEQ ID NO. 61201
  misc_feature (497)..(497): n is a, c, t, g, unknown, or other
  misc_feature (512)..(512): n is a, c, t, g, unknown, or other
agctccaccgcggtggcggccgctctagaactagtggatcccccgggctgcaggaattcgtctcacccctagaaaaaaaaaacagcgcaccgttgattcagagttcagaattcagctacgttgaacctgcggaacacaggcgcccttagatctccgtaagaaggcggaacctgtagaagacatggccggcgagatgagctgggtgggcaagaagatccacctctacaacgtcaccatgggtctctacatgctcgattggtgggagcgctgcctattcaacatactggtgctgatcctgctctggttcatctgcttcaacggatcccgcttcgccactgatgtctacgaaagccacctgaaggcacggattttccaaggcgcaaattacggcatgggaattggcatgccctcctccctagcctcaatgcaaacacagaagcagcaaaatctgctaggtctgggatctgaactggggtcccacgtgctgtaccctgtantgatgggtatgttgnaattccaaaatgtaagaatcttaacattattctttatttaagggacttgtggggaactagggtttgaacgcccgaatt

SEQ ID NO: 61201 - protein, 123 aa, Zea mays
  misc_feature: Ceres CLONE 1522499
  misc_feature (106)..(106): Xaa is any aa, unknown, or other
  misc_feature (111)..(111): Xaa is any aa, unknown, or other
MAGEMSWVGKKIHLYNVTMGLYMLDWWERCLFNILVLILLWFICFNGSRFATDVYESHLKARIFQGANYGMGIGMPSSLASMQTQKQQNLLGLGSELGSHVLYPVXMGMLXFQNVRILTLFFI

SEQ ID NO: 61202 - DNA, 696 bp, Zea mays
  misc_feature: Ceres CLONE 1522513
  misc_feature: Encodes the peptide sequence at SEQ ID NO. 61203
  misc_feature (696)..(696): n is a, c, t, g, unknown, or other
aaagctggagctccccgcggtggcggccgctctagaactagtggatcccccgggctgcaggaattcgtctcacccctagaaaaactctcgcccctctctcccaccccgcagccgccctagcacccgcgacgagcaggatctgcccagttgctcttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcagacagctccttggacaggctgtggcaaaagaacaacgctgatatcaagcagtagattttacatctagtttaccaagaattggacaccgccttagctatgttttgaattcatgtcactatatgcaatgttgtgatttcagctggtaccttaaatctgaagatttagtatcttttgttgggttccttctgagtttgatgtgtggtgttcgtttaattcccttgtccacccccatttaatatcattgtgatgattttggattcaattttgctcgagtcagggtacaattccaataaaaaaaaaaaaaaaaaaaaccttagaaaaaacn

SEQ ID NO: 61203 - protein, 81 aa, Zea mays
  misc_feature: Ceres CLONE 1522513
  misc_feature (1)..(81): Pfam Name: Ribosomal_S21e Pfam Description: Ribosomal protein S21e
MQNEEGKTVDLYVPRKCSATNRIITAKDHASVQINIGHLDANGLYDGHFTTFALSGFVRAQGDADSSLDRLWQKNNADIKQ

SEQ ID NO: 61204 - DNA, 698 bp, Zea mays
  misc_feature: Ceres CLONE 1522515
  misc_feature: Encodes the peptide sequence at SEQ ID NO. 61205
aagctggagctccccgcggtggcggccgctctagaactagtggatcccccgggctgcaggaattcgtctcacccctagaaaaaacctccatccagctcgagccagcccgtcgcctgcgcgcatctctctacacttctactgcttcatactctcgtagagagatccccgcggcccaataaaaacccgactcgctagctgcactacacactcgcagatggccggcctcaggatgaagttcgtcgccgtcgccgccatggccgccgcgctcgtggcgtccgccgcaaccgccgaggcccccgccccggcccccgcctccgacgccgcggccgccgtgcccctcgccgcgggctccctcgccgccgccaccttcggctacctcttctgctagatccgcactggacgcgtggtttctgcttgatttgtgattcgacaggcgcgagtggagtccgtgtcgtgcgcgtgtctgtgtgagttgtttcagcgggcgtgtgtatgtatgtatggagtcagtgactgatgaggacgtgtgctcgtgatggtacgtgcgtcgacactccattgtctgtggcggcgatcatgtgcctgccccgttttctggttatcaatgagatgatttatctgattcttatctaaggaagaaaataaacgagacgctcgaggtacccaattcgccctagagtgagtcggattacgcgcgc

SEQ ID NO: 61205 - protein, 57 aa, Zea mays
  misc_feature: Ceres CLONE 1522515
MAGLRMKFVAVAAMAAALVASAATAEAPAPAPASDAAAAVPLAAGSLAAATFGYLFC

SEQ ID NO: 61206 - DNA, 704 bp, Zea mays
  misc_feature: Ceres CLONE 1522530
  misc_feature: Encodes the peptide sequence at SEQ ID NO. 61207
aagctggagctccccgcggtggcggccgctctagaactagtggatcccccgggctgcaggaattcgtctcacccctagaaaaagtccaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatccccccccccatcaagtacgccgtgtgcgcgctcaaggtggaggtcctcgtggtcattggccacacctgctgcggtggcatcagggcgctcctctctctccaggacggcgcacctgacaacttccacttcgttgaaaactgggttaagatcgctttccctgccaaaattaatgcgcataaagaccacccatcggtgccgtttcaatgaccaagtgctctattcctaaaaaaggtagccctttgaccctgtcccttggagaaacttcaatacccaccccccttccttaaggaaagggcttgc

SEQ ID NO: 61207 - protein, 150 aa, Zea mays
  misc_feature: Ceres CLONE 1522530
  misc_feature (31)..(151): Pfam Name: Pro_CA Pfam Description: Carbonic anhydrase
  misc_feature: SWISSPROT Homolog: EC 4.2.1.1 Carbonate dehydratase
MDDPVERLKDGFHKFKTEVYDKKPELFEPLKAGQAPKYVVFACSDSRVCPSVTLGLQPGEAFTVRNIAAMVPAYDKTKYTGIPPPIKYAVCALKVEVLVVIGHTCCGGIRALLSLQDGAPDNFHFVENWVKIAFPAKINAHKDHPSVPFQ

SEQ ID NO: 61208 - DNA, 685 bp, Zea mays
  misc_feature: Ceres CLONE 1522534
  misc_feature: Translation starting site: 94
  misc_feature: SWISSPROT Homolog: EC 4.4.1.5 Lactoylglutathione lyase
  misc_feature (402)..(402): n is a, c, t, g, unknown, or other
ggagctccccgcggtggcggccgctctagaactagtggatcccccgggctgcaggaattcgtctcacccctagaaaaaagctagctggctagcatggccgggaaagagcttacgctgctggggttatgggcgagcccgttcgtgctccgggcgcgcatcgcgctcagcctcaaaggcctcacctacgcttactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttcccggccgccacacctaatttccttccatccgacccctacgaccgcgccattgctcgcttctgggcctcctanccccacgacaagttctacagcgcgtggatacccgtgttcaggggcaggacggcggccttgttgggtggctgtacgccaccgaggccatctgcggggtgaacgccctcgacgccggcaggacgccgctgctggcggcgtgggcggagcggttctgcgcgctggagggtgtcaaggggctgatcccggacgtggacaggcttctggagtataccaaggccaggcggggcgtatttggcctgccgccgctccgtctttagcatagcataacgtggacatggttctt

SEQ ID NO: 61209 - DNA, 669 bp, Zea mays
  misc_feature: Ceres CLONE 1522727
  misc_feature: Encodes the peptide sequence at SEQ ID NO. 61210
  misc_feature (302)..(302): n is a, c, t, g, unknown, or other
  misc_feature (305)..(305): n is a, c, t, g, unknown, or other
  misc_feature (408)..(408): n is a, c, t, g, unknown, or other
aaagctggagctccaccgcggtggcggccgctctagaactagtggatcccccgggctgcaggaattcgtctcacccctagaaaaaaacaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcntcnaggccgcggcggagtccggcaagcccgcccccccctgcggctgcggaagcagctgccaaggcgacccctggcactgctgaatcccatcgatccaccaccctgnatatgaataaggttcttcctaccggggggggggggggccgaacagtaagtacgcgggggcccaatcggggtgccgcaaggggggctggggcgcggctcgaataccaaaaaccccagcccccgtcttccgatttcccgagcgcccccccgccgccgagggggcctgagcgcggggggccgcggcgttggggcgccacgggggcgacgagggcccacgcggcgtgcccgattaacagcggggcgcggcccccccggtgccgcg

SEQ ID NO: 61210 - protein, 76 aa, Zea mays
  misc_feature: Ceres CLONE 1522727
  misc_feature (1)..(76): Pfam Name: Metallothio_2 Pfam Description: Metallothionein
  misc_feature (50)..(50): Xaa is any aa, unknown, or other
  misc_feature (51)..(51): Xaa is any aa, unknown, or other
MSCNCGSSCGCGSSCKCGKKYPDLEETSTAAQATVVLGVAPEKKAAPEFXXAAAESGKPAPPCGCGSSCQGDPWHC

SEQ ID NO: 61211 - DNA, 841 bp, Zea mays
  misc_feature: Ceres CLONE 1522736
  misc_feature: Encodes the peptide sequence at SEQ ID NO. 61212
cgagctggagctccccgcggtggcggccgctctagaactagtggatcccccgggctgcaggaattcgtctcacccctagaaaaatcagcaaaaccgcgccccaccgcttccccgttccccaccccgaccgactgctccccctcccccgcaccagcctcaaggcatcgccggcgccgcaacatcgctgaggaagcccgcacccctgcccggatccgatggccaacagcaacctcccgcggcggatcatcaaggagactcactggctgctcagcgagccagcacccgggatcagcgcgaccccctaggagaagaacataccctacttcaacgtctcaatcccttggccctgacgtagtatccctttcgaatggggaggaccccaacgtgtgaacccctgtcttaccgtaggaatttatccctcccccctgttgggcaaaagaatttaagcactcccggaccaaaacgttttataggttgcccagaataccccctacactctaggcgcccccaaaataggtcttaaagtcatcctccccccacgcaataaatcggaaccccccttatccggcccccgcctatctcttgtaccagcgacccatccaattcgaccacaccattctcccactatcttattcgccacctcctaattttgtattataagcaccggggtttccatgattaccccatatttcacctatgtccgcccccctctttcgcctctttgccccgttttatttttgttcgccacaccacctacgatgcgttgggctatatgtttattgtcgattgtacgccgcaacgccgatcacaccggccgctttttttgattacccccctcccg

SEQ ID NO: 61212 - protein, 29 aa, Zea mays
  misc_feature: Ceres CLONE 1522736
  misc_feature: SWISSPROT Homolog: EC 6.3.2.19 Ubiquitin--protein ligase
MANSNLPRRIIKETHWLLSEPAPGISATP

SEQ ID NO: 61213 - DNA, 691 bp, Zea mays
  misc_feature: Ceres CLONE 1522739
  misc_feature: Encodes the peptide sequence at SEQ ID NO. 61214
agagctggagctccccgcggtggcggccgctctagaactagtggatcccccgggctgcaggaattcgtctcacccctagaaaagcctccgcctccacgttcccctgctcctcctgatgttgctggtcctggtcctggtcgtgctgcaactgctcctgctcctcttctcccccgtcgcccgctcctccctcctcgtccggtgcctcccgctcggggtccgcggcgccacggccgccatccatgcccgaggaggacggggaggcctgccccagcggcgtcccggcgaggcgcgcgacagcacggaagcggttgcgcaggaggcggcggaaccgcttcacgtcgagggtcggccggggcgcctcccatcggcgcggggcagaggcgccgctgtcggggccgccaatgtggaggttgccgcggtacatcgagatcgccaccatcctccagtccagggtccctgcccgctccgaccgccgcggcgacgtagggtttggtgggttctgctccgatgcggtgggcgtgtgtggcgtgtgggtagagatggcaatgggtacccgaaaccgaaacccgatgggtttttaccccattagggtacgggtttgggccaattttcatacccgtgggtttgttaatgggcataaatctgtacccagcgggtttatgggtacgggtttgttcctatagtacccaaa

SEQ ID NO: 61214 - protein, 147 aa, Zea mays
  misc_feature: Ceres CLONE 1522739
MPEEDGEACPSGVPARRATARKRLRRRRRNRFTSRVGRGASHRRGAEAPLSGPPMWRLPRYIEIATILQSRVPARSDRRGDVGFGGFCSDAVGVCGVWVEMAMGTRNRNPMGFYPIRVRVWANFHTRGFVNGHKSVPSGFMGTGLFL

SEQ ID NO: 61215 - DNA, 665 bp, Zea mays
  misc_feature: Ceres CLONE 1522745
  misc_feature: Encodes the peptide sequence at SEQ ID NO. 61216
aaagctggagctccccgcggtggcggccgctctagaactagtggatcccccgggctgcaggaattcgtctcacccctagaaaaaatcctcacctaatgccacaacaacagctctactgaacattaccgctcatcataagggtacacagcagcagaagagagagagacctaccgagatggcctccggcggttccagcaagcatctgaaggctaggcatcacatgcgcgctgctgtatccgactccgatgctgctggtaatgagaaggagagtggctcatcactggccgtggtggaaatgcgtcggcatcaagagccggaggcggtgagtgaatgtgaggactaccaccgacacgactaacacgccgagtgcctgataaggaggacgttgctcgctcacaccgactacatctacacccagtggaagcacaactagctagtcactgctcactagcctgagctgctggctcatgctcatgtcatgtcgaggagacaagatctatggataaaaacgaaacacaaaagctcgcctggctcacgagctagcctatcccacctgaaattcgacagtgccgtacgtcaactgccgtggactgttttaaaaaatatatacctagtccttttcgtttctgcagttctgccaggctgtggataattttcttatttac

SEQ ID NO: 61216 - protein, 60 aa, Zea mays
  misc_feature: Ceres CLONE 1522745
MASGGSSKHLKARHHMRAAVSDSDAAGNEKESGSSLAVVEMRRHQEPEAVSECEDYHRHD

SEQ ID NO: 61217 - DNA, 785 bp, Zea mays
  misc_feature: Ceres CLONE 1522750
  misc_feature: Encodes the peptide sequence at SEQ ID NO. 61218
  misc_feature (604)..(604): n is a, c, t, g, unknown, or other
aaagctggagctccccgcggtggcggccgctctagaactagtggatcccccgggctgcaggaattcgtctcacccctagaaaaaagatcagatcacactcgtagagagaaggaaaaatatccccaaaccctagctcccgatctcgatggcgaaccctcgcgtcttcttcgacatgaccgtcggaggcgccccggcgggccggatcgtgatggagctgtacgcccacgaggtgcccaagaccgcggagaacttccgcgcgctgtgcacgggcgagacaggcgtgcgcaagtcttgggaagccgctccactacaaggggctccaccttcccaccgcgtcatctccccagttcatggttcgaggtgaggggatttttatccccggctaactgtttccggagggcttttttattataccgcgccccccacctcccccttattaagaaaattctgtgcggcgggttcacacggctcccccgtgtattttctccatagtgcgagagggcgggggcctacagaacccacgtgcttccatatttgagtcctctgttacacgtgggtgaaccccccgtcggtctattgatgttaacataatacgtctccttgnattaacctcactccaaccggcattgcgccgtcggccttattttcctcccgcccaagggggggaaagcttataacaccgggggccaccaccctacttaagtttgtgttcccggggcttacttgtatcgtcttaaaaatacactattatcgaaacgactacttattgcaactcagagtatcat

SEQ ID NO: 61218 - protein, 72 aa, Zea mays
  misc_feature: Ceres CLONE 1522750
  misc_feature (5)..(72): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYAHEVPKTAENFRALCTGETGVRKSWEAAPLQGAPPSHRVISPVHGSR

SEQ ID NO: 61219 - DNA, 755 bp, Zea mays
  misc_feature: Ceres CLONE 1522759
  misc_feature: Encodes the peptide sequence at SEQ ID NO. 61220
  misc_feature (317)..(317): n is a, c, t, g, unknown, or other
  misc_feature (323)..(323): n is a, c, t, g, unknown, or other
  misc_feature (404)..(404): n is a, c, t, g, unknown, or other
  misc_feature (410)..(410): n is a, c, t, g, unknown, or other
  misc_feature (411)..(411): n is a, c, t, g, unknown, or other
  misc_feature (416)..(416): n is a, c, t, g, unknown, or other
  misc_feature (563)..(563): n is a, c, t, g, unknown, or other
  misc_feature (596)..(596): n is a, c, t, g, unknown, or other
  misc_feature (597)..(597): n is a, c, t, g, unknown, or other
  misc_feature (612)..(612): n is a, c, t, g, unknown, or other
  misc_feature (635)..(635): n is a, c, t, g, unknown, or other
  misc_feature (714)..(714): n is a, c, t, g, unknown, or other
gctctagaactagtggatcccccgggctgcaggaattcgtctcacccctagaaaaaagctgaggtcgtcggccatggcggagcgggagcagcatgtgggcagcgacgacgcggcggagtggaagcaggtggcggagctgagggccgtcacccaggcccaggacccttcgtgcaaggatgaggacgactacacgctcccgcgctttcctccgcgcgcgggaccacaacatcggcaaggcggcggccatgctgctccagtcccccagggggagcccgtggcctagcccccggggggccttcgtcgcgggcggaaagganaacaanaaccctgctccacggaaaccccccccccctgggggggcttgggatcgggaaaaggattattacttttcccccccccccccnaaaaannaaaangaaaaaatatatatcgggggggggggtagggggaccctcgagagccaagtcttagtgaccacctctacgagaattggttcccgcacacctgtccgtaggggcgcaccaaatcctcgcggccgggccgccccagtgaaccaccctccnataccccaccccgccaaggaaaatacacccacnncccccccgaccaagnatcaaccactgggctctcaccgntcctccccgaccacatctgcaacgaatatgagtttctttctcacccagggctccaggctcacagaccccctctccatgntgaaaacaatcgttgtgggggttacgcaccccggagaccag

SEQ ID NO: 61220 - protein, 69 aa, Zea mays
  misc_feature: Ceres CLONE 1522759
MAEREQHVGSDDAAEWKQVAELRAVTQAQDPSCKDEDDYTLPRFPPRAGPQHRQGGGHAAPVPQGEPVA

SEQ ID NO: 61221 - DNA, 758 bp, Zea mays
  misc_feature: Ceres CLONE 1522760
  misc_feature: Pfam Name: Fer4 Pfam Description: 4Fe-4S binding domain
  misc_feature: SWISSPROT Homolog: EC 1.6.5.3 NADH dehydrogenase (ubiquinone)
  misc_feature (758)..(758): n is a, c, t, g, unknown, or other
aaagctggagctccccgcggtggcggccgctctatttctagtggatcccccgggctgcaggaattcccctcacccctagaaaaatccgtttgagaagggtcctctgagcccccgcttccgtggtgagcatgctctcagacgttatgaatctggggaagagcgctgcattgcttgtaaactatgcgaagctatatgcccagcgcaggccatcacaattgaggctgaagaacgtgaagatggcagtcgtcgaaccccaagatatgatcttgacatgaccaaatgcatttactgtgggttctgccacgaggcttgaccagccgatgctattgatgaggggactaagcttgactttggtcctgagacacactaggaactactgaacggacagtgacaacttgctttaaaatggtaaccccccccctctactgacattgccttgagaacttcgagaactgaagagtcttctacccccccactctgtaatttaacttccggcttgaccaaattgggtcccctatccactggtcactgttttggggtcacctaactttgaggcatttccacgggactggtgcgctcctctactttatgttaccccaggtttcttcggaaacttgtgtcgccgtttggccccgtgtttctttcttgcgattttatataaaacccccgcttccgttttcggatcccacccctactttacgccccccgcacacgaaggatagcgcggtacacccttttgtgtataccttgttacacan

SEQ ID NO: 61222 - DNA, 799 bp, Zea mays
  misc_feature: Ceres CLONE 1522761
  misc_feature: Encodes the peptide sequence at SEQ ID NO. 61223
  misc_feature (635)..(635): n is a, c, t, g, unknown, or other
gctctagaactagtggatcccccgggctgcaggaattcgtctcacccctagaaaaaaacgaactccagaaatcatccgccctcgtatcctcacgcccacaaaacacccgaagaaaagaagagactgaacgccgcgagttcacgccacgatggaaaacgccgcccccgccattgctaagccgtcgctgtccaagaagccctcgccgtcgttccgcctccggaacggcagcctcaacgcactgcgcctgcgccgcgtgttcgacctcttcgaccgcaacggcgacggtgagatcaacctcgacgaaatggactcacagctcgaaacgctcggcctcggcgccaaccgctccgggctggaggccgcggtttggtggaaacccccccccgccggggcccccggggggttccgctttacaacaagtttcaaggcccctcccccccccacggtctggggaaaggcattgttttccggctccacagggccgcggggggctgttgaccctaagttaagaccgaataaacgaagggggggaaaattaaaagagagggcgattcccggggggggtatctatgagaggaccgaacgaaagagacctttttctcatggcctctcttaaaatgagaagggcccgatgntacaaaaaaattgcgtgcctgcgccggtaagttggggagacacggcccgcgtgttgtaacggaacagaatatgggagtggttgattcgatgatcatgtaatggggcgcgcgtccaaactctcgctggatatccacggaatatgtgagtggtagggtcgaagccg

SEQ ID NO: 61223 - protein, 155 aa, Zea mays
  misc_feature: Ceres CLONE 1522761
  misc_feature (32)..(60): Pfam Name: efhand Pfam Description: EF hand
MENAAPAIAKPSLSKKPSPSFRLRNGSLNALRLRRVFDLFDRNGDGEINLDEMDSQLETLGLGANRSGLEAAVWWKPPPAGAPGGFRFTTSFKAPPPPTVWGKALFSGSTGPRGAVDPKLRPNKRRGGKLKERAIPGGGIYERTERKRPFSHGLS

SEQ ID NO: 61224 - DNA, 844 bp, Zea mays
  misc_feature: Ceres CLONE 1522763-R2
  misc_feature (459)..(459): n is a, c, t, g, unknown, or other
  misc_feature (547)..(547): n is a, c, t, g, unknown, or other
aacttcgagcgtctcgtttttttttttttttttgcgaagagcttctttttattttatgctatgattccttattaaattcttccgtatcttacgccgtagcaaagcaatacatggagaactcctagggtatccatccaaagctgcgcgcccgcttgacacttacacgtggggccacaaccgttgcttctatcccagccactggacgaagttcacccagggacggatcactccattctacgcaaccttgcacgtgggaattaggatgctgatagcctcctccttctgcatccccttagatgtgcagcttctgggggagcctccacgggggctacggcgcccccgatgggtcgccatcccggacgaagtgctcccgaccgtaaccggccaccaagtctatgagctccttgtcggactcgttgttgtcacccgtcgggcggtcgtgagatccggagcaccttngcggacctccaccaggaagaggtccctggagacgagcagcggccacaagaatgacaccacgaaggccagcctgggcccgagcgacganatccatacggcggccgtgcgtcactgaaagctactgcttcggccggcctgcacccggtgctcccacactagctccccgagcttccccttggtggccatggccgggtcggcagcgcgaccgggcacgggagggagatcttgggggaggaaaactttttgagctaggtggctctgggaaacggaaaacaaaatgagagtttttttaagggtaaagaaattttgtagctcttgtgatccctccattttaaagtgggcgcgttttattagagctcaacttatttctctttactggggatag

SEQ ID NO: 61225 - DNA, 958 bp, Zea mays
  misc_feature: Ceres CLONE 1522763-R
  misc_feature: Encodes the peptide sequence at SEQ ID NO. 61226
gccttttattttatgcctgattcattattaaaatctacggtatcttacgccggagcagagcaagacatggagaagtcctagggtatcgagccacggcggcgcgccggcctgacacttacaggtgggcccgcaacggttgcccccacccgtgccactggaggaagttcacccggggacggagcacgccatgccacgcaacatcacacagcacagctaggctgctgacagcctcctcctccggcagcccgttagatctgcagctcgggcggagcctccacgggggctactgccgccggatgcgccgcatccgggacgaggtgctccgggcggtacccggcgactaagtctatgagctccttgtcggactcctcgtcgttacccgcgggcggtcgctgagatccccaccaactttggcggaccctcactcaggaaaaagggcccctggaaaacccaagagccgggtcaaaagaaatgagctccccggaggccaaaccttggggcccaccggccgaaaaatcaaaaagggcggggcgtgggttcaccgaaaacctcccggtttggggcctgcctggcacccccgggtggttccccaaactaagggtcccccggaagcctttcccttttggggggggccatttggcccctgggttttggcaaagggcgaaaccggggaaaactgtccgcgggaaaattttttggggggatgaaaaaaatttttcttgaagagggaggggggggttctcttgggggaaaaaggtgaaacaaatattttttttcactttttttttttagggggtggagaaaaaacattttttttgggacccccgggggggatccacataaattcttattaaggggggcgcgtcttcctctgggtggaaatacgcactttttgaagtccgcttgggaggaggagttataaacccttcccgctcgtgggtgaatatcttttgataag

SEQ ID NO: 61226 - protein, 83 aa, Zea mays
  misc_feature: Ceres CLONE 1522763-R
MSSPEAKPWGPPAEKSKRAGRGFTENLPVWGLPGTPGWFPKLRVPRKPFPFGGGHLAPGFWQRAKPGKTVRGKIFWGDEKNFS

SEQ ID NO: 61227 - DNA, 686 bp, Zea mays
  misc_feature: Ceres CLONE 1522763
  misc_feature: Encodes the peptide sequence at SEQ ID NO. 61228
  misc_feature (413)..(413): n is a, c, t, g, unknown, or other
caaaagctggagctccccgcggtggcggccgctctagaactagtggatcccccgggctgcaggaattcgtctcacccctagaaaaaaacgcaaacgctctcctcctgaactgcgaagcgcacctcgttcccgaaactttcatcacctagatctccctcccgtggccggacgcgctgccgacccggccatggccaccaacgggaagatcgcggacttcgtgtgcgagcaccgggtgccggcctccccccccgtggctttcgtggcggccggggccgcctcggtctaccgctgccgggacaccgtcacgctcgcggcgacctacgtcaggcccgtcgtcgactgacgccgcctcttcatgctcgcggctgctgcgctggtcctgatatccatccccggcgccggcgacgacaacnaggcccgcaagaacctcacccactacgtcaacaggagccacgcggaccaccgcgtcaccgaggccacggccaacggctgctataactccagaggaggctcctgcagatctgcggatctgacggtgctatctgatgaagaggctgagcccagcctagctgtgcctagtgctgcttcgagctatgacatgctccctcacctgaggacctttcatcgttttctgaggtggtcggcaactgttacaataccaccttgaaagtgaaagtgagtccggc

SEQ ID NO: 61228 - protein, 51 aa, Zea mays
  misc_feature: Ceres CLONE 1522763
MATNGKIADFVCEHRVPASPPVAFVAAGAASVYRCRDTVTLAATYVRPVVD

SEQ ID NO: 61229 - DNA, 711 bp, Zea mays
  misc_feature: Ceres CLONE 1522768
  misc_feature: Encodes the peptide sequence at SEQ ID NO. 61230
  misc_feature (390)..(390): n is a, c, t, g, unknown, or other
  misc_feature (442)..(442): n is a, c, t, g, unknown, or other
  misc_feature (443)..(443): n is a, c, t, g, unknown, or other
  misc_feature (463)..(463): n is a, c, t, g, unknown, or other
  misc_feature (481)..(481): n is a, c, t, g, unknown, or other
  misc_feature (502)..(502): n is a, c, t, g, unknown, or other
ggcggccgctctagaactagtggatcccccgggctgcaggaattcgtctcacccctagaaaaaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaaagcacaactcttancatatgcatgcgccggccgacgacgacgcgcgctgcctctcgtgagcttctnngtcagtgatgcatgtttcangggcatcatggatgcttnacgtatatgcgtattaattanccgtgtcagggaaccgacagaaggggggtgttgtttatatttacgtcttctggtgatcaaataaagggaaatatatgttggatgtgtccaaaaaaaaaaaaaaaacgagaccctcgaggtacccaatcggcctaatagggagtccgaatacccggccctcccggggcggcgtttttaaacgtcctgactgggaaaaccctggggttacc

SEQ ID NO: 61230 - protein, 90 aa, Zea mays; identical to SEQ ID NO: 58696
  misc_feature: Ceres CLONE 1522768

SEQ ID NO: 61231 - DNA, 674 bp, Zea mays
  misc_feature: Ceres CLONE 1522769
aaagctggagctccccgcggtggcggccgctctagaactagtggatcccccgggctgcaggaattcgtctcacccctagaaaaagagcccatctcacgacttcgttcatctcgagtctcgaccatctccaacttctattgcaccacaagagacgacgatgtattgcaactgcggatcaagctccggactgcggatcccgctgccagtagccgcaagaagtaccctgacctggaggagacgaacaccgccgtgcacgacaccaacaacctcagcgagaacccgaagaacatcgtcgcgcccgaaatcatcaaggccacgactaagacccgcaagacaacccactcctgcagctgcagcatcagctccaattgcgacccctgctactgctcatcacatcgatcgacgaccatggatatgatccacatctatctatctaggccatgcgtccgaacactaataagatattgcaacttctgtgccatacatagatattcaatggcgtgttccagagagacaacaacgctactcttcacatggctatcacgctcgaggcatatgtggcatctggctacgcgaacatgaacatgggcctgcatgtgagctacatgatccgatagcgacaactgaaacccagatgatcctctgactaacaccaagtctgcgacgaggcttgg

SEQ ID NO: 61232 - DNA, 701 bp, Zea mays
  misc_feature: Ceres CLONE 1522772
  misc_feature: Encodes the peptide sequence at SEQ ID NO. 61233
  misc_feature (408)..(408): n is a, c, t, g, unknown, or other
agagctggagctccccgcggtggcggccgctctagaactagtggatcccccgggctgcaggaattcgtctcacccctagaaaaaacattttatcttctttatcgctactccaagagtacccaatcaccgagccatggccatctcagtcactgccgtggccgccttgtccgctttctcggctcaaagaagcctcccgcagccgtaccgccagagggtcgtaacgttcatcgtcgtccggccggtgcgcgcgcaccgccggtttgtgggcgtggcggccagctcgccgcccacgccgccggatctcgcaaagaaggtgtccgagagcatcaagcaggcccaggagacgtgcgcagatgacccggtgagcggcgagtgcgtggcggcgtgggacgaggtggaggagctcancgcggccgccagccacttgcgcgaccggcagaagggcgccgacccgctcgaggagtactgcaaggacaaccccgagaccgacgagtgccccacgtacgaggactgaaccagcgcgcgcggaggttggatcgctgtcacttgatctagctagcaccttacctcggcgtggatggcaacatgtgtaaacttgcaatggaaccgggaaaggaaccttccttaaattccgtccggcctggggggggaaataaaacgagggtttgctttttttataaaaggaaacattttaggagccc

SEQ ID NO: 61233 - protein, 126 aa, Zea mays
  misc_feature: Ceres CLONE 1522772
  misc_feature (57)..(126): Pfam Name: CP12 Pfam Description: CP12 domain
  misc_feature (92)..(92): Xaa is any aa, unknown, or other
MAISVTAVAALSAFSAQRSLPQPYRQRVVTFIVVRPVRAHRRFVGVAASSPPTPPDLAKKVSESIKQAQETCADDPVSGECVAAWDEVEELXAAASHLRDRQKGADPLEEYCKDNPETDECPTYED

SEQ ID NO: 61234 - DNA, 683 bp, Zea mays
  misc_feature: Ceres CLONE 1522774
  misc_feature: Encodes the peptide sequence at SEQ ID NO. 61235
aaagctggagctccccgcggtggcggccgctctagaactagtggatcccccgggctgcaggaattcgtctcacccctagaaaaaatcttccaccgcgcttcgcccactcgctccagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaagagctcgccaagctgaagaaggcgtccacggcttaaggagtctctttccgtgaatgtcatgttagagtttttggttatgagttggatcagcaattcgattgagcgttgtcaaagccagaattaccaatatgttccctgtaaacccatttcaactttatcaagcac

SEQ ID NO: 61235 - protein, 134 aa, Zea mays; identical to SEQ ID NO: 12674
  misc_feature: Ceres CLONE 1522774
  misc_feature (44)..(120): Pfam Name: Ribosomal_L14e Pfam Description: Ribosomal protein L14

SEQ ID NO: 61236 - DNA, 691 bp, Zea mays
  misc_feature: Ceres CLONE 1522775
  misc_feature: Encodes the peptide sequence at SEQ ID NO. 61237
aaagctggagctccccgcggtggcggccgctctagaactagtggatcccccgggctgcaggaattcgtctcacccctagaaaaagacttgtgagttgtgagagcaaaccacaccagcctcattgcctcaatcccaaaccaatccgtcgcagacactcaaggtcgcaggatgcctccgccgcgtgagcacaaccagccccaggacgaagaggacgacgacaccgcaggcgtcgtcaagctcatcagcgccgagggcttcgaattcgttgttgacaggaaggccgccatggtctccaacaccctccgcaacatgctcacatccccaggcggcttctctgagacgcgccagggcgaggtccgcttcccagagatccccaccaacatcctcgagaagatctgccagtatttctattggtcgctccattactccagtgggaaggagacagcggagtttccaatcgaaccggagataaccctggagcttatgatggccgcaaactatctggacacttgatgaggagcctgaggggtataatcctagttttgttataatatgaaagaacgaaagcatgaatactagggaatctttccttcattcgtttcctttttttttttgctttactgatgtacccggctaccctggatgaatggctggttttccccaattgattctgtctggaccaacccggggg

SEQ ID NO: 61237 - protein, 114 aa, Zea mays
  misc_feature: Ceres CLONE 1522775
  misc_feature (20)..(82): Pfam Name: Skp1_POZ Pfam Description: Skp1 family, tetramerisation domain
MPPPREHNQPQDEEDDDTAGVVKLISAEGFEFVVDRKAAMVSNTLRNMLTSPGGFSETRQGEVRFPEIPTNILEKICQYFYWSLHYSSGKETAEFPIEPEITLELMMAANYLDT

SEQ ID NO: 61238 - DNA, 661 bp, Zea mays
  misc_feature: Ceres CLONE 1522785
  misc_feature: Encodes the peptide sequence at SEQ ID NO. 61239
aaagctggagctccccgcggtggcggccgctctagaactagtggatcccccgggctgcaggaattcgtctcacccctagaaaaaatcttcaaaccctaaccttaacgcactctcctatatccgccgccatcgtctcgggctctcatctctaatcttcgggttcgcgtcgcagtgtcttccgcccgggctaccaccatgccgaagcagatccacgagatcaaggacttcctgctgactgcgcggcggaaggacgcacggtcggtgcggatcaagcaggccaaggacgccgtcaagttcaaggtgcgctgctccaggtacctctacaccctctgcgtccacaacgccgacaaggccaacaagctcaaacagtcgctcccgccaagtctgactgtccaggagatttaacgcatcaagccacaaactgtgctttttttgctgtgtcagggacgtttgctccactgttactttagtttgtaaggtgggctccattgctgtgtttgaatgaattatggaagtttgagttttgggaatgccaatgaatgtgtccaaacctattaagcctggttttgtaaaggttaacccccgaaccgccaaagaagggccaatctatccaaaattaaaacttgatttcctcttaaaaaaaaaaaaaacaaccgagacc

SEQ ID NO: 61239 - protein, 69 aa, Zea mays
  misc_feature: Ceres CLONE 1522785
  misc_feature (2)..(69): Pfam Name: Ribosomal_L38e Pfam Description: Ribosomal L38e protein family
MPKQIHEIKDFLLTARRKDARSVRIKQAKDAVKFKVRCSRYLYTLCVHNADKANKLKQSLPPSLTVQEI

SEQ ID NO: 61240 - DNA, 698 bp, Zea mays
  misc_feature: Ceres CLONE 1522806
  misc_feature: Encodes the peptide sequence at SEQ ID NO. 61241
  misc_feature (437)..(437): n is a, c, t, g, unknown, or other
  misc_feature (498)..(498): n is a, c, t, g, unknown, or other
  misc_feature (499)..(499): n is a, c, t, g, unknown, or other
  misc_feature (515)..(515): n is a, c, t, g, unknown, or other
aagctggagctccccgcggtggcggccgctctagaactagtggatcccccgggctgcaggaattcgtctcacccctagaaaaaacctaccattctggagaggagaggaacagagccaagaaacaagcccggaagatggcaggcggcggagtggtgaagcacatcctgctggcaagcttcaaggaggaggtgacgcaggagcgcctggacgagctcatccgaggatacgccgcgctcgtcggcgtggtcccctccatgaaggcgttccactggggaactgatgtgagcatagaaaacatgcatcaagggttcacgcacgtcttcgagtccacgtttgaaagcacggaaggaatcaaggagtacattgagcaccctgcacacgtcgaatttcgcagtgtgttcttgcctgtgctggagaaggtccctcatatcgactancaaccgacgtcggccaatttagcgtagaacatgctgtgtacttgttcctcggaggatccanngttgatctactctttnatttgctaaataaactcggtctgctttggtcccttgtaaagaatgagctttgagttttctgtagtgcaaaaaaaaaaaaaaaaccaagacctccaggtaccccatccgcccaaagggaatccaattcccgccccctcctgggcgtccttttaccaacccttgacggggaaaaccctgggtttc

SEQ ID NO: 61241 - protein, 109 aa, Zea mays
  misc_feature: Ceres CLONE 1522806
  misc_feature (7)..(103): Pfam Name: Dabb Pfam Description: Stress responsive A/B Barrel Domain
  misc_feature (101)..(101): Xaa is any aa, unknown, or other
MAGGGVVKHILLASFKEEVTQERLDELIRGYAALVGVVPSMKAFHWGTDVSIENMHQGFTHVFESTFESTEGIKEYIEHPAHVEFRSVFLPVLEKVPHIDXQPTSANLA

SEQ ID NO: 61242 - DNA, 716 bp, Zea mays
  misc_feature: Ceres CLONE 1522807
  misc_feature: Encodes the peptide sequence at SEQ ID NO. 61243
  misc_feature (399)..(399): n is a, c, t, g, unknown, or other
  misc_feature (438)..(438): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
ggcggccgctctagaactagtggatcccccgggctgcaggaattcgtctcacccctagaaaaaataggggccgtccgatccgagaacagggaatagcaccaccgaccttcggcgcccgttggggatcctcatcttcacgagcgagtacttggcttgacctcttcctcttcggaccatctccaacgctcttggtgtagcttgccactctcaccgatcaggttttcatgtgtgatctcgacattcaaatccccactgccgtccaacccttctctgaggcacatgcgggggactctccgagccctgcaggttctaacgactacgtatgcttgcgcagcctcctgcgtaatggtctgcagagcctgactacctgccagtgattgacgaatgagttcagctacngctggatcctcagagatcttaacacacacccctgccccnatggtacagtgatgcagtacccagaaactggacaggtcatctcgctccagcgtgatcttagcaaaagcgtctcgagtttctcagcacaggccggccttgtgcaaatagagcctttccctattcatgggttactcagcgaccgacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 61243 - protein, 45 aa, Zea mays
  misc_feature: Ceres CLONE 1522807
MQYPETGQVISLQRDLSKSVSSFSAQAGLVQIEPFPIHGLLSDRR

SEQ ID NO: 61244 - DNA, 782 bp, Zea mays
  misc_feature: Ceres CLONE 1522817
  misc_feature (330)..(330): n is a, c, t, g, unknown, or other
  misc_feature (331)..(331): n is a, c, t, g, unknown, or other
  misc_feature (336)..(336): n is a, c, t, g, unknown, or other
  misc_feature (398)..(398): n is a, c, t, g, unknown, or other
gcggccgctctataactagtggatcccccgggctgcaggaattcctctcacccctagaaaaaacctggtgcccttcgccggcaacgagcacccgcccaccaggatccaggtttgtgctgcgaaaccccctatccattccccatgagtaagggcgggctcctgatcaccccccaggggcagggggagcctcacccagtagcaatcccccctcaccccccaacggagacggaccacgggcctttcgcggaatttgattgaattatttcatattctttccccccaaagcgggaatattgcctgatatggactatttcataaaaaaaaaaaaannaaaancaatagaagacttttttctttccccccccccgggggacaagaaaaaggggcaccttcttccnattttatacaccccccccctctttgaaccaaaaaaagaaaacctgccaaggagggggggactagaaaaaccatagctttccttggcttcggaggcgcagcgtcaagagaaattccccgatgccccgtcctcccgggtcgccgacatgcccaggacaaaggacccgaaccccgcgttcccgcacactcaacaccccccccaccgccagggggcgcaggtagattgagggtgatgcgttcaatttccgcactcccgaaccacactctttgccgtgcggccacccaccagagggtcctatgggggacgttgccttaaatccccacactctcggactcaacatccatggaggcgcgtggggcgttcctctcggtgtacgccacccccc

SEQ ID NO: 61245 - DNA, 582 bp, Zea mays
  misc_feature: Ceres CLONE 1522818
  misc_feature: Encodes the peptide sequence at SEQ ID NO. 61246
  misc_feature (468)..(468): n is a, c, t, g, unknown, or other
  misc_feature (469)..(469): n is a, c, t, g, unknown, or other
  misc_feature (475)..(475): n is a, c, t, g, unknown, or other
  misc_feature (476)..(476): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (483)..(483): n is a, c, t, g, unknown, or other
ggagctccccgcggtggcggccgctctagaactagtggatcccccgggctgcaggaattcgtctcacccctagaaaaagatggaaaggatgagttcgtcgctgcagtactgggtggaggagcacaagctctcaaccatcggagccgtgtgggcgacggcggtgggcgcgtccgtggcgtacagccggcggcgggcgccggcgcgggcgacgggcatgcgcctcatccacgccaggatgcacgcgcaggcgctcacgctcgccgtcctcgggggagccgcgctcgcgcaccactaccacggtaagagcaccaacaccgggaagaagctacagcttcgagaccctggactacggatttactcctttccgatagcccccccggccccccctatccccgagggggaaaaataaaaacccccccccccaaaaatcttttggaataaaaaagatttgttttcccttctcccttnnctgggnnannnagnacaaaaaaaacacccccgggagaaaaaaaaaaaaaaaaaaaaaacctatttttttttttttttgtgggccgcccctggttgtatggtgggggggggggg

SEQ ID NO: 61246 - protein, 109 aa, Zea mays
  misc_feature: Ceres CLONE 1522818
MERMSSSLQYWVEEHKLSTIGAVWATAVGASVAYSRRRAPARATGMRLIHARMHAQALTLAVLGGAALAHHYHGKSTNTGKKLQLRDPGLRIYSFPIAPPAPPIPEGEK

SEQ ID NO: 61247 - DNA, 680 bp, Zea mays
  misc_feature: Ceres CLONE 1522824
  misc_feature: Encodes the peptide sequence at SEQ ID NO. 61248
  misc_feature (405)..(405): n is a, c, t, g, unknown, or other
  misc_feature (511)..(511): n is a, c, t, g, unknown, or other
  misc_feature (593)..(593): n is a, c, t, g, unknown, or other
gctctagaactagtggatcccccgggctgcaggaattcgtctcacccctagaaaaactagaaaaggctcctcccgaccgcaacgcccctcatctccctcgaccccgacatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaagccaagaagagcgtggagacctacaagatctacatcttcaaggtgctgaagcaggtgcaccccgacatcggcatatcctccaaggccatgtccatcatgaactccttcatcaacgacatctttgagnagctggccggcgaggccgccaagctggcgcggtacaacaagaagcccaccatcacgtcccgcgagatccagacctccgtgcgcctagtccttcccggagagctcgncaagcacgccgtcttcgagggaaccaagccgtcaccaagttcacagccactggacgcgctgcgggatcccggatctggtagnagggttctttgctgtgtcctttcccccgttccccaccctaccggctagtagctagctggctgctctataatccgggccgccgattgt

SEQ ID NO: 61248 - protein, 212 aa, Zea mays
  misc_feature: Ceres CLONE 1522824
  misc_feature (94)..(164): Pfam Name: Histone Pfam Description: Core histone H2A/H2B/H3/H4
  misc_feature (135)..(135): Xaa is any aa, unknown, or other
  misc_feature (170)..(170): Xaa is any aa, unknown, or other
  misc_feature (197)..(197): Xaa is any aa, unknown, or other
SRTSGSPGLQEFVSPLEKLEKAPPDRNAPHLPRPRHPRPDGAQGGEEASGEEAGGRGEGGEDDRREEAQGREAAARVQVLRQGGRREEGEEEAKKSVETYKIYIFKVLKQVHPDIGISSKAMSIMNSFINDIFEXLAGEAAKLARYNKKPTITSREIQTSVRLVLPGELXKHAVFEGTKPSPSSQPLDALRDPGSGXRVLCCVLSPVPHPTG

SEQ ID NO: 61249 - DNA, 800 bp, Zea mays
  misc_feature: Ceres CLONE 1522825
  misc_feature: Encodes the peptide sequence at SEQ ID NO. 61250
agctcgcaccgcttaatcaacaacctgacaagttagctacccgcgcagcgccgcgcgccatggccacgatgaaccaccgcattgtgcccctcctgctggtcgcagccacactgctcgcgcaggccgcggcctgcccctactgcccgacgccgaagccgccgccgcctccgccgccgtcgtcgtcgtccacgccgtgccctcccccgccctactcgccgtcgccgtccacgccgacgggtaagtgccccgtgaacacgctcaagctgctcgcgtgcgtggacgcgctcaacggcctcgtgcacgccgtcatcgggaccaaggccagcgacacctgctgcccgctgctctccggcgtggccgacctcgacgccgcgctctgcctctgcaccaccatcaaggccaaggcgctcagcgtcagcctcgtgctccccgtcgccatctcggtgctcgttaacgagtgcggcaagcatgtgccctccagcttccagtgcccgtaatcacatcagctgcatatatgtgctactatgatgtatcaccaccactaatctatatccgcatgcatgcatcaatgcatgggtgattaagggtttatacgcggtcaaagttatacacgcatatatatgtagcttcatacatggagctgtgggttgtgcattcattttcaaatcatgtaccagtattatattgtagtatcataaaccagtgtgagagttgtggccttggtgggggtgcttgtaagtcatcattaagtaaaaccatgaataaaacgtgtgtaacatatataaaaaaaaaaaaaaaaa

SEQ ID NO: 61250 - protein, 145 aa, Zea mays
  misc_feature: Ceres CLONE 1522825
  misc_feature (62)..(144): Pfam Name: Tryp_alpha_amyl Pfam Description: Protease inhibitor/seed storage/LTP family
MATMNHRIVPLLLVAATLLAQAAACPYCPTPKPPPPPPPSSSSTPCPPPPYSPSPSTPTGKCPVNTLKLLACVDALNGLVHAVIGTKASDTCCPLLSGVADLDAALCLCTTIKAKALSVSLVLPVAISVLVNECGKHVPSSFQCP

SEQ ID NO: 61251 - DNA, 689 bp, Zea mays
  misc_feature: Ceres CLONE 1522828
  misc_feature: Encodes the peptide sequence at SEQ ID NO. 61252
  misc_feature (631)..(631): n is a, c, t, g, unknown, or other
  misc_feature (634)..(634): n is a, c, t, g, unknown, or other
caaagctggagctccccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcggtgtccgcgtccgcgtcgtccacgctggcgggcgccttcttcgcggcgctggcgtcgtcgcccgacgctgcgctggcggacgtcgtggcggcggcggacgccggcggcgacagccgcggccagctgctgctcgtcgtggtggcgcccgccatcgggtgggtgctgtacaacatcctgcagccggcgctgaaccagctgaaccgcatgcgcagcagccaggccgtggccgctggcctgggcctcggcgccgccgccgccgggatggcggccccgcccgaggcctccgccgccgtggtgcaggacctcgnagnaatcgccgccgccgcgcccgccgacgacagccgcggcctcctcctgctcatcgtc

SEQ ID NO: 61252 - protein, 165 aa, Zea mays
  misc_feature: Ceres CLONE 1522828
  misc_feature (80)..(114): Pfam Name: PsbY Pfam Description: Photosystem II protein Y (PsbY)
  misc_feature (146)..(146): Xaa is any aa, unknown, or other
  misc_feature (147)..(147): Xaa is any aa, unknown, or other
MATIATMALLKPAAKAAARSAPSTSSGSVSLRVRTGQAAKKAAVSASASSTLAGAFFAALASSPDAALADVVAAADAGGDSRGQLLLVVVAPAIGWVLYNILQPALNQLNRMRSSQAVAAGLGLGAAAAGMAAPPEASAAVVQDLXXIAAAAPADDSRGLLLLIV

SEQ ID NO: 61253 - DNA, 663 bp, Zea mays
  misc_feature: Ceres CLONE 1522830
  misc_feature: Encodes the peptide sequence at SEQ ID NO. 61254
  misc_feature (431)..(431): n is a, c, t, g, unknown, or other
  misc_feature (483)..(483): n is a, c, t, g, unknown, or other
caaagctggagctccccgcggtggcggccgctctagaactagtggatcccccgggctgcaggaattcgtctcacccctagaaaaagccgccacttcccctccgagcctcagttcgcatccacgcgcgccgccgccgcctcgcagctcgacgctcaccgcgcagccatggcggaacagactgagaaggctttcctcaagcagccaaaggttttcctcagctcaaagaaatccggcaaaggtaagaagcctggcaagggcggcaaccgattctggaagagcattggccttggcttcaagactcccagggaagcaattgaagggacctacattgacaagaaatgcccattcactggaactgtttctatcagaggcagaattattgctgggacatgccacagtgctaagatgaacagaactatcattgttcgcangaactacctccactttgtaaagaataccagaggtatgagaagaagcactccnaacatcctgctcacatctccccatggctcccgtgtgaaggaaggtgaccatgtcatcattggccagtgcaggcccctgtcaaaaactgtgaggttcaatgtcgttaaagtcatcccagctggatccgcagctgctggaaagaaagccttcccgccagccggagttaagaacattgtccag

SEQ ID NO: 61254 - protein, 166 aa, Zea mays
  misc_feature: Ceres CLONE 1522830
  misc_feature (74)..(143): Pfam Name: Ribosomal_S17 Pfam Description: Ribosomal protein S17
  misc_feature (89)..(89): Xaa is any aa, unknown, or other
MAEQTEKAFLKQPKVFLSSKKSGKGKKPGKGGNRFWKSIGLGFKTPREAIEGTYIDKKCPFTGTVSIRGRIIAGTCHSAKMNRTIIVRXNYLHFVKNTRGMRRSTPNILLTSPHGSRVKEGDHVIIGQCRPLSKTVRFNVVKVIPAGSAAAGKKAFPPAGVKNIVQ

SEQ ID NO: 61255 - DNA, 684 bp, Zea mays
  misc_feature: Ceres CLONE 1522832
  misc_feature: Encodes the peptide sequence at SEQ ID NO. 61256
  misc_feature (581)..(581): n is a, c, t, g, unknown, or other
  misc_feature (660)..(660): n is a, c, t, g, unknown, or other
aaagctggagctccccgcggtggcggccgctctagaactagtggatcccccgggctgcaggaattcgtctcacccctagaaaaaaaaccataagagcttctgagtctagacactagatacagtaagccttaccaccaagagaggttagtatctcaacaaggatacttcaaataagtccgcctcacgcagctcctctcccaactccatctcagagtggagccagaaagagaacaagatgtttgaagaggcactcgcatactacggcgagggcacatccaaccggtgggacaaggtgtccagagccatgggaggcatcaagtctgctgaggaggtgcgctgccactatgaagatcttgactatgacgtcaagatgattgaatcacgccacatgccgtaccccaagtacaacacacatggattctggatctgaggtcgagatgttggagggctcagggaggcacataacatagctctctgaatctaagatcgcactaggttctagaaggtagcagagcaaatcatgtgtggctgggaaataatatgatcgaacagtgtgcatatgtatagtatacgctatgagncagtttatgtttagctgtgattgtaggaactagcgtaccttccaaaccgcatgattacattatcccttggaacaaagtnatgaaggatgtaacctcatgcatt

SEQ ID NO: 61256 - protein, 64 aa, Zea mays
  misc_feature: Ceres CLONE 1522832
MFEEALAYYGEGTSNRWDKVSRAMGGIKSAEEVRCHYEDLDYDVKMIESRHMPYPKYNTHGFWI

SEQ ID NO: 61257 - DNA, 698 bp, Zea mays
  misc_feature: Ceres CLONE 1522838
  misc_feature: Encodes the peptide sequence at SEQ ID NO. 61258
  misc_feature (433)..(433): n is a, c, t, g, unknown, or other
acccgcggtggcggccgctctagaactagtggatcccccgggctgcaggaattcgtctcacccctagaaaaaaccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgacgtcctcccgcggtccggccccgctccgcgcgtccaccgaggaggcggtggatgcgcccaaggcgttcgtggccccgcagctggatcccagcacgccgaccccgatcttcggcggcatcacaggcgagctgcatcacatggcgcacgccgcagagttctacgtcatcacgtggacgtccaccangaactagtgttcaagatgcccagcggacgagccgccatcatgcgggaggcccccaacctctggacctggcgcggaagaacaaagcctggccctcggcaccaggtggctccatgacaagatcactaccatgctaccgcgttttccccaccagggagtgcctacctccaccctaggacgcggctaccagaaaaggcaccccgggaggagggggcgtccaaacttccaatgtcggaaaagggccacccctttaagtcagttccgggag

SEQ ID NO: 61258 - protein, 99 aa, Zea mays
  misc_feature: Ceres CLONE 1522838
  misc_feature (98)..(98): Xaa is any aa, unknown, or other
MAMATQASAATRHLLAAAWAPAAKPRQLSSQLALPSTSSRGPAPLRASTEEAVDAPKAFVAPQLDPSTPTPIFGGITGELHHMAHAAEFYVITWTSTXN

SEQ ID NO: 61259 - DNA, 693 bp, Zea mays
  misc_feature: Ceres CLONE 1522853
  misc_feature: Encodes the peptide sequence at SEQ ID NO. 61260
gcggtggcggccgctctagaactagtggatcccccgggctgcaggaattcgtctcacccctagaaaaacgcgccgccacttcccctccgagcctcagttcgcatccacgcgcgccgccgccgcctcgccggtcgacgctcaccgcgcagccatggcggaacagactgagaaggctttcctcaagcagccaaaggttttcctcagctcaaagaaatctggcaagggtaagaagcctggcaagggcggcaaccgattctggaagagcattggccttggcttcaagactcccagggaagcaatcgaagggacctacattgacaagaaatgcccattcactggaactgtttctatcagaggcagaattattgctgggacatgccacagtgctaacatgaacagaactatcattgttcgcaggaactacctccactttgtaaagaaataccagaggtatgagaagaggcactcccacattcctgctcacatctctccatgcttccgtgtgaaggaaggtgaacatgtcatcattggccagtgcaggcccctgtcaaaaactgtgaggtttcatgtccttaaagtcattccagctggatccgcagctgctggaaagaaggccttcacagcaacctgagtttatagacaatgttccctgagtaacctatgaaatgatggccttttaaatccaaaaaaatc

SEQ ID NO: 61260 - protein, 159 aa, Zea mays
  misc_feature: Ceres CLONE 1522853
  misc_feature (74)..(143): Pfam Name: Ribosomal_S17 Pfam Description: Ribosomal protein S17
MAEQTEKAFLKQPKVFLSSKKSGKGKKPGKGGNRFWKSIGLGFKTPREAIEGTYIDKKCPFTGTVSIRGRIIAGTCHSANMNRTIIVRRNYLHFVKKYQRYEKRHSHIPAHISPCFRVKEGEHVIIGQCRPLSKTVRFHVLKVIPAGSAAAGKKAFTAT

SEQ ID NO: 61261 - DNA, 659 bp, Zea mays
  misc_feature: Ceres CLONE 1522859
  misc_feature: Translation starting site: 170
aagctggagctccccgcggtggcggccgctctagaactagtggatcccccgggctgcaggaattcgtctcacccctagaaaaactcgagcctgacccttacgccttcgctcgagccgccgccgcagccggcgctacgccccgcacctcgcttcatttcgtgtcgccaacatgacgaaccgcgctatcaaggaaggaattgtagcgaaatatggaaccaggtctggtgctagattgcgtaaacaaatcaagaagatggaggtatctcaacattcccagtacttttgcgagttctcgcgcgaactttgctgtgaagaggaaagcattaggaattcgagggtgcaacgactgtacaaatgtgaagactgctggtgctcacaccatgaacactgctagagcgaccaccgcctcgagaacgatcctgcgcctgacggatcagactgaagcaggatatacctcttcatatcatcgaggattcatgcattcgctcatgtcaagcatgttgtgagcgccttagctaacggaactgtgcaatcactgtactgcctgttttagcaacacgatgctcctgatattgagtatatgctctaggatcacatagtcgagtaattgttgcacatgggtgaccgtctcaagctgacgagggatttttcatcctaaa

SEQ ID NO: 61262 - DNA, 702 bp, Zea mays
  misc_feature: Ceres CLONE 1522865
  misc_feature: Encodes the peptide sequence at SEQ ID NO. 61263
  misc_feature (370)..(370): n is a, c, t, g, unknown, or other
  misc_feature (474)..(474): n is a, c, t, g, unknown, or other
  misc_feature (585)..(585): n is a, c, t, g, unknown, or other
  misc_feature (640)..(640): n is a, c, t, g, unknown, or other
ggatcccccgggctgcaggaattcgtctcacccctagaaaaactctcgcgccgccgcggaacacaacaccgcaccacactacccagcggaatccgcccacccgcacccgcacccggagcagaggagatatgtcgcaggggaagggaggagcggcgaggaaggaggaggtggtcaccagggagtacaccatcaacctccacaagcgcctccacggctgcacattcaagaagaaggcacccaacgccatcaaggagatcaggaagtttgcgcagaaggccatgggcaccacggacattaggatcgatgtgaagctcaacaagcacatctggagcagcgggatcaggagcgtgccgcggagggttcgtgtgangatcgcccgcaagaggaacgacgaggaggatgccaaggaggagctctactcccttgtcaccgtcgcagagatccccgccgagggcttgaaagggctggggaccnaagtcgttgacgaaaccgattaagctgtcgcgttatctacatctttagagagttcctagtttgtatttgcaacagcaaaaccttttgtatttcacaaagtgtctatttccngcacagaattgcatggctagttttcttttcattgctgctgcatcctttttctcantatcgccccctgggaagtcgctgctcatgggacaagttggaaatctccatgtgtggtggtta

SEQ ID NO: 61263 - protein, 122 aa, Zea mays
  misc_feature: Ceres CLONE 1522865
  misc_feature (10)..(104): Pfam Name: Ribosomal_L31e Pfam Description: Ribosomal protein L31e
  misc_feature (81)..(81): Xaa is any aa, unknown, or other
  misc_feature (116)..(116): Xaa is any aa, unknown, or other
MSQGKGGAARKEEVVTREYTINLHKRLHGCTFKKKAPNAIKEIRKFAQKAMGTTDIRIDVKLNKHIWSSGIRSVPRRVRVXIARKRNDEEDAKEELYSLVTVAEIPAEGLKGLGTXVVDETD

SEQ ID NO: 61264 - DNA, 691 bp, Zea mays
  misc_feature: Ceres CLONE 1522867
  misc_feature: Encodes the peptide sequence at SEQ ID NO. 61265
  misc_feature (1)..(1): n is a, c, t, g, unknown, or other
  misc_feature (331)..(331): n is a, c, t, g, unknown, or other
  misc_feature (527)..(527): n is a, c, t, g, unknown, or other
  misc_feature (590)..(590): n is a, c, t, g, unknown, or other
  misc_feature (610)..(610): n is a, c, t, g, unknown, or other
  misc_feature (654)..(654): n is a, c, t, g, unknown, or other
naaagctggagctccccgcggtggcggccgctctagaactagtggatcccccgggctgcaggaattcgtctcacccctagaaaaatctttcgctcgctctcggcgacagctgggcgaccgtcgtcgccgccgcccttctctaggtgcccaggtcttcgccggtccctttgccgcctcttcgccgccgatgagcaccagccaggaagaaaagaagctgaaccatggggaagagaaagtcagctgctaagccacctcctaagaagcggatggacaagcttgacactgtcttttcctgcccattctgcaaccacgggagtagtgttgagtgccnaattgacatgaagaatctgattggcgaagcatcttgtagaatctgtcaggaaaacttcaccacaactgttaatgcactcactgagcctattgatatatatagtgaatggattgacgagtgtgagcgtgtcaacactgttgaaggcgacgatgatgcctgagcttgccccatgcgatgaaactgttacctaccatcnaatgtaatgtgctagtattctccaatgcatagcccatagtccgccctggctggaaaaacgcangggctgacggaattgccagnaggcaccctattcaggacctacggagctacaaaaaggttgtatnatacctttggggaccaccttaaaaaaaaaaaaaagaa

SEQ ID NO: 61265 - protein, 89 aa, Zea mays
  misc_feature: Ceres CLONE 1522867
  misc_feature (8)..(68): Pfam Name: Elf1 Pfam Description: Transcription elongation factor Elf1 like
  misc_feature (37)..(37): Xaa is any aa, unknown, or other
MGKRKSAAKPPPKKRMDKLDTVFSCPFCNHGSSVECXIDMKNLIGEASCRICQENFTTTVNALTEPIDIYSEWIDECERVNTVEGDDDA

SEQ ID NO: 61266 - DNA, 750 bp, Zea mays
  misc_feature: Ceres CLONE 1522871
  misc_feature: Encodes the peptide sequence at SEQ ID NO. 61267
  misc_feature (53)..(53): n is a, c, t, g, unknown, or other
  misc_feature (54)..(54): n is a, c, t, g, unknown, or other
  misc_feature (77)..(77): n is a, c, t, g, unknown, or other
acatgctggagctcaccgcggtggcggccgctctagactagtggatccccggnnctgcaggatcgtctcaccctagnaaagataaccaagaacaaaccattgttggacgcgttcccctcctgcacgcaacctcatctcgtcctccagatccaggatggccgtcctccttgagaccttgcctccccgagtgctctcggtgacctactttcgcttcgatttatcaggaaatccgcttgcctcacggggggcacgctggtatctaaatggcgggatcgggttaccccccctgaatccaaaaacccctcaccccctccccccccggcacactggaactcgtccacggccgggcgaagcttcttctggcccccccccgggggggggggggggggggaaccccccccattcctccccccccccccgggggggggggggtccttagggcatcctattctgggcccgccgggggcgcgtctgtgggcgcgggcggagggtatgccgcccccctgccccgccggcccggggccgcccccccggcgcagggagaggcgggcggggggggggggccagaggccggcggggccggcgcggctcgagcaccacgggccgggccctccccctcacattccggcccgccccgccggggtgggtcaaccacctcggctaataccctagcgtgcgcgtggctccccgggggcgccctcccccgccgggcggcggtcggcagcggggggggtgtctggcgtgcgccgc

SEQ ID NO: 61267 - protein, 59 aa, Zea mays
  misc_feature: Ceres CLONE 1522871
MPPPCPAGPGPPPRRRERRAGGGGQRPAGPARLEHHGPGPPPHIPARPAGVGQPPRLIP

SEQ ID NO: 61268 - DNA, 741 bp, Zea mays
  misc_feature: Ceres CLONE 1522876
  misc_feature: Encodes the peptide sequence at SEQ ID NO. 61269
  misc_feature (408)..(408): n is a, c, t, g, unknown, or other
gcggtggcggccgctctagaactagtggatcccccgggctgcaggaattcgtctcacccctagaaaaaaagagtagtgcctcacgagtagagtcacctcctgcccaattcggcggtgatgtatactcgtcgtcctccgcgccgagaatcaatgcttctatggcccgtatgaatgacactgcgcgcgggtcagctgctgggaaggcgccccgcaagcatctggcgaccaggaggtacgcaagtttgcgccggccaccgatggtgtgaaaaagctccatcgcttccgccccggtaccgtcggcgttcggggagattggtaagtaccaaaagaccacggagctgctcatccccaagttggccttgtggcgcgtcgtccgagagatcccgccccccccccggtttgatctcngcttccagtcctccgccgtctcttgcgctgcaaggaggccctcaaggcctacttctcggtggtcttttgggacccttaccctggggtccttccatccaactaacaaccctgtcttgggcaaaggatttccgcctgagatctccatctggtgaaaaaagggctggactcaagggaaccttccccccccgcagggagggggcgttgttccttttgggcctgtgtataagaagttgtgctctgggggggacccaattacggggggggagggagtaaatatttccccctggggggctcgcctgaaatttttaaaggttaagagcgtggtcaaccggt

SEQ ID NO: 61269 - protein, 87 aa, Zea mays
  misc_feature: Ceres CLONE 1522876
GGGRSRTSGSPGLQEFVSPLEKKSSASRVESPPAQFGGDVYSSSSAPRINASMARMNDTARGSAAGKAPRKHLATRRYASLRRPPMV

SEQ ID NO: 61270 - DNA, 508 bp, Zea mays
  misc_feature: Ceres CLONE 1522877
  misc_feature (210)..(210): n is a, c, t, g, unknown, or other
  misc_feature (212)..(212): n is a, c, t, g, unknown, or other
  misc_feature (217)..(217): n is a, c, t, g, unknown, or other
ggcggccgctctgaatagtggatcccccgggctgcggattcgtctcacccctagaaaaaaaaaccaatcagatagagagagcatagtcgatcatgaagggtggcaagaaggaagtggccggtgcggtggtgggcatactgctggttctgcgctctgcactcacgacgcatggcgccgtcgccgcgacctgccgatgctctcgcacacccnangtganatgctgtcgccaccttgctcccggggaaactggaaatacctcccggtccaccctggttggtccgggaactttaaggatccccccccgcccaccccaaaattttccccccggtgtgtttgaattaaggcctttttcccgaaaaccccattttttttttgtttggccccgggcaaaaaaaaaaaaaattcccctcggggaattttttgtttaagggaggagggttttcgggggcccccgggggggtttttccaaatacggctattttaaaccccccggggggagaaacacaaa

SEQ ID NO: 61271 - DNA, 605 bp, Zea mays
  misc_feature: Ceres CLONE 1522878
  misc_feature: Encodes the peptide sequence at SEQ ID NO. 61272
ctggagctccccgcggtggcggccgctctagaactagtggatcccccgggctgcaggaattcgtctcacccctagaaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggttggcaaggtgcctgccgagccatgctgtaccctcatcaaacgccttgcggacttcgaggccgccgtctgcctctgcacggccatcaaggccaacgtgctcggcgtcgtcgtcgatgtccccatcaagctcagcgcgctcgtcaacttacgtggcaagtgcgtgcccaagggctacatgtgcgcgtaagcagctccgggcagttaccccctcgtaacctgtcccctacgaaattatttatgcc

SEQ ID NO: 61272 - protein, 133 aa, Zea mays
  misc_feature: Ceres CLONE 1522878
  misc_feature (51)..(132): Pfam Name: Tryp_alpha_amyl Pfam Description: Protease inhibitor/seed storage/LTP family
MASKAVLFLALNLLFFTVANACGNCPTPTPPVEPPPPPPAATPPPSSSGKCPLNALKFGVCADVLGLVKGEVGKVPAEPCCTLIKRLADFEAAVCLCTAIKANVLGVVVDVPIKLSALVNLRGKCVPKGYMCA

SEQ ID NO: 61273 - DNA, 847 bp, Zea mays
  misc_feature: Ceres CLONE 1522886-R
  misc_feature: Translation starting site: 519
  misc_feature: SWISSPROT Homolog: EC 2.3.1.153 Anthocyanin 5-aromatic acyltransferase
caattgggtacctcgagcgtctcgtttttttttttttttttgtaatgccaaatttcaaaatagataattataataacaaatctcataacttcaaaaactataatggcacgaatcaatgaacccttcttttttatcaatcacacaattgatattctcgcatacgagattactccacgcaaatatgaaaatatacccatccctccctcaaatatacacttcggatcatctctcttatccctatattttcttattatactactccttaaacaccacttcatgtagtgtaatttcgcgagctccattacatgtaatcgcgagctgatgaccagcttctcgaaaatggaggtgccatcgtcgatgccgctcagttcagttcagtcacactgtcacagagcacctccaccgcatcggcgaagcaggagccgaagcgcgccatctcggcctcctgcagcacgacgccgacctccaccccggcgtcgcgggcctccgccagggacaccgtgccgggcgtcttgtcgatggacaccagctccaccttggccggccggcccaacccgaagtcagtctcgtacacaccgtaccgcggggacccgcccaccgacatcgggcgctccgggaccagcgacaggatcttgtggaaccacccgcctgccccatccagcacgccgccgtcaaagcgcgcgacggccgcggcgatcgccgcggtcgcagccgccacgccgtcgccgcccagcagctcggccggggccaccttcacaaaacacggcccggaaggcagttgcccaggtactcctgcgggaatcgggcggggccaggggggcgccgggacttccaccgagaaaaggag

SEQ ID NO: 61274 - DNA, 768 bp, Zea mays
  misc_feature: Ceres CLONE 1522889
  misc_feature: Encodes the peptide sequence at SEQ ID NO. 61275
  misc_feature (1)..(1): n is a, c, t, g, unknown, or other
  misc_feature (263)..(263): n is a, c, t, g, unknown, or other
  misc_feature (264)..(264): n is a, c, t, g, unknown, or other
  misc_feature (337)..(337): n is a, c, t, g, unknown, or other
  misc_feature (344)..(344): n is a, c, t, g, unknown, or other
  misc_feature (346)..(346): n is a, c, t, g, unknown, or other
  misc_feature (400)..(400): n is a, c, t, g, unknown, or other
naaggtggtggagctccccgcggtggcggccgctctagaactagtggatcccccgggctgcaggaattcgtctcacccctagaaaaaggcccaaatcccccgactcctcgcttcctcccgttccgtcgccgccgcgcgcctcggagaagagatagaggcggccgctgcatcgaccccgcgccacccccgcctgcctcccccggaaccgatcgggtttgatcgatggcgtcaaagaggatcctgaaggagttgaaggacctgcnnaaggacccgcccacctcctgtttcgcaggtcgtggtggtgaggacttgttcctttggtttgcaaccataatgnagaattncnaaaaccccatttttttccccccccccccgggggttgtaggggggttcccacctnatatccccccccccccctctttgggtgtggtttcctgcacctggggtgtgccccgcgggcgggcggatgtttatgggagggttgggggggtggccgtgtgctgatgagccggggggcgcccggcgttttagcgagcctctatggggggcgcgcttggcgtggggcccgctaggtccgcttgccacctaacggggcggttgcgctcggggggtgcgggcaagccgcgctccttatgttacctgtcggtctgggggggataccgatttcggcgccttgtccccccgtcggccgtgctttgacttgctcccgcgtcctccgggggtgcagcttgtcgtgtgcggctgagtgtgggcgtgcgtgttgtgtgg

SEQ ID NO: 61275 - protein, 93 aa, Zea mays
  misc_feature: Ceres CLONE 1522889
  misc_feature: SWISSPROT Homolog: EC 6.3.2.19 Ubiquitin--protein ligase
  misc_feature (14)..(14): Xaa is any aa, unknown, or other
  misc_feature (39)..(39): Xaa is any aa, unknown, or other
  misc_feature (41)..(41): Xaa is any aa, unknown, or other
  misc_feature (42)..(42): Xaa is any aa, unknown, or other
  misc_feature (60)..(60): Xaa is any aa, unknown, or other
MASKRILKELKDLXKDPPTSCFAGRGGEDLFLWFATIMXNXXNPIFFPPPPGVVGGFPPXIPPPPSLGVVSCTWGVPRGRADVYGRVGGVAVC

SEQ ID NO: 61276 - DNA, 845 bp, Zea mays
  misc_feature: Ceres CLONE 1522890
  misc_feature: Encodes the peptide sequence at SEQ ID NO. 61277
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (363)..(363): n is a, c, t, g, unknown, or other
  misc_feature (481)..(481): n is a, c, t, g, unknown, or other
cccctcccccaaaaanannannnnnnnnnnnnnnnnnngaaannnnnnaatccaggagctcaccccggtggcggccgctctagaactagtggatcccccgggctgcaggaattcgtctcacccctagaaaaatcgatcctgtcctgtccagcaagggagacctggactggaggaggaggacctacctacccggcctccagctctctcgtctcttcctcctcctcctcgaaggtccgatccgatcccccaatgtttgacaccacccccgcctcccgccgcctactattccggccctcccgccgctccgcctcctaagtctaaccccgcttttttgcccccagggagggggccgcggttcccggnctgtttttcctccccccccgtccggctaaactttgtaaccccctttttttttcccccccccccggggggggggggggcttccttcttttttatttccttttttcccccgcggggggantagtggcccccttttccccccgccctctcggccccgggtctcccccccccttttttccttatttccccttagtcgctctccccttctgacccccttcgccccttccggtccctttcccccccccttcatcgtttccccctactcttcccgcggcccacggtgtaatgttttcccccccatcttccgcgttaattttcccgcccgcggcccctttgctcccctctccctctcttttcttccccccccccgccctccgctttctttttcgccccccgtcgctccccccgctggtttttggtcccccgccccccctacgcgtgcctttcctccatccccccaccctcctatctcccgcggtctctcg

SEQ ID NO: 61277 - protein, 66 aa, Zea mays
  misc_feature: Ceres CLONE 1522890
MFSPPSSALIFPPAAPLLPSPSLFFPPPALRFLFRPPSLPPLVFGPPPPLRVPFLHPPTLLSPAVS

SEQ ID NO: 61278 - DNA, 623 bp, Zea mays
  misc_feature: Ceres CLONE 1522897
  misc_feature: Encodes the peptide sequence at SEQ ID NO. 61279
ctggagctccccgcggtggcggccgctctagaactagtggatcccccgggctgcaggaattcgtctcacccctagaaaaagaactctcaaggcgtgaaagggaggagcttgagaaacaaaaagctcatgaacgttatatgaaacttcaggagcaaggaaaaacagaacaagcacggaaagatttggaacgtcttgctttaataagacagcaaagggctgatgctgcaaagaaacgcgatgaggagaaagctgccaaggagcagaggaagtcggaagcacggaagtaactgcaatatcatggacgatgagaccacgaaggcatgatctgcgttagttggatatttatttctaatgcatcagttatcttgttataaacctggtccctattctgtatccccataaaatatgcattgacaaaattagtaacagtcttgtgggcgtgtcttcctgtaaacttgagcttgacaaaattagaaagtagtattaaggtcagcttatgcgaaactggctcttttgtctgctgtccggttgatgctggtgaaaatgattggtattattgggactttaaaaagaaaaaaaaaaaaaaaacgagaccctcgaaggtacccatttcgcccctatag

SEQ ID NO: 61279 - protein, 94 aa, Zea mays
  misc_feature: Ceres CLONE 1522897
GAPRGGGRSRTSGSPGLQEFVSPLEKELSRREREELEKQKAHERYMKLQEQGKTEQARKDLERLALIRQQRADAAKKRDEEKAAKEQRKSEARK

SEQ ID NO: 61280 - DNA, 692 bp, Zea mays
  misc_feature: Ceres CLONE 1522898
  misc_feature: Encodes the peptide sequence at SEQ ID NO. 61281
  misc_feature (557)..(557): n is a, c, t, g, unknown, or other
  misc_feature (587)..(587): n is a, c, t, g, unknown, or other
ggccgctctagaactagtggatcccccgggctgcaggaattcgtctcacccctagaaaaatggggagtttggctggggcggcacatccatatcactccaccaaaccctaaaaccgcttccgcaaccacgtataaaaacaccgcacgcgccgccgccgccgtcctattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccgcatatgctatgcacggctgcaccctagggctgtncactgccgcaagaagaagtgtggtcacagncaccagctgaggggcagaagagatcaagaactgaggtgtgctgctagtcagttcatggacatgttgttgggttgtgaaccgtgttgtttagaactgatttttgtt

SEQ ID NO: 61281 - protein, 153 aa, Zea mays
  misc_feature: Ceres CLONE 1522898
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature (118)..(118): Xaa is any aa, unknown, or other
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRICYARLHPRAVHCRKKKCGHXHQLRGRRDQELRCAASQFMDMLLGCEPCCLELIFV

SEQ ID NO: 61282 - DNA, 612 bp, Zea mays
  misc_feature: Ceres CLONE 1522904
  misc_feature: Encodes the peptide sequence at SEQ ID NO. 61283
acccgcggtggcggccgctctagaactagtggatcccccgggctgcaggaattcgtctcacccctagaaaaaatcacttatcatccccgtccgcacctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagagcggcttcatcgtcttcaagaaccgcccctgcaaggttgtggaggttctacctcagagactggtagcatggtcatgccaatgccactttgttgccatagatatattcagcgcgacaagcacgaatcagattgttctttcgatcccacaactgggaatattcttcgtcgtgaccccggactgattatccgctcgattgatctttccggaggatgggatttggggagcctaccttaactcccgaagggaaccacataagggacgaaccttaaaagcccccaacccgaaagaaaaacccttgggggggccccaaaatcaaaggaggggggtttggaaaaattgggaaacggcttcccttgtttttgacc

SEQ ID NO: 61283 - protein, 90 aa, Zea mays
  misc_feature: Ceres CLONE 1522904
  misc_feature: SWISSPROT Homolog: EC 6.1.1.3 Threonine--tRNA ligase
MSDSEEHHFESKADAGASKTYPQQAGTVRKSGFIVFKNRPCKVVEVLPQRLVAWSCQCHFVAIDIFSATSTNQIVLSIPQLGIFFVVTPD

SEQ ID NO: 61284 - DNA, 714 bp, Zea mays
  misc_feature: Ceres CLONE 1522907
  misc_feature: Encodes the peptide sequence at SEQ ID NO. 61285
  misc_feature (558)..(558): n is a, c, t, g, unknown, or other
  misc_feature (650)..(650): n is a, c, t, g, unknown, or other
  misc_feature (714)..(714): n is a, c, t, g, unknown, or other
cgtagctggagctcaccgcggtggcggccgctctagactagtggatccctcgggctgcaggaattcgtctcacccctagaaaaaactcactctcgctcgacctatgttcttgagctggttgatgagatagcaactggatcaaagttgtactctcttgcctccccgtgacaataatgaatcgccctctgcgtgcgatttatgttgatcttgtggtagttcccccaactgtcaccatgcagaacgaggagggtaagactgtggacctctatgtccccaggaagtgctcggccacaaacaggatcatcactgccaaggaccatgcctctgtccagatcaacattggccacttggatgctaatggcctgtatgatggacacggcagcaactttgctctctctgggtttgcccctcctcagggcgacgcaaacagctccttggacaggttgtggcagaagaacaaggctgatattcagcagtaaattttacctctaagtttacccagaattggaccctgtcttaacctatgttttggattcatgtcactataatgccatggtngtcatttcaggctggctcctttaagcctgaggaatgtagctgtcttttgtcgggccccccccccgactttttaatgcccgtggcgccccccnccaaaaaacttcaaaaatttacccaccctccctcttttgattacccccctctccgcccccaaan

SEQ ID NO: 61285 - protein, 81 aa, Zea mays
  misc_feature: Ceres CLONE 1522907
  misc_feature (1)..(81): Pfam Name: Ribosomal_S21e Pfam Description: Ribosomal protein S21e
MQNEEGKTVDLYVPRKCSATNRIITAKDHASVQINIGHLDANGLYDGHGSNFALSGFAPPQGDANSSLDRLWQKNKADIQQ

SEQ ID NO: 61286 - DNA, 651 bp, Zea mays
  misc_feature: Ceres CLONE 1522912
  misc_feature: Encodes the peptide sequence at SEQ ID NO. 61287
  misc_feature (377)..(377): n is a, c, t, g, unknown, or other
  misc_feature (380)..(380): n is a, c, t, g, unknown, or other
  misc_feature (551)..(551): n is a, c, t, g, unknown, or other
  misc_feature (602)..(602): n is a, c, t, g, unknown, or other
ctggagctccccgcggtggcggccgctctagaactagtggatcccccgggctgcaggaattcgtctcacccctagaaaaaagcagcagcacagtcatccacactaacgaacgaactgaggtcgacgacgactgatcgagcagcgacgatggcggctgtgctgaacagcaggaagacgccgcaggtggttgccgtgctggtggcggcggcgctgctggcgtcgtccgcttcggcggcgatcacctgcgggcaggtggggtcgtcgctggctccgtgcatcccgtacgcgacggggagggccagcgcgctccccgcgtcgtgctgcagcggcgtcaagagcctcaacagcgcggcgcggaccagcgcggaccgccaggnggngtgccgctgcctcaagagcctcgccaacagcgtcaagagcgtcaacatgggcaccgtcgccaccatccccggcaagtgcggcgtcctccgtcggattccccatcagctgtcccccgattgcaccaggatcagctaagttttacgacgaccaacctaataagcctaccgaangttcacctacgtccccccgcgcctgccccgagtgatgaagcccgggaacanatcaaataaaccttcctgtttttgcccagaaccaccttgcagtttccat

SEQ ID NO: 61287 - protein, 122 aa, Zea mays
  misc_feature: Ceres CLONE 1522912
  misc_feature (33)..(118): Pfam Name: Tryp_alpha_amyl Pfam Description: Protease inhibitor/seed storage/LTP family
  misc_feature (77)..(77): Xaa is any aa, unknown, or other
  misc_feature (78)..(78): Xaa is any aa, unknown, or other
MAAVLNSRKTPQVVAVLVAAALLASSASAAITCGQVGSSLAPCIPYATGRASALPASCCSGVKSLNSAARTSADRQXXCRCLKSLANSVKSVNMGTVATIPGKCGVLRRIPHQLSPDCTRIS

SEQ ID NO: 61288 - DNA, 691 bp, Zea mays
  misc_feature: Ceres CLONE 1522918
  misc_feature: Encodes the peptide sequence at SEQ ID NO. 61289
  misc_feature (527)..(527): n is a, c, t, g, unknown, or other
ccaagctggagctccccgcggtggcggccgctctagaactagtggatcccccgggctgcaggaattcgtctcacccctagaaaaactgctgcaacccaaccaagcccgcacgacacgacaccaagtcgaggagctcgagagggcaccaataatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggagccaactttgcgcgcgcctacaccgtggagttcggcagctgccagttcccctacaacttcactgggtgccaggacctcgccaagcagaagaaagtccccttcatcagcgacgacctcnagattgagtgcgaggggaaggagaaagtcaagtgcggcctccacgttttctggaagtggtgaagcagctagcagcaacgtctgattgggaatggaggagatcatcaccttgtcttgtcgacccctagaatatgtccaacctgcaggaaattaaaatctttctgg

SEQ ID NO: 61289 - protein, 145 aa, Zea mays
  misc_feature: Ceres CLONE 1522918
  misc_feature (8)..(145): Pfam Name: PsaN Pfam Description: Photosystem I reaction centre subunit N (PSAN or PSI-N)
  misc_feature (126)..(126): Xaa is any aa, unknown, or other
MAGVNSSVVGLKPAAAVPQAAAASSPAKRVQLAAPEGRRAALLGLAAVFAVTATTGSAKATIFDEYLEKSKANKELNDKKRLATSGANFARAYTVEFGSCQFPYNFTGCQDLAKQKKVPFISDDLXIECEGKEKVKCGLHVFWKW

SEQ ID NO: 61290 - DNA, 713 bp, Zea mays
  misc_feature: Ceres CLONE 1522927
  misc_feature: Encodes the peptide sequence at SEQ ID NO. 61291
acccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtctgatgttgagtaccggtgcttcgtcggcggcctcccctgggcgacggacgagcactccctccacagctccttcaggacctacggcgaggtcctcgagtccaagatcatcctcgatcgggagacgcagaggtcccgcggcttcggcttcgtctccttctccacggaggaggcgatgcggaacgccatcgagggcatgaacggcaatgagctggacggccacaacatcaccgtctacgatgcccagtctcgccgcggccgtgtaggcggcggcagtgggtactgtggtggccgtgtaggcggcggctactgcggtggcgggcgccgtgatggacgcggcggctacggcggtggcggcggcggctactgtggcatcggcggctaccgtgttggttgtcggcggctaccgcgtggctaacgtggcggcggctccgcaactcctacgggacctgaggaactgagcggtggggccgcgcgccaagttacctggtcgctaccgtgtgtttaccctatcaagaggctaatctccgtcgc

SEQ ID NO: 61291 - protein, 141 aa, Zea mays
  misc_feature: Ceres CLONE 1522927
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLPWATDEHSLHSSFRTYGEVLESKIILDRETQRSRGFGFVSFSTEEAMRNAIEGMNGNELDGHNITVYDAQSRRGRVGGGSGYCGGRVGGGYCGGGRRDGRGGYGGGGGGYCGIGGYRVGCRRLPRG

SEQ ID NO: 61292 - DNA, 582 bp, Zea mays
  misc_feature: Ceres CLONE 1522928
  misc_feature: Translation starting site: 176
  misc_feature (425)..(425): n is a, c, t, g, unknown, or other
  misc_feature (473)..(473): n is a, c, t, g, unknown, or other
aagctggagctccccgcggtggcggccgctctagaactagtggatcccccgggctgcaggaattcgtctcacccctagaaaaaattcgtgtcctggcatccgcagagagtttgttccgtccaggcaaccaaaaagcgttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgccctggtggcgcgagatcgcgcaggactttcagacagaccntcggttccagagccacgccgtgctggcgctccaggaggggcgcgaggnctacctcgtcgggctcttcgaggacaccaacctctgcgccatccacgccaagcgcggtcacatcatgcccaaaggacatccagttcgcccgccgcattccgggggcgag

SEQ ID NO: 61293 - DNA, 616 bp, Zea mays
  misc_feature: Ceres CLONE 1522934
  misc_feature: Encodes the peptide sequence at SEQ ID NO. 61294
ggagctccccgcggtggcggccgctctagaactagtggatcccccgggctgcaggaattcgtctcacccctagaaaaactctcgtgtgtctggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtaccttgaagtacttgaaccaagaagtactttgaagaagcacaccgtggcgggattggcttaccgcgtggttgcctgccaccaagaaccgaaaccgcctattgagctcccgcctacctcaaactttgctgaaaaacgaagggccaaggaaaaaagatttaaattggcccctacgcctttttatttttagtattgaaacccccttggcctttt

SEQ ID NO: 61294 - protein, 145 aa, Zea mays
  misc_feature: Ceres CLONE 1522934
  misc_feature (16)..(115): Pfam Name: Ribosomal_L22e Pfam Description: Ribosomal L22e protein family
MARGVVSAKGGAVAGKKKGSVSFTIDCTKPVEDKIMEVASLEKFLQERIKVAGGKAGNLGDSVTISREKTKVTVTSDGPFSKRYLEVLEPRSTLKKHTVAGLAYRVVACHQEPKPPIELPPTSNFAEKRRAKEKRFKLAPTPFYF

SEQ ID NO: 61295 - DNA, 672 bp, Zea mays
  misc_feature: Ceres CLONE 1522936
  misc_feature: Encodes the peptide sequence at SEQ ID NO. 61296
tggcggccgctctagaactagtggatcccccgggctgcaggaattcgtctcacccctagaaaaaacagacacgtccgcatactcccaagttcccaaccaaatctccctccagcaccgcagctagcccgagaagccgacgaggaggaaaccgaccgccgacgccgagcaccctcggttccttgttttcccggcgcccaatctagacagctctttctcgttcgtctgtatccatggccgccgcctcgagcaagaccgtcgctgtcctcctcgccgcgctgctcctcgcgctggtcacgtccgcggtggccagcaggaagctggaggaggacgctttcctggggagcctttcgccggcgcctgcccccgtcgtgggcggagccgccaggctcgctagcgcctagccgggggcggtgggccgtcgccgctcttgtctctctcatcggcttcctcgcgaaatgagcgggtccctgcaatcgggattgctggcggggggagggaaacatttaggccccccccggttggttccagggttttgggattccgggggcggggggaccctccttttttgggggtgttataagagggggttacccccccgttttctttttttaacccaccaacctatcgcgggggtaccttcttcccccaaggggggggtctttttcccggggg

SEQ ID NO: 61296 - protein, 56 aa, Zea mays
  misc_feature: Ceres CLONE 1522936
MAAASSKTVAVLLAALLLALVTSAVASRKLEEDAFLGSLSPAPAPVVGGAARLASA

SEQ ID NO: 61297 - DNA, 693 bp, Zea mays
  misc_feature: Ceres CLONE 1522940
  misc_feature: Encodes the peptide sequence at SEQ ID NO. 61298
  misc_feature (486)..(486): n is a, c, t, g, unknown, or other
  misc_feature (487)..(487): n is a, c, t, g, unknown, or other
gctctagaactagtggatcccccgggctgcaggaattcgtctcacccctagaaaaaatatttgcatcactgcctgcttctggaatcaggaaaggagatcaccacttcactcaagaaagcaccctcccttgccactccttttccttgagatgactatgattacgatgaagaagcagcagcagctcctcctcctcctttctctcatggttctcattgctgtgacagcagccgatgttgctgccgatccacatccacagcagcaggtgcatgtgcagcagcagcagcgagcactgatgaagattaacagggccgccagagtccttcttcctcagccgcagccgaaactagactgccagtccacctgctctgtgcgctgcggcaacaactggaataatcagatgtgcaacagatgtgcaacgtctgctgcaacaatagagctgcgtgcccccgggtaccgggcaagaaacctgccactctgccctgatannaacacatgctcattcccccacggggaagctaaagggccctaaggccttccccctcgggttatggaaatggcctatcatcccttcaaaaaataagaaaaaactttctggttcaaaaaaaaaaaaaaaaaaaaacgccgggggacccatttcccccataagggacggaataaacccggccctgggccccctttttacccttccgaacg

SEQ ID NO: 61298 - protein, 126 aa, Zea mays
  misc_feature: Ceres CLONE 1522940
  misc_feature (113)..(113): Xaa is any aa, unknown, or other
MTMITMKKQQQLLLLLSLMVLIAVTAADVAADPHPQQQVHVQQQQRALMKINRAARVLLPQPQPKLDCQSTCSVRCGNNWNNQMCNRCATSAATIELRAPGYRARNLPLCPDXNTCSFPHGEAKGP

SEQ ID NO: 61299 - DNA, 682 bp, Zea mays
  misc_feature: Ceres CLONE 1522946
  misc_feature: Encodes the peptide sequence at SEQ ID NO. 61300
  misc_feature (443)..(443): n is a, c, t, g, unknown, or other
  misc_feature (524)..(524): n is a, c, t, g, unknown, or other
tggcggccgctctagaactagtggatcccccgggctgcaggaattcgtctcacccctagaaaaactggttctccatccggtcagaccaatcaacaaagtgacgcgagcacgagcatccatcgtttccccttcttccccatcgcgtgccctcgccgcagccatcttccatggcggaccagctcacggacgagcagatcgcggagttcaaggaggccttcagcctcttcgataaggatggcgacggctgcatcactaccaaggagcttggaactgtgatgcgctcccttggccagaaccccactgaagcagagctgcaggacatgatcaacgaggttgatgctgatgggcatgggaccattgacttcccagagttcctgaacctgatggcaaggaagatgaaggacaccgactccgaaggagagcttagggaggcctttcgcgtnctcgacagggacagaatggtttcatctcggctgctgagctccgccatgtcatgacccacctcggcgaagagctgactgacnaggaggtcaaccaaatgatccgtgaagcccatgtttaaccgcaacggccaaattcactacgaggattcgtcaagggcctgatggccaatggaggaccatccccgtttcctggaaggaatggaagggaaattccgggccccaactggacttttgccggg

SEQ ID NO: 61300 - protein, 109 aa, Zea mays
  misc_feature: Ceres CLONE 1522946
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDEQIAEFKEAFSLFDKDGDGCITTKELGTVMRSLGQNPTEAELQDMINEVDADGHGTIDFPEFLNLMARKMKDTDSEGELREAFRVLDRDRMVSSRLLSSAMS

SEQ ID NO: 61301 - DNA, 812 bp, Zea mays
  misc_feature: Ceres CLONE 1522968
  misc_feature: Encodes the peptide sequence at SEQ ID NO. 61302
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
atccctatcgtgcccttgtgggttccccccccccccccnnnnnnnnnnnnnnnnnnatcatgactgggactccaccgcggtggcggccgctctagaactagtggatcccccgggctgcaggaattcgtctcacccctagaaaaatgctctctcagaggtgggctggcttctcctccccctcttaccaagtcctcctcgggttagggttccttagggttttgtggaggggcgatggccgcctctcatctccagtccccgtcccctcccgccgcgggcttgtcttggtccacagctagggagtgtcttgagaaaggcctgcgcctccttgggcgaggatccgcgacttttatgcgcttcccgtgatcatttacaccgccggggtccccgccggtttcccaccagcaagtaccctgcgccttcattcataaattatattttttctcccccccccccctagtggggggggggggggtgtcctcccccctcccctcttttgtttttatcgccccccccccccccgcccggaacgcccgagggcgtccggtctccgccccggtcagcatggtcgttattttcgggcgccctcgtatcttccggtcccagcggggcgggcggcgtccctgctgcgcgcgatcgcgcgccgcgcgtgcttgccggtctccctgttttgcccggtgtctgtcctccccccatcttaccccctcacctgcgctcgcgacgcccccgccttcttccccctttcgcccgccgcccccctcttcttcctcaccgtcgctctcagcaccgctctaccttccccttctcccagctcc

SEQ ID NO: 61302 - protein, 43 aa, Zea mays
  misc_feature: Ceres CLONE 1522968
MAASHLQSPSPPAAGLSWSTARECLEKGLRLLGRGSATFMRFP

SEQ ID NO: 61303 - DNA, 650 bp, Zea mays
  misc_feature: Ceres CLONE 1522971
  misc_feature: Encodes the peptide sequence at SEQ ID NO. 61304
ggagctccccgcggtggcggccgctctagaactagtggatcccccgggctgcaggaattcgtctcacccctagaaaaaaagccaccgaaatcttccgtctccaaatcctcctagcgaattcaccacagcttctcaccaccgctaccttcgatggcacccaaggcggacaagaagccggcggcgaagaagcctgcagaggaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctataacaagaagcccaccgtcacctcccgcgagatccagacctcggtgcgcctcgtcctccccggcgagcttgccaagcacgccgtctccgaagggcacaaggccgtcaccaagttcacctcctcttaaggttcatagtactaggctgggtggtgttggtagacctg

SEQ ID NO: 61304 - protein, 153 aa, Zea mays
  misc_feature: Ceres CLONE 1522971
  misc_feature (60)..(130): Pfam Name: Histone Pfam Description: Core histone H2A/H2B/H3/H4
MAPKADKKPAAKKPAEEEPATEKAEKAPAGKKPKAEKRLPAGKSAGKEGGEGKKGKKKAKKSVETYKIYIFKVLKQVHPDIGISSKAMSIMNSFINDIFEKLAAESAKLARYNKKPTVTSREIQTSVRLVLPGELAKHAVSEGHKAVTKFTSS

SEQ ID NO: 61305 - DNA, 639 bp, Zea mays
  misc_feature: Ceres CLONE 1522975
  misc_feature: Encodes the peptide sequence at SEQ ID NO. 61306
  misc_feature (80)..(80): n is a, c, t, g, unknown, or other
ctggagctccccgcggtggcggccgctctagaactagtggatcccccgggctgcaggaattcgtctcacccctagatatncttgcatctcaacttcgtgcgtgcataataaaacctaatcatcggcacttcccgttccgctctttggaaggtggctaggaatggaaccggcctctagtagctaggctatagcttccgcctttaattcccccatcagaccagtcatcgctcgtccccccggccgccggcgagctcttcgtcttcccgtgtgatccttcaattccttcccatccggtccggcctagactagatctgagagacaaaaaagggagggatgggggagggggaagatagtgataaaggaagaaacacaactccacgagcaggcaggtgacctttccccaagaagggggaccgggctgcctaaaaaaagcgaaaggactctcctaccttctgcaacgcggaggttgggcctcatcattcttctccagcaccggcaaggctcctacaatttcccaacccccaaataaaatctttgataaaaccaatttgggaaggcaaaagactagcaacttggcaagaacgatgcaaccttcgaactctgggtaggtgaaaaaaaggattccctattccagcaaag

SEQ ID NO: 61306 - protein, 51 aa, Zea mays
  misc_feature: Ceres CLONE 1522975
  misc_feature (26)..(26): Xaa is any aa, unknown, or other
GAPRGGGRSRTSGSPGLQEFVSPLDXLASQLRACIIKPNHRHFPFRSLEGG

SEQ ID NO: 61307 - DNA, 651 bp, Zea mays
  misc_feature: Ceres CLONE 1522976
  misc_feature: Translation starting site: 144
ctggagctccccgcggtggcggccgctctagaactagtggatcccccgggctgcaggaattcgtctcacccctagaaaaaacccgcttcccccagccgcacgaaaccctaacgccgccgccgcttcacaggtaagccgccgtcatggtctccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtcgggtggactcgtacgccagaagatgaagtacctccgctttctccgcagcggatgaacaccaagccatcccatgggcccatccacttccgcgccccgtcaaagatcctgtggcgcaccatccgcgggatgatccgccaaagaccaaaaggggggaggcggctctggcaaggctcaagacgtacgaaggcgtccccgccgccttacgacaagaacaaccgcctggtcatccctgaccctcttaagggcctgaagctgcaaccctgaaaccaaggactgcctccctgggtgaattttccaaggggggccggatgggaactcccctggacccctcccgggacctttgggggaaaaaaaaaaggaaa

SEQ ID NO: 61308 - DNA, 641 bp, Zea mays
  misc_feature: Ceres CLONE 1522983
  misc_feature: Encodes the peptide sequence at SEQ ID NO. 61309
catctggagctccccgcggtggcggccgctctagaactagtggatcccccgggctgcaggaattcgtctcacccctagaaaaaaacagacgctcgcttcgtttataaatacgctgcgccatacgcccacctcgaacctgagaacctgacgcggcatcatgcaaacaaaaccgatcagagagatggcggccgtctcctccaccgccaccgcctcctcgcagccggagctgccgacctccaccgcccaccctaccgccaatgccgccgccatcagcaggctggcgcggcggccacggcggaacaacagcttcgtgatggtggaggaggcgtcctatgccagcggcggcggcgacggcggggtggccaccacgaagagcctcgcggaggacgacctggaggagctcaagggctgcgtcaacctcggcttcggcttcgcctacagcgagatacccgagctctgcgggacgctgcccccgctcgagctctgctactccatggacccggaggttcctcgacgagcaaagggccccgggccaggattgagaagaaggaggagcccggcgtccccgccgctcccaaagggggaggatccttggcccggggaaaaccaaagaaccacctttgctggagctgtatcccgag

SEQ ID NO: 61309 - protein, 153 aa, Zea mays
  misc_feature: Ceres CLONE 1522983
  misc_feature (14)..(136): Pfam Name: DUF1685 Pfam Description: Protein of unknown function (DUF1685)
MAAVSSTATASSQPELPTSTAHPTANAAAISRLARRPRRNNSFVMVEEASYASGGGDGGVATTKSLAEDDLEELKGCVNLGFGFAYSEIPELCGTLPPLELCYSMDPEVPRRAKGPGPGLRRRRSPASPPLPKGEDPWPGENQRTTFAGAVSR

SEQ ID NO: 61310 - DNA, 694 bp, Zea mays
  misc_feature: Ceres CLONE 1522996
  misc_feature (145)..(145): n is a, c, t, g, unknown, or other
  misc_feature (202)..(202): n is a, c, t, g, unknown, or other
  misc_feature (311)..(311): n is a, c, t, g, unknown, or other
  misc_feature (312)..(312): n is a, c, t, g, unknown, or other
  misc_feature (314)..(314): n is a, c, t, g, unknown, or other
  misc_feature (315)..(315): n is a, c, t, g, unknown, or other
acatcctggaggctccccgcggtggcggccgctctagaaactagtggatcccccgggctgcaggaattcgtctcacccctaaaaaaaatctacgctgctatctagagacagccgtgaccagttcgggtccagccgagagcaaccnacaacatgaccctctcgtttaagctggtggccggcgttcttctggtcctggcattanctctgctcccctcgagcgccaaagaaaggagcacccggcgcgcttcctattccaacgctgatgggctcaaatcgcgtattatacttcagaaggaaaaaaaaaccccaannannccccctccctccctccaaaccccaccggaaatatgggggcggaggtttttttttttcccccccccccccaaggagaaagatagggggtttttttttccccctttcttcttccccccccgtcctcagagaaacataatatttttttcccttttccatgtcgccgcaaattttcccgcgcgttcttacaccctcctgcccccactcttatctccccacccctgttcccctaccctcccatcggcaccctttctgcctccgcacaccgctcaccccagcgccccccccgtcactgctcccactaccccccccccaccccagccgcggcccctccctcgtccttcttcgcaaatccgtgctctgctgcgccctccccccctcc

SEQ ID NO: 61311 - DNA, 614 bp, Zea mays
  misc_feature: Ceres CLONE 1523002
  misc_feature: Encodes the peptide sequence at SEQ ID NO. 61312
aaagctggagctccccgcggtggcggccgctctagaactagtggatcccccgggctgcaggaattcgtctcacccctagaaaaaacctgacacctcccgccgcccgtcggcgattcgcaatggccttcgccggcaacgccgacgactcggcggaggactattccgcggaggccaccgtggtgcgcttcgacccgccgctccctctcctccgggcgccagtcccctcgccagcatctagcggcgagggccccgtcctcgccttccgcgacgtcgcgagctggcgagccgcctgggaggccgccgaggccagcctcgtctcccagtgcgagctggccgaggtgcctcgcgatagtcatgcaaggcagtaagtttagcagctgcaaatatcaaggagggcaaaccagctcctggctactggagctcagtggttagggttgacaatgcccccataatcgccggactatgtttgtttcacttatgttttttttactttgtgacgatgtgttcctttgtggaaaccggaatggttagggttgacaatgcccccataaccgctggacctttcatgtggcatttatatttgtttcccttttgaaaaaaaaaaaaaaaccagg

SEQ ID NO: 61312 - protein, 82 aa, Zea mays
  misc_feature: Ceres CLONE 1523002
MAFAGNADDSAEDYSAEATVVRFDPPLPLLRAPVPSPASSGEGPVLAFRDVASWRAAWEAAEASLVSQCELAEVPRDSHARQ

SEQ ID NO: 61313 - DNA, 728 bp, Zea mays
  misc_feature: Ceres CLONE 1523127
  misc_feature: Translation starting site: 153
  misc_feature (428)..(428): n is a, c, t, g, unknown, or other
  misc_feature (556)..(556): n is a, c, t, g, unknown, or other
aaagctggagctccccgcggtggcggccgctctagaactagtggatcccccgggctgcaggaattcgtctcacccctagaaaaaagccgtcatcgcttcacgtccgctacataccggcgaggagacgaaggagggagttttgagaagcataaatggctcctaaagccgctcctgtcaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgaagtacccaagaatcagcactactggaagaaacaagcttgatcagtaccaaatcctcaagtaccccctcaccacagaatctgcaatgaagaagattgaagataacaacactctnggtctttattgttgacctcaaggcagacaagaaaaagatcaaggctgcagtcaagaagatgtatgacattcaagcaaagaaagtcaacaccctgatcaggcctgatgggaagaagaaagcttatgtgnaactgacacccgactacgatgcccttgatgtggccaacaaaattggcatcatctaagttaataggcaactggattcgacatctatgtcctactagttctgaacatacaacagatttttctatggtactagaaattttgtttggcaaatgggttgtttttttgcacctagtct

SEQ ID NO: 61314 - DNA, 760 bp, Zea mays
  misc_feature: Ceres CLONE 1523128
  misc_feature: Encodes the peptide sequence at SEQ ID NO. 61315
  misc_feature (514)..(514): n is a, c, t, g, unknown, or other
  misc_feature (717)..(717): n is a, c, t, g, unknown, or other
  misc_feature (722)..(722): n is a, c, t, g, unknown, or other
  misc_feature (727)..(727): n is a, c, t, g, unknown, or other
  misc_feature (736)..(736): n is a, c, t, g, unknown, or other
  misc_feature (737)..(737): n is a, c, t, g, unknown, or other
  misc_feature (743)..(743): n is a, c, t, g, unknown, or other
  misc_feature (757)..(757): n is a, c, t, g, unknown, or other
  misc_feature (760)..(760): n is a, c, t, g, unknown, or other
aaagctggagctccccgcggtggcggccgctctagaactagtggatcccccgggctgcaggaattcgtctcacccctagaaaaagttgcttgctcccaaaatcaatcgcctcccgcctccagcactcttaactcatgggacacgatcgccatggccgccacatcgaccgccgccgccatgctgtgcccgccgtccgtggccaggctccgcctggcaccgtctcccggacgggcgcgcgtgtcattcacgcgggacctgcaccagctcggcggtccgcggacgggcacgcggcactgaactacgcgctggtgaactggctgaacatgggcgtggacttcttcctgggccggttcaccttactccacttccggggggggaacggggcccaaacaggtgccgggggcaaaaccccaaaaaccgccttcggaatgcaggggaaaaaccgcacccaaggaaattctgggggccctggctccaaatccaaaaagaccccgggggggctttaaaccctccnccaaaaataccccccaccctgagggatgcggccccggccaatttccgtatcctaataaagttcctcccccccccccacagaagaaggaaaacaacccccccaacttttttttgaagagggtcacacggggaattctctctcaaaaaaaagcccctgtggcaattgaggtgagcccagtattcctgcaaaaaacttggtggggnggggncccanccccccccnnaaaaanccccgccccagaanaan

SEQ ID NO: 61315 - protein, 48 aa, Zea mays
  misc_feature: Ceres CLONE 1523128
MAATSTAAAMLCPPSVARLRLAPSPGRARVSFTRDLHQLGGPRTGTRH

SEQ ID NO: 61316 - DNA, 834 bp, Zea mays
  misc_feature: Ceres CLONE 1523129
  misc_feature: Encodes the peptide sequence at SEQ ID NO. 61317
  misc_feature (815)..(815): n is a, c, t, g, unknown, or other
atagctggagctccccgcggtggcggccgctctagactagtggatcccccgggctgcaggaattcgtctcacccctagaaaatcagacgcaaccccgcgggtcgcgggatcaaggagccagagagcgggacgcagcgagcgttccgccagagatcgagaccgtagctagggtttgaggcgccgggctgcggtggacgagatgtccacgccggcgaggaagcggctgatgcgggacttcaggcgcctgcagcaggacccgcccgccgggatcagcggcgcgccgcacgacaacgacatcatgcctctggaacgccgtcctatttcgggcctggatgacaccccgtggggaccgggggttttttttttcttaccttggggggggggggggggattacccctaccaattttaacagggcgcccccactctgtcctcgggggaatgatcgattcccgagcataatgctggtgggggggagggctgccgagtatgtgagagtctttacaaccaccgcccgtggtacgccccccggccccggggtgtttctccgtcgcggttatgaagcccttgaaagccgcggtagcggcggcgggggcaagatccccagagcctctggtgcttgccggctgtgcggggtgcgcggccgctccgaccaggattagcgtgtgtgctcgcgcgcgcgcaggcgtaaataagccacactcacggcgggtgctgtgggggtggagggctagacgagcgagtgatatgtgggccccgcgccccgtttttgtgtttgtgtggggtgttggcccgatccatcgcgccccgttggggngactgtctaccgacgttgg

SEQ ID NO: 61317 - protein, 86 aa, Zea mays
  misc_feature: Ceres CLONE 1523129
  misc_feature: SWISSPROT Homolog: EC 6.3.2.19 Ubiquitin--protein ligase
MSTPARKRLMRDFRRLQQDPPAGISGAPHDNDIMPLERRPISGLDDTPWGPGVFFFLPWGGGGGLPLPILTGRPHSVLGGMIDSRA

SEQ ID NO: 61318 - DNA, 789 bp, Zea mays
  misc_feature: Ceres CLONE 1523133
  misc_feature: Encodes the peptide sequence at SEQ ID NO. 61319
  misc_feature (209)..(209): n is a, c, t, g, unknown, or other
  misc_feature (428)..(428): n is a, c, t, g, unknown, or other
tccccgcggtggcggccgctctagaactagtggatcccccgggctgcaggaattcgtctcacccctagaaaaaccacagacgacagggagtatgggcatgaagcggcaccggttccacttcctccaccacgacgacgaggacgaggagaagaatatggcggcgaggaagcggctccgccacgctgatgagcacgacgacgacagcgacnacgaggaggatgagcaagtgtaagagatggtccggcgcttcaggaaagcgatcatgaggaggaggtttcggccacgggcacgggcatggacgccggttccggcttcttccaccacatccaccgccccccccaaggaaggccaaaaacccccggcgatggttgaagaaaaggaaaagcggtgtccttggccaaccatcatagggcccccccccaaccggntccaagagggtggcctcattcgaagcggatcccggcccccttccattcccttccccggggccctgggggggggttggccctttttttaaaatatttaaaaaaaagacgaaacccccgggtggcgcccccccccacgggccttgggcgcggggggggaatttttcctggggggggcttatagaggggggtgttccccgcgcgcgggggtggggccccgctgtataaatagggacccttgtgcgaccccggatgttcgaggggtgcccgatccccccgcgggtgtgggggtgggggcgattcacccctgggtgctgtgttgtcgagggcgttctttccaggcgcgtcgtgctcgccccccctt

SEQ ID NO: 61319 - protein, 46 aa, Zea mays
  misc_feature: Ceres CLONE 1523133
  misc_feature (40)..(40): Xaa is any aa, unknown, or other
MGMKRHRFHFLHHDDEDEEKNMAARKRLRHADEHDDDSDXEEDEQV

SEQ ID NO: 61320 - DNA, 710 bp, Zea mays
  misc_feature: Ceres CLONE 1523138
  misc_feature: Encodes the peptide sequence at SEQ ID NO. 61321
  misc_feature (437)..(437): n is a, c, t, g, unknown, or other
  misc_feature (567)..(567): n is a, c, t, g, unknown, or other
  misc_feature (568)..(568): n is a, c, t, g, unknown, or other
ccccgcggtggcggccgctctagaactagtggatcccccgggctgcaggaattcgtctcacccctagaaaacaacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctccacggccacggcaagacggccaaggtgatgcacctgctgctctggggacccaagtgaagcggcgagaggccaccgtaccgccggcgttgctcgttttgctctgcctgncatccgccccgcacggactgtactgtactgtacctatacacctatatactacgacgtgcacatgtacgagtctacgacgtgctgctgtaccatactaatactagtgcgctgctgctcccttgccttcttnngctgcaagtgcacagccactccgctttttttgctcgacgatcgactgctcgtcgcgtcgggccaggccggtcgtcagtttggtgtgtcactccactgtaaagcccccctcttgtttttgggactcctgcatgccaagttagg

SEQ ID NO: 61321 - protein, 73 aa, Zea mays; identical to SEQ ID NO: 58678
  misc_feature: Ceres CLONE 1523138

SEQ ID NO: 61322 - DNA, 804 bp, Zea mays
  misc_feature: Ceres CLONE 1523141
  misc_feature: Encodes the peptide sequence at SEQ ID NO. 61323
  misc_feature (248)..(248): n is a, c, t, g, unknown, or other
  misc_feature (338)..(338): n is a, c, t, g, unknown, or other
  misc_feature (343)..(343): n is a, c, t, g, unknown, or other
  misc_feature (344)..(344): n is a, c, t, g, unknown, or other
  misc_feature (474)..(474): n is a, c, t, g, unknown, or other
  misc_feature (475)..(475): n is a, c, t, g, unknown, or other
  misc_feature (487)..(487): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (528)..(528): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (608)..(608): n is a, c, t, g, unknown, or other
  misc_feature (617)..(617): n is a, c, t, g, unknown, or other
  misc_feature (649)..(649): n is a, c, t, g, unknown, or other
  misc_feature (661)..(661): n is a, c, t, g, unknown, or other
  misc_feature (662)..(662): n is a, c, t, g, unknown, or other
  misc_feature (688)..(688): n is a, c, t, g, unknown, or other
  misc_feature (729)..(729): n is a, c, t, g, unknown, or other
  misc_feature (737)..(737): n is a, c, t, g, unknown, or other
  misc_feature (757)..(757): n is a, c, t, g, unknown, or other
  misc_feature (779)..(779): n is a, c, t, g, unknown, or other
  misc_feature (780)..(780): n is a, c, t, g, unknown, or other
tatccgtggagctccccgcggtggcggccgctctagaactagtggatcccccgggctgcaggaattcgtctcacccctagaaaaaagggtgaagcaccgccgccgtctccgctgccgcacaaagacgagaggaagaggttcccggcgcctccaccaccatgtcgtcgatgatgaacgcgctggcgaactggctggcgaacccgcgccgcaacccgctggcgcgcctccccatgcacgccgtctcctcncgcctcaggaaatacggactgaggtacgacgacctctaccacccctacttcgggctggacatctaggaggcgctccgtaaggttgcctanagaannggtcaaaacccggttttttacgccccccccgtgggggggggggggggccctggatcccccattacccccccccagggggtgtttggaactggagggttcccatcccaccgataattgtgaggccacccgnnccagcgcatggngacaacatgaccgtgccccnnnntcacaatgtccctgtggnaacactgtttcgcaaagcccctacgtgnnncccgtgccnnnnggctgggtgggtacaagtcgggcggtggtttgactttngtcgtcgantctcgtgcagtataagcgcacgccctccgcanagctcgcacggnnggtacagggaggcttctattggtcancccgcttgagccgccccgatattaccgcttctcgccccgcntcaggagncactcccccgagcccgccgngatctctcccacccgtcggggnntttcgctttcgccggcctcatgcc

SEQ ID NO: 61323 - protein, 51 aa, Zea mays
  misc_feature: Ceres CLONE 1523141
MSSMMNALANWLANPRRNPLARLPMHAVSSRLRKYGLRYDDLYHPYFGLDI

SEQ ID NO: 61324 - DNA, 739 bp, Zea mays
  misc_feature: Ceres CLONE 1523142
  misc_feature: Encodes the peptide sequence at SEQ ID NO. 61325
  misc_feature (506)..(506): n is a, c, t, g, unknown, or other
  misc_feature (617)..(617): n is a, c, t, g, unknown, or other
tacccgcggtggcggccgctctagaactagtggatcccccgggctgcaggaattcgtctcacccctagaaaaactctttctcttagactatctgccgctccagcctttcgctagggtttatccaccggcggcgcacgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaagaaccgcagaactgtgaaccgtccctatgggggagtactatctggaactgcagttaaaaaaaggatcatccgtgcttttcctggttgaaaaccaaaagattgtcaagaaggtgttgaaatttccgaagacccaagacaagacttcctcanaaaagtaactctgaaacaaaagtgacccctccctttctggccagcagggaaaaattttttgtcgacagttattatcaggggcttatccccctcaaccgggtccaatgttcntggaacctggacgggacaccgggtttctaggggccccttgaaatctgttctgcgaaatcttcttagaatttggagaaaaaaaagaaccaaacaaaacaaccacaaaaaaagaattagtgccc

SEQ ID NO: 61325 - protein, 97 aa, Zea mays
  misc_feature: Ceres CLONE 1523142
  misc_feature (5)..(95): Pfam Name: Ribosomal_L34e Pfam Description: Ribosomal protein L34e
MVQRLTYRKRHSYATKSNQTRVVKTPGGKLVYQYTKKRASGPKCPVTGKKIQGIPHLRPAEYKRSRLSKNRRTVNRPYGGVLSGTAVKKRIIRAFPG

SEQ ID NO: 61326 - DNA, 684 bp, Zea mays
  misc_feature: Ceres CLONE 1523144
  misc_feature: Encodes the peptide sequence at SEQ ID NO. 61327
  misc_feature (320)..(320): n is a, c, t, g, unknown, or other
  misc_feature (329)..(329): n is a, c, t, g, unknown, or other
  misc_feature (330)..(330): n is a, c, t, g, unknown, or other
  misc_feature (404)..(404): n is a, c, t, g, unknown, or other
  misc_feature (462)..(462): n is a, c, t, g, unknown, or other
  misc_feature (467)..(467): n is a, c, t, g, unknown, or other
ctccccgcggtggcggccgctctagaactagtggatcccccgggctgcaggaattcgtctcacccctagaaaaattcctcggagagggagaagccgccgccgcagcaatcacagcagcccggagaaagcccaggtccgacaagatgcagatcttcgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactantacatccannaggagtctacgcttcacctcgtgcttaggctccgcggtggcatcattgagccctcgctgcaggcgctcgctcgncaagtacaccagggacagatgatctgccgcaaatgctatgcacgactgcaccctaggnctgtncactgccgcaagaagaagtgtggtccccgcaaccagctgaaggccaagaagaagatcaagaactgaggggctgctccaaaccagtttcaggaacaaggtggggctgattgcgtggggggttgtaaacccggttttgttacccaaatttgggggctccgttaggttttaccttgggtgcgaggaccccttctttttgagcattgccaccctggttttt

SEQ ID NO: 61327 - protein, 129 aa, Zea mays
  misc_feature: Ceres CLONE 1523144
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature (59)..(59): Xaa is any aa, unknown, or other
  misc_feature (62)..(62): Xaa is any aa, unknown, or other
  misc_feature (63)..(63): Xaa is any aa, unknown, or other
  misc_feature (107)..(107): Xaa is any aa, unknown, or other
MQIFVKTLTGKTITLEVESSDTIDNVKAKIQDKEGIPPDQQRLIFAGKQLEDGRTLADXYIXXESTLHLVLRLRGGIIEPSLQALARQVHQGQMICRKCYARLHPRXVHCRKKKCGPRNQLKAKKKIKN

SEQ ID NO: 61328 - DNA, 739 bp, Zea mays
  misc_feature: Ceres CLONE 1523150
  misc_feature: Encodes the peptide sequence at SEQ ID NO. 61329
  misc_feature (331)..(331): n is a, c, t, g, unknown, or other
  misc_feature (422)..(422): n is a, c, t, g, unknown, or other
  misc_feature (439)..(439): n is a, c, t, g, unknown, or other
  misc_feature (453)..(453): n is a, c, t, g, unknown, or other
  misc_feature (458)..(458): n is a, c, t, g, unknown, or other
  misc_feature (461)..(461): n is a, c, t, g, unknown, or other
  misc_feature (489)..(489): n is a, c, t, g, unknown, or other
  misc_feature (490)..(490): n is a, c, t, g, unknown, or other
ccccgcggtggcggccgctctagaactagtggatcccccgggctgcaggaattcgtctcacccctagaaaaaatccactctcagcatcaccagctaagaacaggtcttcgtctcaataatggaaggcaaaacaggggagctcaggtgctgtttcgtcgccatcgtgctcgtcctgcgtcttgtccttgagcagtcccatcacgctgaagctagaggcaaatggtgctgcgaaaccgccaccggacaataccattttaatcgctgcgttgactcgggttgggtcgacaatattgcgttctgtgcgagtaatgcaggttgcatcattatggangacagatgtgcatgtcgtttgccagtgcctgctcgtgatgcactttctctggatgtcattcgattaatcatacgcaggtacgtgaagtaangaaacgatggccaaacnaactgtctgtcagncgatnggntattcgtgaacttgcccatttggcctcnntattcaacttttcaaataggccctatcaagaaagcatgtcctcccccttcaaaatttggccactggtggcgtattccatcctttttttcccaaaaattaaaagaaacgagacccttggaggtacccattcccccccaaagggaggcataatacgcgcggccactggcccccttttttaaaagcccggagtgggaaaaaccggggtttccccacttttattgggttgtggaaatcccccttttccaaagg

SEQ ID NO: 61329 - protein, 100 aa, Zea mays
  misc_feature: Ceres CLONE 1523150
  misc_feature (71)..(71): Xaa is any aa, unknown, or other
MEGKTGELRCCFVAIVLVLRLVLEQSHHAEARGKWCCETATGQYHFNRCVDSGWVDNIAFCASNAGCIIMXDRCACRLPVPARDALSLDVIRLIIRRYVK

SEQ ID NO: 61330 - DNA, 556 bp, Zea mays
  misc_feature: Ceres CLONE 1523152
  misc_feature: Encodes the peptide sequence at SEQ ID NO. 61331
  misc_feature (378)..(378): n is a, c, t, g, unknown, or other
aagctggagctccccgcggtggcggccgctctagaactagtggatcccccgggctgcaggaattcgtctcacccctagaaaaagggtcgcgactcgcgaccagacgacaaacgtcgagaggggccgatcgtgatcgagcagcgatgtcgacgtcgcggaggcggacactgctcaaggtcatcgtccttggcgacagcggggtcgggaagacgtcgctgatgaaccaatatgtccacaaaaagttcagtcagcagtacaaagctacaatcggtgcagatttcgtcacaaagggaggttctgatcgaagacaggctagtcacgttgcagatatgggacacgcgggcaggaagatccagagtctgggggtgcatctacganggggcgatgctgggtgctccctatgatgtaactcttacggtcatttgatccctcatacatgggtggatgaattcctcacaccaggctagccccttcaaaacccaaaaaatttttccccttcccccttaacccgggaaaaaaaaattttttgtttaaatggggggggaaaaaaaccaaa

SEQ ID NO: 61331 - protein, 86 aa, Zea mays
  misc_feature: Ceres CLONE 1523152
  misc_feature (79)..(79): Xaa is any aa, unknown, or other
MSTSRRRTLLKVIVLGDSGVGKTSLMNQYVHKKFSQQYKATIGADFVTKGGSDRRQASHVADMGHAGRKIQSLGVHLRXGDAGCSL

SEQ ID NO: 61332 - DNA, 688 bp, Zea mays
  misc_feature: Ceres CLONE 1523160
  misc_feature: Encodes the peptide sequence at SEQ ID NO. 61333
  misc_feature (142)..(142): n is a, c, t, g, unknown, or other
aagctggagctccccgcggtggcggccgctctagaactagtggatcccccgggctgcaggaattcgtctcacccctagaaaaactcaggaccagtgcctcttcggtcaaaaatatccttgtacctgcatctcgacctcaccnggcgtccggcggtggtatcacgatggtggcgttgctgggccggcggatcggggtggctgcggcagctgccgcgttcatcgccctcgtggcgttcgggatccggccttcatcctcggcccaaggtccctttcggggaaagtcccaaccggtttttcccgcccaggaaggtcgtcttcttttcccaagtcaaactgcccctaactgcaaaaaaaacaaaggcccggttttaaaggactttggatttaaaaaaaaaccccttggtgtgggaaccttggatcccccgaaaaaaaccccccaaaaattccgggggggcctttttttaaaaaaattgggggaaggtaaattggcccccaaattttttgtcccgtagaaaacccccctgggggggttcaaaaaaaactggttaacccccccaaaagggggaaaaacgggtcaaaattttaaaaacccgggagacaggagacacctttttaggagggtcgcccccggcgcacccctgttttttttgtttcaaccccccgggggtttaacacccctcaagagggc

SEQ ID NO: 61333 - protein, 115 aa, Zea mays
  misc_feature: Ceres CLONE 1523160
MVALLGRRIGVAAAAAAFIALVAFGIRPSSSAQGPFRGKSQPVFPAQEGRLLFPSQTAPNCKKNKGPVLKDFGFKKKPLGVGTLDPPKKTPQKFRGGLFLKKLGEGKLAPKFFVP

SEQ ID NO: 61334 - DNA, 708 bp, Zea mays
  misc_feature: Ceres CLONE 1523162
  misc_feature: Pfam Name: RNA_pol_Rpb4 Pfam Description: RNA polymerase Rpb4
  misc_feature (49)..(49): n is a, c, t, g, unknown, or other
cagagctgagctcacgcggtggcggccgctctagactagtggattcttnggctgcaggattcgtctcacccctagaaaaaattccccttcgcaattcccagccccgttccccgtcggccgagtccagcgaggaagttctccccggtcggaagcaccaccggacaacagtgatggctggcgagaagaaggagaacgccccggagctcaagagtctctaagagttcctcaaggtcaggtgcctgatgaactgccaggtggcgatcatcctgcagcacaagtacgaccagatccatggctcgcgcggctgctgagtgggactcctcgtcgcaggtgtcgcccgagttctacaactagttgaagtacgtgaaggagggcggggggcagaacaacccctaagctattcacgggcccccccacacactaaaccgcaacggcctacgtcgaattcgggctgtggacgattcacgacctccagtccaaccaacccttggtaagaccgcctggttacgcgcccttcctacaattacgggcgcctgggtcgttccagacaacccgggggtataactttgtttggagaagaaaggtgtccggggaccctggccgtgtggcggtggtatgtctaaggtgggccgttggcgacccccctctttgctttttgacgctccttacttgtttgggaatgacgcaaaacccccgcacctgcgtaag

SEQ ID NO: 61335 - DNA, 716 bp, Zea mays
  misc_feature: Ceres CLONE 1523164
  misc_feature: Encodes the peptide sequence at SEQ ID NO. 61336
ggagctccccgcggtggcggccgctctagaactagtggatcccccgggctgcaggaattcgtctcacccctagaaaaaagcgccagacgcagacggccccgaacgccggcggcggagcatcaggtcgtcgacctccgagcatcgacccgccgcgatggagaagggaaagggcctcgctcgccgctgggcggtggagctccccgacgcctcctcctcctcccccgccgtccccgacccgcccggcttcaccagatccgcgcctgacgcggacgacgccgctggagcgcgccagcgcaaggactccgaggctgcatggaaggcgcagaaagcttgggaagttgcgcaggctccgttcaagaacctgatgatgatgggatttatgatgtggatggcagggagcaccccccacctcttcagcatcggaattaccttctctgctctgtggcaacccctcaacgctctccgatctgttgggaaagtttttgaaccatttaagggaccaagggtggatactattggctcctaagttgctccttattgcccctcatttggctgccaggggattgggtatattggaacctttatcctttgggccttctttcaaccaaatccattcgaatgggggggtcttctccgggctcctgctcgggaggttgaataagcccggaagaaggcctccccctttaatttaagggcccttttcccctttggacctt

SEQ ID NO: 61336 - protein, 123 aa, Zea mays
  misc_feature: Ceres CLONE 1523164
  misc_feature (16)..(124): Pfam Name: DUF1077 Pfam Description: Protein of unknown function (DUF1077)
MEKGKGLARRWAVELPDASSSSPAVPDPPGFTRSAPDADDAAGARQRKDSEAAWKAQKAWEVAQAPFKNLMMMGFMMWMAGSTPHLFSIGITFSALWQPLNALRSVGKVFEPFKGPRVDTIGS

SEQ ID NO: 61337 - DNA, 601 bp, Zea mays
  misc_feature: Ceres CLONE 1523165
  misc_feature (150)..(150): n is a, c, t, g, unknown, or other
  misc_feature (257)..(257): n is a, c, t, g, unknown, or other
  misc_feature (262)..(262): n is a, c, t, g, unknown, or other
  misc_feature (271)..(271): n is a, c, t, g, unknown, or other
  misc_feature (283)..(283): n is a, c, t, g, unknown, or other
  misc_feature (291)..(291): n is a, c, t, g, unknown, or other
  misc_feature (292)..(292): n is a, c, t, g, unknown, or other
tccccgcggtggcggccgctctagaactagtggatcccccgggctgcaggattcgtctcacccctagaaaaaatcggtttatctatccttctatccccattcccatcccgagacaggagagggcaaggatgctgctcctgagctcccccnttcggtgtaccgtggtcgccgccgccgccgcgctcagtccatggtgctcgccggcgctgcgatcgagggcgacagcagctgacggggcgggtggtgacgaccatgcngacanacgtcgggnttgaaggtggtncaccttgnntccccaccccatgtacaaccgccgggacctccttcaaaaaaaactacctggcgcccgaaccccggccacccggttcaagggccggggaaagaaccttaaaacacccaacccccccccgggggccgttttttcaaaaaaagaaaggacaaatttcccccccccgcgaatcgcggggtccccgcgggcccggggggaaaaaatccccccccgcaaaaatttttggggggccctcaagggggggggttccctttggtaataaaaaaggaaaatggggggcgccccccccccaaaaagggggggttcttcctt

SEQ ID NO: 61338 - DNA, 836 bp, Zea mays
  misc_feature: Ceres CLONE 1523166
  misc_feature (835)..(835): n is a, c, t, g, unknown, or other
ggggagtggggggaaagggtcaattaaaaaaattattaaaacgaattaaagcatccgtcgtagtggcggccgctctagtaatagaggatcccccgggctgcaggaattcgtctcacccctagaagaagcgcaaacatcgaatcgtctcactcgagtctgccctgctcatactgcttgccctcgccgtatcgtccactctcaacgcacaggaggattccatggtcaacaacaccgggacgttggtgggcagtatccaagacgtgccgggttagcaaaaacgaccttcacctccaggagctcgccccgcttcgccgtctatgagcacaacaagaaggtcaattgctcttcaggggatcgaagaagcttgtgaaggccaagacacaggtgggtgctgggcacaatgtactatctctctattgaagagaaggacggcgaattcaagaagctctactatagctaacgtcttgggagaagccatggtagaacctctcaagggctgcaggaattcaatcctggttctaaagagggggctagcgccataaggatgtcctcccttctccatgagtgctaacctgaagctccttagcctagtttgcaaaattaagaagccctggcttccccttgggataatttcataagaactacaacccctattaagaacttgggtttggttcgagtcctgaatcgaagggcaacatgaacggtgtatatattttcccttcgtatttcaaattaaaagggttttttaatctccctaccaagaatacttggagttcctcaacctagaccagaaccagcccttaaaaaaagaaaagaccaaaacaatatgacccana

SEQ ID NO: 61339 - DNA, 715 bp, Zea mays
  misc_feature: Ceres CLONE 1523169
  misc_feature: Translation starting site: 178
  misc_feature (1)..(1): n is a, c, t, g, unknown, or other
  misc_feature (266)..(266): n is a, c, t, g, unknown, or other
  misc_feature (470)..(470): n is a, c, t, g, unknown, or other
  misc_feature (560)..(560): n is a, c, t, g, unknown, or other
nacagctggagctccccgcggtggcggccgctctagaactagtggatcccccgggctgcaggaattcgtctcacccctagaaaaaatccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggncaccgctggtgcctcccacccgccttacttcgagatgatcaaggaggctatcacggcgctcaaggagaggaccggctccagctcgcaagcaatcgccaagcacgcgggggaggaggggggggcgtctctgcccgccaacttcaagaagatgctttccatccagctccgtggggtcctcagccaaggggcgagctcctgaaggtnaaaggttctgtaaaaactcctcggaccgcccccaaaaaaggattcccccccaaaacccaaggttaatccctgcaaaggccccccgcgttngaggagcctcgtcccccaagccgggcaaatgccacccccccccagctcaaaaaagggtgcgggggccccccccacaaacagtccgccccttcccgggaacaaaggcacaaggggccccaccaaatacgtctggtggagccttgcaatgtccccgc

SEQ ID NO: 61340 - DNA, 689 bp, Zea mays
  misc_feature: Ceres CLONE 1523170
  misc_feature: Encodes the peptide sequence at SEQ ID NO. 61341
  misc_feature (442)..(442): n is a, c, t, g, unknown, or other
cagagctggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcanggggctgcaggaatttcagcctgttgaagaggtgctagcgcctaaggatgtctcctttctcatgtgcgagcctgaagctcaaagcaaagttgcagaaataggagccatgctcccttgtgtaatttcataggactaccaccctattagggcttggtttggttggtctgtattcaaagaaatggaggggattaattttccttcaattctaaaagaggggtttaaacttcctcaaaaatcttcaatcaaa

SEQ ID NO: 61341 - protein, 131 aa, Zea mays
  misc_feature: Ceres CLONE 1523170
  misc_feature (10)..(98): Pfam Name: Cystatin Pfam Description: Cystatin domain
  misc_feature (89)..(89): Xaa is any aa, unknown, or other
MANNTGTLVGGIQDVPGSENDLHLQELARFAVDEHNKKANALLGFEKLVKAKTQVVAGTMYYLTIEVKDGEVKKLYEAKVWEKPWENLXGLQEFQPVEEVLAPKDVSFLMCEPEAQSKVAEIGAMLPCVIS

SEQ ID NO: 61342 - DNA, 748 bp, Zea mays
  misc_feature: Ceres CLONE 1523174
  misc_feature: Encodes the peptide sequence at SEQ ID NO. 61343
  misc_feature (341)..(341): n is a, c, t, g, unknown, or other
  misc_feature (389)..(389): n is a, c, t, g, unknown, or other
  misc_feature (396)..(396): n is a, c, t, g, unknown, or other
  misc_feature (410)..(410): n is a, c, t, g, unknown, or other
ccccgcggtggcggccgctctataactagtggatcccccgggctgcaggaattcctctcacccctagaaaaatttaatcaatccttcaagcgcaagctgcctcctcctcgtcgtccggtcgtgagaagggatggcgggccgtggcaaggctatcggcgctggcgccgcgaagaagccaacgtcgaggagctccaaggccggactccagttccccgtcggcaggattgctaggttcctcaaggcgggcaagtacgctgagcgcgtcggcgccggcgcccccgtgtacctcgccgccgtcctcgagtacctcgcggctgaagttctcgaacttgccgggaacncctctagggacaaccacaagacggggggggtggcggcgccacatccancttgctntcccccaccaccanaacctgaacaaactgttggggtggtgccaccatcccggagcggaggtgttatgcctaacatcccttcggctctgggtccccaaaaagggtggccccctccaagggcaggggtccaagaagaaaaaaaaattggaattggcttcctggaaaaaaggatcccacccccccccttgtttttgtagaaataagaagaatttggcccttccaatcgggggaggagccgggtaatccccgcgaaagagaaaaaaaaataagatcgcggtttttttagaacggagatggaagcatgggcgggtaatcccacgaggtggggtggccccgggaaaaaaaagagtggg

SEQ ID NO: 61343 - protein, 153 aa, Zea mays
  misc_feature: Ceres CLONE 1523174
  misc_feature (19)..(85): Pfam Name: Histone Pfam Description: Core histone H2A/H2B/H3/H4
  misc_feature (71)..(71): Xaa is any aa, unknown, or other
  misc_feature (87)..(87): Xaa is any aa, unknown, or other
  misc_feature (89)..(89): Xaa is any aa, unknown, or other
  misc_feature (94)..(94): Xaa is any aa, unknown, or other
MAGRGKAIGAGAAKKPTSRSSKAGLQFPVGRIARFLKAGKYAERVGAGAPVYLAAVLEYLAAEVLELAGNXSRDNHKTGGVAAPHPXCXPPPPXPEQTVGVVPPSRSGGVMPNIPSALGPQKGWPPPRAGVQEEKKIGIGFLEKRIPPPPLFL

SEQ ID NO: 61344 - DNA, 724 bp, Zea mays
  misc_feature: Ceres CLONE 1523175
  misc_feature: Encodes the peptide sequence at SEQ ID NO. 61345
  misc_feature (477)..(477): n is a, c, t, g, unknown, or other
  misc_feature (516)..(516): n is a, c, t, g, unknown, or other
ggggctccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgaaatatatctatctagcttgtggtgggtggtgaaacataataagcgaggccgagctggctgccatacatangtattgtgtggtgtgtggtaaaaaaaaaaaaaaccgagntcttcagttggctatccctccctgcatggttggcggtcagcctttgggcccatgtacctaccgtgtggccacccggcggtttgttgaacccattgcatcggcggaacctaaatttaaatggcccccaaagaaaagatttgaaccttatataaccccaacccggatttctttttaaaaaaaaaaaaaaaagaaaccctcggggaccctc

SEQ ID NO: 61345 - protein, 76 aa, Zea mays; identical to SEQ ID NO: 8464
  misc_feature: Ceres CLONE 1523175
  misc_feature (1)..(76): Pfam Name: Metallothio_2 Pfam Description: Metallothionein

SEQ ID NO: 61346 - DNA, 711 bp, Zea mays
  misc_feature: Ceres CLONE 1523177
  misc_feature: Encodes the peptide sequence at SEQ ID NO. 61347
  misc_feature (145)..(145): n is a, c, t, g, unknown, or other
  misc_feature (195)..(195): n is a, c, t, g, unknown, or other
  misc_feature (215)..(215): n is a, c, t, g, unknown, or other
  misc_feature (218)..(218): n is a, c, t, g, unknown, or other
  misc_feature (251)..(251): n is a, c, t, g, unknown, or other
  misc_feature (252)..(252): n is a, c, t, g, unknown, or other
  misc_feature (305)..(305): n is a, c, t, g, unknown, or other
  misc_feature (307)..(307): n is a, c, t, g, unknown, or other
  misc_feature (352)..(352): n is a, c, t, g, unknown, or other
  misc_feature (355)..(355): n is a, c, t, g, unknown, or other
  misc_feature (399)..(399): n is a, c, t, g, unknown, or other
  misc_feature (400)..(400): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (483)..(483): n is a, c, t, g, unknown, or other
  misc_feature (489)..(489): n is a, c, t, g, unknown, or other
  misc_feature (490)..(490): n is a, c, t, g, unknown, or other
  misc_feature (518)..(518): n is a, c, t, g, unknown, or other
  misc_feature (526)..(526): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (612)..(612): n is a, c, t, g, unknown, or other
  misc_feature (620)..(620): n is a, c, t, g, unknown, or other
  misc_feature (621)..(621): n is a, c, t, g, unknown, or other
  misc_feature (645)..(645): n is a, c, t, g, unknown, or other
  misc_feature (651)..(651): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (697)..(697): n is a, c, t, g, unknown, or other
  misc_feature (698)..(698): n is a, c, t, g, unknown, or other
aaaactggagctccccgcggtggcggccgctctagaactagtggatttcttgggctgcaggaattcgtctcacccttagaaaaatgaaggtgaacctacacccaaactggcgaaagacgtcaggggtgacgacaagatggtccancaggtggaagatgaactgccatccaggattgcacaggatgctaatggtcnatctaaggtgaccgaacacntcnaggacggattatcaaagtgcaaacttgatgacnntattgagaaatacgaagagttggtcattatgactttccacgggggggaaaaanantcttttccgggtactccttgaagcctcccttcaaccccggaggcnaanatattttttccccccccccccgggggggggggggggggggaaannccttatnnnaattataattaatcccccctccctgaggnnnngtgaggaaaaaaaaatcaaaaannncttttgggcgcgatttnttctanngggggcagggggggatataccatccaanccacactnacgnnnnngattatagaattcgcgcggcccccggccaatnnncgagggcgcgccgcaaacaannnnngtgcgcgnnnnnnnnntanggtcgagnngcccgagcgcggcgtcaggcgggncggcgnggcgctgtgcggtgccggccgggnnnnnngtgctnnnctgcggggnncctagagtatgcg

SEQ ID NO: 61347 - protein, 63 aa, Zea mays
  misc_feature: Ceres CLONE 1523177
  misc_feature (3)..(3): Xaa is any aa, unknown, or other
  misc_feature (20)..(20): Xaa is any aa, unknown, or other
  misc_feature (27)..(27): Xaa is any aa, unknown, or other
  misc_feature (28)..(28): Xaa is any aa, unknown, or other
  misc_feature (39)..(39): Xaa is any aa, unknown, or other
  misc_feature (57)..(57): Xaa is any aa, unknown, or other
MVXQVEDELPSRIAQDANGXSKVTEHXXDGLSKCKLDDXIEKYEELVIMTFHGGEKXSFPGTP

SEQ ID NO: 61348 - DNA, 741 bp, Zea mays
  misc_feature: Ceres CLONE 1523181
  misc_feature (508)..(508): n is a, c, t, g, unknown, or other
  misc_feature (606)..(606): n is a, c, t, g, unknown, or other
  misc_feature (698)..(698): n is a, c, t, g, unknown, or other
  misc_feature (708)..(708): n is a, c, t, g, unknown, or other
ggggctccccgcggtggcggccgctctagaactagtggatcccccgggctgcaggaattcgtctcacccctagaaaagaccggaccgacgagcgacgaagcgcgcagaaagaaaagaacctcggagctgagatggcacaagccatggcgtcgatgaaccggcctctcgcagggcgtcctgcccagcaggcgcgccgacagcagaaccaggacggccgtcgtcatccgtcagggcgtccgcggagggcgacgccgttgcgcaggcgggccgccgcgccgtgatcgggctggtggccactggcatcgtcggcggcgccttgtcgcaggcggcgcgcgccgagaccgtcaagaccatcaagattggagccccgccgccgccctccggtggactccccgggactctcaactctgaccaggcgagggacttcgacctccccttgaaggagcggttctacctgcagccgctgccgccggcggaggcggcggcgagggtgaagacgtcggcgcangacatcatcaacctcaagccgctcatcgacaagaagggcgtggccgtacgtccagaacgacctcccgcctccgggcctcctacctgcgctacgacctncagaccgtcatcgctccaagccccccagggaggaagaagaagagcctcaaggagctcacccggcagctcttcagcacccatcgacgatcttngaccatgccngcgaaagatcagagcaccccagaagcccgagaa

SEQ ID NO: 61349 - DNA, 680 bp, Zea mays
  misc_feature: Ceres CLONE 1523184
  misc_feature (609)..(609): n is a, c, t, g, unknown, or other
  misc_feature (624)..(624): n is a, c, t, g, unknown, or other
  misc_feature (648)..(648): n is a, c, t, g, unknown, or other
caaagctggagctccccgcggtggcggccgctctagaactagtggatcccccgggctgcaggaattcgtctcacccctagaaaaacttcgtcgttcctcaaccgttaatttctagagagagatagggcatcgttgtgccagggactcggcggcggctccgcctggggctctcggctacctgctcttggctacctgccctgccctggtggtgcgatcgagcgaagtcgcagcggcgctgggtaccagtacggtgcatccgcggacgttgaggaccgacaggatctcgtgaattcctcatcggagttcttccctcgtcgcgagtcgaccctcatcgtggacagctcgctcgcgcgcccgatcctcgcagtgaggtcatgaggatttgaagaatcatcctggtacctagaatctcaagtgccaggagaagaacaggtggttcaagaggagccacacaacgaggagtttgacttgatctaggtggcgtctcctagttgactttctggcgccaaggatggactttaggtccgttatatatttatcttttatcctgtaagacttccgctatgtaataaatactctgattatattgggacatttatctctttgccnaaaaagaaaaacaangatacacaacaaagaaaacccccntaaaaaaagctaaaaaatacctgccaccctaa

SEQ ID NO: 61350 - DNA, 712 bp, Zea mays
  misc_feature: Ceres CLONE 1523185
  misc_feature: Encodes the peptide sequence at SEQ ID NO. 61351
  misc_feature (53)..(53): n is a, c, t, g, unknown, or other
aaagctggagctcaccgcggtggcggccgctctagactagtggattcctcggnctgcaggattcgtctcactcctagggaagccactcatcaccagctagtagctctagcaaagcacttgccatctaccgaccgccgcattccaaacagcccgacgagctagcagagcggcaggcacctcctccaggaacatggcccgcacgcctcagttggcagtaatggccacagcctcggtggcccttggtgccgcctggcgggcgccaccccggaggtggtcatttcgttgcgggcggggggcggccggacctccccccctgcactttcaacgtatgggggcccgggttccagggtcttttccgcgctttcgcgaccagggggggcgggggggggtagaggggggatccccgccaaaacccccaccgcgcggggggggggtcgtaagacgggcctgggagaggcgcgtcggcgtgtcttttgtgcccacgcgcgagcgccggggtgctcgtccgccggccatgtttgcgagttcgcttctaccggtcgtttcgtgcgacgcgtagcggcgcgcctgcgcacctcacgcgttcccacgccgtcgtgacgtccctgggcgggtgtcgtataatgggccccatatacgtatcttcctcgtggagagttggggcgcgtcgggatctaggcgcggcccgtgacacctccgctcccccgcggcg

SEQ ID NO: 61351 - protein, 122 aa, Zea mays
  misc_feature: Ceres CLONE 1523185
MARTPQLAVMATASVALGAAWRAPPRRWSFRCGRGAAGPPPLHFQRMGARVPGSFPRFRDQGGRGGVEGGSPPKPPPRGGGVVRRAWERRVGVSFVPTRERRGARPPAMFASSLLPVVSCDA

SEQ ID NO: 61352 - DNA, 727 bp, Zea mays
  misc_feature: Ceres CLONE 1523187
  misc_feature: Encodes the peptide sequence at SEQ ID NO. 61353
  misc_feature (355)..(355): n is a, c, t, g, unknown, or other
  misc_feature (382)..(382): n is a, c, t, g, unknown, or other
cgcggtggcggccgctctagaactagtggatcccccgggctgcaggaattcgtctcacccctagaaaaaaaaacggagaaaaagaaagaggagctcggacaaggcagagcgccatcgttcggtttccttgctgaattcccgatcgctcgctcgctcgaaaagaaagaagctagcttttagcatggcgtctctggcgttcggcagcaccgtagcggcggccgtggcggcgacatcggggaggacgcggccggcgcgccggtccgtgctggtcgtgccgcccgctgccagcaggggcggcccggcgccggccaaggaggagaagggcctcggcgagaccatcttcggcttcatcttncagaaggaccagctggtggagacgganccgctcctcaacaacgtcggcgccgcgccgggcgccgcctcccgcgccaagacgacccgcggcaagaaggctgccggcggcgacaacagcggcagcggcggggggtccaccctcggcgggcctcggcggcctcttccccaagaaaagcagctgaacgtggcgttgtttatgaattgcccaactcaagctgggatttggtttttgagggggaaatggttgcccatatatatttgtggacgggtgggggtgggaccgggggactttgatggccaaaagggaaaacccccacttcccaaaaaaaaaaaaaaaaagagacgctcggggacccatttcgccctaatgggg

SEQ ID NO: 61353 - protein, 182 aa, Zea mays
  misc_feature: Ceres CLONE 1523187
  misc_feature (58)..(58): Xaa is any aa, unknown, or other
  misc_feature (67)..(67): Xaa is any aa, unknown, or other
MASLAFGSTVAAAVAATSGRTRPARRSVLVVPPAASRGGPAPAKEEKGLGETIFGFIXQKDQLVETXPLLNNVGAAPGAASRAKTTRGKKAAGGDNSGSGGGSTLGGPRRPLPQEKQLNVALFMNCPTQAGIWFLRGKWLPIYICGRVGVGPGDFDGQKGKPPLPKKKKKKRRSGTHFALMG

SEQ ID NO: 61354 - DNA, 382 bp, Zea mays
  misc_feature: Ceres CLONE 1523190
  misc_feature (145)..(145): n is a, c, t, g, unknown, or other
  misc_feature (227)..(227): n is a, c, t, g, unknown, or other
  misc_feature (245)..(245): n is a, c, t, g, unknown, or other
cccgggggggccgctctagaactagtggatcccccgggctgcaggaattcgtctcacccctagaaaaagtgcccgcggtgctagtgacggttgctctagatccgttcatcctggtggttttgtgaggtcaagcgcgagcgaatanaaatgctggacagctgtgggacgacgtggtggccgggcctcgcccggagacgggcctcgagaagctccggaagggccaacancggcccggccggtttgtnattaaaaaagaacgccggacggggggcagtttaacaagcgggggggaattttaaaaccccgttaaccccccaaaaaaacccccggttgaaccccccttttttttttttcaaaaaaaacccccccgggggggggcccc

SEQ ID NO: 61355 - DNA, 888 bp, Zea mays
  misc_feature: Ceres CLONE 1523192
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (376)..(376): n is a, c, t, g, unknown, or other
  misc_feature (399)..(399): n is a, c, t, g, unknown, or other
gagggggggtaccaaaaggccggccccaaanannggnnnnnnnnaaaaactggaactccccgcggtggcgggcgctctagaactagtggatcccccgggctgcaggaattcgtctcacccctagaaaaattcccaatctcgtcttgtgttgttcggagcgggcagcagcacacagccccgtcccaatcctagtcgatcttcttcccctcctcgaggagaaaaagaagctgacccgtggggcagaaaaactcaggttggctaggccccctcctaaaaacccaaggacaagagctggacggggtcttttcctagcctattctgggcccgaggggagacggttggaggcgccaatggggcgtgggagaactctggttgnaaaaaacacctaaaaaaaaactnaacaagaaaaatcttcaggagcgggctgtttgttgtcccggggtggaggcgggtatcataggagagtaggggaaaaccccccccggtgcaggaggggccgtcttcacggcgagggtgccagggaggcacggcctataccctgacccctttgccgcaataatacaatgagagcctgtcaccccgtgaatcccagaaggtggctagggtggtgcgtgcaattggctcgaaattgccgtaaattcccccctaaggacttcccctggtgttcttgggtaggggcggaatggtaggttgacccgactgtccgccggtgagaggaggggtggtgtccaggtggctctcgatctaaatattgccacgaaggtttgtgttccgtgaggccccgttctctcgggcgccctcctaagagttgcgggtctctggggtggaacgcgcccttaaatctaatgcctgtggagggtgggcccggtgtgggcgtgtgcctggggg

SEQ ID NO: 61356 - DNA, 697 bp, Zea mays
  misc_feature: Ceres CLONE 1523195
  misc_feature: Encodes the peptide sequence at SEQ ID NO. 61357
  misc_feature (407)..(407): n is a, c, t, g, unknown, or other
ggagctccccgcggtggcggccgctctagaactagtggatcccccgggctgcaggaattcgtctcacccctagaaaaagagcttatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctaccatcaagactggtaagcatggccatgccaaatgccactttgttgccatagacatattcaacgggaaaaaagcttgagatattgttccttcatcacancactgtgatattccgcatgtgaaccgtactgagtaccagctgattgatatatcagaggatggatttgtgagccttctttactcagatggcacactaaggatgatcttagactcccaactgatgagactcttgtggccagatcaagggagggtttgaaagcgcaaagatcttgttgggactgcccaatctgctatgggggaggaacaatctgccccctaaggatgttggcccaagtaactacctggcttggaatctgtatcccaaacctaaatcgaaaaagaatggttcct

SEQ ID NO: 61357 - protein, 72 aa, Zea mays
  misc_feature: Ceres CLONE 1523195
MSDSEEHHFESKADAGASKTYPQQAGTVRKNGFIVIKNRPCKVVEVSTIKTGKHGHAKCHFVAIDIFNGKKA

SEQ ID NO: 61358 - DNA, 684 bp, Zea mays
  misc_feature: Ceres CLONE 1523198
  misc_feature: Encodes the peptide sequence at SEQ ID NO. 61359
aagctggagctccccgcggtggcggccgctctagaactagtggatcccccgggctgcaggaattcgtctcacccctagaaaaagctattcgtgtcctggcatccgcagagagtttgttccgtccaggcaaccaaaaagcgttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccggttccagagccacgccgtgctggcgctccaggaggccgccgaggcctacctcgtcggcctcttcgaggacaccaacctctgcgccatccacgccaagcgcgtcaccatcatgcccaaggacatccagctcgcccgccgcatccgtggcgagcgcgcgtagccatcatctccgatgatctgatgaatgtctagttaccagacaaataggccgcattagcgtcgttgctctgtattcggaatattggattcggttgc

SEQ ID NO: 61359 - protein, 136 aa, Zea mays; identical to SEQ ID NO: 35188
  misc_feature: Ceres CLONE 1523198
  misc_feature (58)..(132): Pfam Name: Histone Pfam Description: Core histone H2A/H2B/H3/H4

SEQ ID NO: 61360 - DNA, 789 bp, Zea mays
  misc_feature: Ceres CLONE 1523199
  misc_feature: Encodes the peptide sequence at SEQ ID NO. 61361
  misc_feature (434)..(434): n is a, c, t, g, unknown, or other
aaattgcatgggctccccgcggtggcggccgctctagaactagtggatcccccgggctgcaggaattcgtctcacccctagaaaaagttcatccactctcagcatcaccagctaagaacaggtcttcgtctcaataatggaaggcaaaacagggcagctcaggtgctgtttcgtcgccatcgtgctcgtcctgggtcttgtccttgagcagtcccagcaggctgaagctagaggcaaatggtgctgcgaaaccgccaccggaaaataccattttaatcgctgctttgactcgggttgggtcgacaatattgggttctgtgcgagaaatgccggttgcatccattatggaggacaaatgttcacccccccgcgccggggggggggcgggaccccctttcctctgaatcccccccccctttttaaaaaaaaaaacnatgaatttatataactcagggcccggacgacgggtcgtcccacgcaatgggttattcgagaaattggcccgttccccctccttatttcgacctttcccataagcccccgttcgtgggaaccgtagccatcccctgtcaaagtttagcccaagaggcacaagaaccacatctcattcccccgaatagagaccggggtccttcacgtgttgaccaaaataagtaacccccccgtcggctctgtggaaacctccctcgccttagttctccttgtgtaggaccgcccaacgctccagtcataatcatcgtctcgaccgttgtcttgtggaaaaatactcgcccgtgacgcccacccttc

SEQ ID NO: 61361 - protein, 103 aa, Zea mays
  misc_feature: Ceres CLONE 1523199
  misc_feature (100)..(100): Xaa is any aa, unknown, or other
MEGKTGQLRCCFVAIVLVLGLVLEQSQQAEARGKWCCETATGKYHFNRCFDSGWVDNIGFCARNAGCIHYGGQMFTPPRRGGGGTPFPLNPPPLFKKKNXEFI

SEQ ID NO: 61362 - DNA, 742 bp, Zea mays
  misc_feature: Ceres CLONE 1523200
  misc_feature (260)..(260): n is a, c, t, g, unknown, or other
  misc_feature (742)..(742): n is a, c, t, g, unknown, or other
aaagctggagctcaccgcggtggcggccgctctagactagtggatcccccgggctgcaggaattcgtctcacccctagaaaaacgcgacagcctgagcagccatgccggggcggcgggcgatcgacgtccggctgctgccgggcggcggctactccgctgcggcggccaggtggcgcatgtcgctgctggagaacacgttcagcggcttcctgcagggcgcccgcgccgacgccccggctaggggcttgttcctcaatgnttccctgttttgcccgttctttcatccacgaggggctgcgaatccgccaacctgtttttcttggggaggggactgggtcctccctgcgtccctttttttttttccctccccggggggggggggggggggccccattttgattactctttctacccccccccgctgttcgcgaaacctccgcgcgcattttccttcgttcgcggcgtgtgggtgcccttctctttttggcgctcccctcctctgcccccttcaattcgcctccttttcctcttccgttgcctactgtttatgcgcttccctgcgtatgcctccgttgggtgagggtttacgcccgccccgccgccctttggcccgcggaccgccgactcttgacgttcctcctcacttgacccgttcctgtccctcctcccttccccgcataggtaatacacacttcctcacccccacttcggtgtccttcccctttgccacactccagtctn

SEQ ID NO: 61363 - DNA, 692 bp, Zea mays
  misc_feature: Ceres CLONE 1523204
  misc_feature: Encodes the peptide sequence at SEQ ID NO. 61364
  misc_feature (374)..(374): n is a, c, t, g, unknown, or other
  misc_feature (389)..(389): n is a, c, t, g, unknown, or other
gcggtggcggccgctctagaactagtggatcccccgggctgcaggaattcgtctcacccctagaaaaagtccccgtctcaccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggacatggacctgggcgtgccgcccgcgccggcgcccgacacgggcgcggcagcggggggcgcggcgtcggtcctgcccgtggattgctctgacgtcttcttcatactcgtcgacggtggtctcgtgcagtangggctgccatcaacntgctgcctagctgctgggtcgaggtcaggctgaaccctgttcgatcgctttcccccttaattattaataaaagtatcaggcccgggcccggggttgaatggggtcccgggctccccccggggggggggtggggaacctttggccttttggttaaatctctttttgggccaaaacggggatttgtgtcacaacaaaaaaccctttttgtttaaaggggggggggtttttaaaatttataaaaagggcgggggggggtttcccgggggcgcccctcaaaaaaaaaaaaaaaaaccccgggccgcc

SEQ ID NO: 61364 - protein, 82 aa, Zea mays
  misc_feature: Ceres CLONE 1523204
  misc_feature (67)..(67): Xaa is any aa, unknown, or other
MASRVAVLLVAVAAVLFAAASAQDMDLGVPPAPAPDTGAAAGGAASVLPVDCSDVFFILVDGGLVQXGLPSTCCLAAGSRSG

SEQ ID NO: 61365 - DNA, 694 bp, Zea mays
  misc_feature: Ceres CLONE 1523208
  misc_feature: Encodes the peptide sequence at SEQ ID NO. 61366
  misc_feature (499)..(499): n is a, c, t, g, unknown, or other
acccgcggtggcggccgctctagaactagtggatcccccgggctgcaggaattcgtctcacccctagaaaaaggagaggataagatggaagggctggtcccgttcgtgatcgacatgatcaggaggagccatgagcggagcggctaccgccccgtctcgtccgacagcggcagctcccgcggcgggcccgggggcagcagtgggcgccacctcaccgactactcggagctgcccgacgacgcagccgcggcgagcgccggcgccgacaggccgtccggtacgctgcaccgccgcgcgcggtccgggtacgtggagacgacggtcgggcgtcgcgcggactacgagcaagcaggccggcgcccgtggtcgtcgccgggtcggcttatcgacgcaaatgaggggcgcgacgtgcatgctgagctttgctgggaggattcatcgtcagcatcagcaagttgagcttgacatgctttgggttggccaggtgctgcttgataantagttagctagctagctattcgtctttaccatgcatgtatctaaacaagcttgcatttctgggcgtacaaggggctcagggcccgggcttgggtttccgtagacatgcaccccccattttttttgctgtccaaaaaaaaaaaaaaagaagagctggggccaccatcccccctaaaggaggccatatcccgccccc

SEQ ID NO: 61366 - protein, 124 aa, Zea mays
  misc_feature: Ceres CLONE 1523208
MEGLVPFVIDMIRRSHERSGYRPVSSDSGSSRGGPGGSSGRHLTDYSELPDDAAAASAGADRPSGTLHRRARSGYVETTVGRRADYEQAGRRPWSSPGRLIDANEGRDVHAELCWEDSSSASAS

SEQ ID NO: 61367 - DNA, 710 bp, Zea mays
  misc_feature: Ceres CLONE 1523209
  misc_feature: Encodes the peptide sequence at SEQ ID NO. 61368
  misc_feature (53)..(53): n is a, c, t, g, unknown, or other
  misc_feature (304)..(304): n is a, c, t, g, unknown, or other
  misc_feature (392)..(392): n is a, c, t, g, unknown, or other
  misc_feature (393)..(393): n is a, c, t, g, unknown, or other
  misc_feature (420)..(420): n is a, c, t, g, unknown, or other
acagctggagctccccgcggtggcggccgctctagactagtggatctcttggnctgcaggaattcgtctcacccctagggaggcctcagcactagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgacgaggggtggcgtgaancgcatctccgggctgatctacgaggagacccgcggcgggctcaagatctttttttataacgccctcccgggggggggggggcggaccnnatcactcccctctcccccccccccccnctataggaagaggggaacggccccaaacgccggggcggcctctccaatggcttcgcccgccacgtaacccgtggggaatagccttccacggggcccggaatctgtgcgcccgcgtgtggcgggcgcccgggggcccattcccccctaagaggccttagcccgggtcccccgatccgtggtggacctgcggcctcctcgggctcctcccacgcctcccctgcccgcacacggccccagacagggtcgagccagggccgttgttcctccccccttgcccactcccacccgcg

SEQ ID NO: 61368 - protein, 105 aa, Zea mays
  misc_feature: Ceres CLONE 1523209
  misc_feature (45)..(45): Xaa is any aa, unknown, or other
  misc_feature (75)..(75): Xaa is any aa, unknown, or other
  misc_feature (84)..(84): Xaa is any aa, unknown, or other
MSGRGKGGKGLGKGGAKRHRKVLRDNIQGITKPAIRRLATRGGVXRISGLIYEETRGGLKIFFYNALPGGGGRTXSLPSPPPPXYRKRGTAPNAGAASPMASPAT

SEQ ID NO: 61369 - DNA, 793 bp, Zea mays
  misc_feature: Ceres CLONE 1523211
  misc_feature (324)..(324): n is a, c, t, g, unknown, or other
  misc_feature (735)..(735): n is a, c, t, g, unknown, or other
  misc_feature (757)..(757): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (770)..(770): n is a, c, t, g, unknown, or other
  misc_feature (771)..(771): n is a, c, t, g, unknown, or other
tggcggccgctctagaactagtggatcccccgggctgcaggaattcgtctcacccctagaaaaaagttccaactccaacctacgcagcagaggggagccacctccccgtcgctctcacgctctttgtgggcgccgcctcccctccgtctctccctctcccctcccggttgaagcacatggggctcccatcggccggatattcccgcccctctctcttcgccaggcccggcgaggggaataaaaaccaaattctccaggcttttccacccgtttgagaaagggaagaaaatttctccccccggcagccaatggcttataaaaaanggatcccccgccccccccccacaaaaggtattatttcccccccccccctgggggtgggggggggggggggaaagtatttttttttttttctcttctcctacccccccactgggtgggcccccaaaaaccattatgtagaccgtatagtagtgcggcgaaaatctccgggtcacttcgcgcgggaaccagatccataagtgcaccccaacccaccccttctacagattagctaggagcgggcagcactcacccccgcaacaaccctggcagtgggacggcgtaaaaagtaaaaaatagccatggtgcctactagagggaggctgtcgccacgtgtcccctccacgaaggaccggcgttgagaccccgccatcccacgcgcttggaggtgtggtgtgaggcccggattgtttntccttgtcgagtggtggtaatnttggtcgnnnttnntttgtcgaggagatcagacgac

SEQ ID NO: 61370 - DNA, 623 bp, Zea mays
  misc_feature: Ceres CLONE 1523213
  misc_feature: Encodes the peptide sequence at SEQ ID NO. 61371
  misc_feature (383)..(383): n is a, c, t, g, unknown, or other
  misc_feature (441)..(441): n is a, c, t, g, unknown, or other
ctccccgcggtggcggccgctctagaactagtggatcccccgggctgcaggaattcgtctcacccctagaaaaaacctgctgcagcttctcaaccggataggtagcaccggagcaggtagaacgctgcacaatccccttcgccgccgccaagatggtgaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgncagcactactcacagcacgcccatcagaggatgcagcattttgagattggtggagacnagaagggcaagggcacatctttttttctaaagcttctcgtccacctgtgctgggttgttgaatttgaacctgtggggtctactactacggttaaaaaaaacttgtcgcaaatttcattgttaatggaccatggaaagccaaccctggctttgtatcccaattccccagggccgggaattttg

SEQ ID NO: 61371 - protein, 157 aa, Zea mays
  misc_feature: Ceres CLONE 1523213
  misc_feature (19)..(95): Pfam Name: Ribosomal_L44 Pfam Description: Ribosomal protein L44
  misc_feature (77)..(77): Xaa is any aa, unknown, or other
  misc_feature (97)..(97): Xaa is any aa, unknown, or other
MVNVPKTKKTYCKNKECKKHTLHKVTQYKKGKDSLSAQGKRRYDRKQSGYGGQTKPVFHKKAKTTKKIVLKLQCQSXQHYSQHAHQRMQHFEIGGDXKGKGTSFFLKLLVHLCWVVEFEPVGSTTTVKKNLSQISLLMDHGKPTLALYPNSPGPGIL

SEQ ID NO: 61372 - DNA, 682 bp, Zea mays
  misc_feature: Ceres CLONE 1523216
  misc_feature (142)..(142): n is a, c, t, g, unknown, or other
  misc_feature (334)..(334): n is a, c, t, g, unknown, or other
  misc_feature (390)..(390): n is a, c, t, g, unknown, or other
  misc_feature (391)..(391): n is a, c, t, g, unknown, or other
  misc_feature (472)..(472): n is a, c, t, g, unknown, or other
  misc_feature (473)..(473): n is a, c, t, g, unknown, or other
  misc_feature (509)..(509): n is a, c, t, g, unknown, or other
  misc_feature (536)..(536): n is a, c, t, g, unknown, or other
  misc_feature (537)..(537): n is a, c, t, g, unknown, or other
  misc_feature (599)..(599): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (678)..(678): n is a, c, t, g, unknown, or other
cccgtggcggccgctctagaactagtggatcccccgggctgcaggaattcgtctcacccctagaaaaagtcgaagggcccgaccgcaacaaatcacaccgaatcaccctctcgcccaccaggccaccaccacaccacaccanaccacaccaccgggggggggggggcgacccattctaaaaacacaaagggcatggcccacgcccttaaaccccgggtttcccccccctcccccccggggccaaagggtccaaaccatctttttcttgatttctttccccccggggggaaaaaaaaaagggagggccctggccttttttaaccaaaaaataaancccgtgcacccaattttttttttcccccccccccgggggggggggggggggttatnntccccttttcctcccccccaacccatttttttttttatttctcccccacctcctcagagggctcggggtgttcccctagannacaccaagtctcccgctctctactccctagacagtnccccctcctcccccttgtttattacannacatttgtttccctaagccacctcattcctctaccccacaaaacacctccccatgtctcttntctttccctcttttcccctcatagtaacccactacgtcttcctctcctttctcccctnnntttttcacttttcctcgancctc

SEQ ID NO: 61373 - DNA, 716 bp, Zea mays
  misc_feature: Ceres CLONE 1523219
  misc_feature: Encodes the peptide sequence at SEQ ID NO. 61374
ggagctccccgcggtggcggccgctctagactagtggatcccccgggctgcaggaattcgtctcacccctagaaaaactagaaaaaatcttccaccgcgcttcgcccactcgctccagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtcccctataataccgccctgatgggggcgggggaggaaacttatgtgaaaaccaagtggcccaaacacctcatggggccaagaaacatgattgtccagaaaaaggggagccatcgctcagaggactttgaataggtgccaaaatacatggctgggtaagcattaaaagcgggggggtgtctttctcgcaaaaaactccccaagctgtaaaaaagttgtcccggtagtaaacgagtttattatgcggtgcatagtcagctaaccacctgttcggctacggtcctgacgcgacccacctcccccttagttcaggcaccaccccccctacaaccccctcgctgttccccagagaacggcgcaaagacatccgtgc

SEQ ID NO: 61374 - protein, 108 aa, Zea mays
  misc_feature: Ceres CLONE 1523219
MPFKRFVEIGRVALVNYGEDYGRLVVIVDVVDQNRALVDAPDMVRCQVNFKRLSLTDIKIDIKRVPYNTALMGAGEETYVKTKWPKHLMGPRNMIVQKKGSHRSEDFE

SEQ ID NO: 61375 - DNA, 683 bp, Zea mays
  misc_feature: Ceres CLONE 1523222
  misc_feature: Encodes the peptide sequence at SEQ ID NO. 61376
  misc_feature (443)..(443): n is a, c, t, g, unknown, or other
aaagctggagctccccgcggtggcggccgctctagaactagtggatcccccgggctgcaggaattcgtctcacccctagaaaaaagtcagagtcctcgcaccgcacgcaacaagtacgcaggcagcgcagcctcgagccgtcgccatggcgagcaagcacctcgtcctcgccgcatgcctcctcctcctgcccaccgcctcggtcgccaccgacgtcgactactgcagtaagaaggactacccggtgaaggtgagcggggtgcagatcgtgcccgatccggtcgaacccggcaagcccgccactttcaagatctccgcttctactgataaaaccatcgagaaggggaagctggttatcgacgtcaagtatttcttcttctacgtgcactcggagacccgcgacatctgcggagagacttcctgcccagcgaccggcgacttcntgctgtcccaccagcagacgctgccagggcttccctccgccgggctcttacacaatctacatgaaaattgtcggggacaacaaccaaaagctaagctgcctctcgttcgggttcagcatcggtttcgtcgcgttcagttaaacccttccaacctttggcccagaaggccccccccccttggatttaaatatccgggagccccctctgttcccctagaatttcaagtatttgggcccggag

SEQ ID NO: 61376 - protein, 179 aa, Zea mays
  misc_feature: Ceres CLONE 1523222
  misc_feature (20)..(141): Pfam Name: E1_DerP2_DerF2 Pfam Description: ML domain
  misc_feature (100)..(100): Xaa is any aa, unknown, or other
MASKHLVLAACLLLLPTASVATDVDYCSKKDYPVKVSGVQIVPDPVEPGKPATFKISASTDKTIEKGKLVIDVKYFFFYVHSETRDICGETSCPATGDFXLSHQQTLPGLPSAGLLHNLHENCRGQQPKAKLPLVRVQHRFRRVQLNPSNLWPRRPPPLGFKYPGAPSVPLEFQVFGPG

SEQ ID NO: 61377 - DNA, 670 bp, Zea mays
  misc_feature: Ceres CLONE 1523224
  misc_feature: Encodes the peptide sequence at SEQ ID NO. 61378
  misc_feature (636)..(636): n is a, c, t, g, unknown, or other
  misc_feature (670)..(670): n is a, c, t, g, unknown, or other
ctccccgcggtggcggccgctctagaactagtggatcccccgggctgcaggaattcgtctcacccctagaaaaacctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcaaggggctgcaggaattcaagcctgttgaagagggtgctagcgcctaaggatgtctccttctccatgtgcgagcctgaagctcaaagcaaagttgcagaataaggagccatgctcccttgtgtaatttcataagactacaaccctattagggcttgtttgggttgtgtctgtatcgaagggattggaaggtgataanttttctttctattcaaatagaggggtttttatcn

SEQ ID NO: 61378 - protein, 103 aa, Zea mays
  misc_feature: Ceres CLONE 1523224
  misc_feature (10)..(98): Pfam Name: Cystatin Pfam Description: Cystatin domain
MANNTGTLVGGIQDVPGSENDLHLQELARFAVDEHNKKANALLGFEKLVKAKTQVVAGTMYYLTIEVKDGEVKKLYEAKVWEKPWENLKGLQEFKPVEEGASA

SEQ ID NO: 61379 - DNA, 674 bp, Zea mays
  misc_feature: Ceres CLONE 1523225
  misc_feature: Encodes the peptide sequence at SEQ ID NO. 61380
  misc_feature (441)..(441): n is a, c, t, g, unknown, or other
  misc_feature (521)..(521): n is a, c, t, g, unknown, or other
  misc_feature (528)..(528): n is a, c, t, g, unknown, or other
ggagctccccgcggtggcggccgctctagaactagtggatcccccgggctgcaggaattcgtctcacccctagaaaaagaagttctcctcccctaccctcaacctctagccaaagtagttgcgtgtgcgttgtagttcctgtgtccacgacagttttagctcccctcctcagccactagatcgatctgcccttattcatcacagccaactcatgtgtctggtgaccacaacagcaatccttcaacctcaccatggccagggttcgtggagattgtctcggccgtgttgtgcccgttccttgttcctcaccgaattcccagaagaagatgataaaattcaagaagtggtttctgaagaggagtctgcttcagtgcctgctcatcaagtgatgggagccatctaactggggtttaatagagggatttagacctccgtctctgncacaaaggtggtgaggagtactctaggtgttcttgaagctggaggggcgttccagttctgggagaagactagctaagttnatgtacnagctttggaggatttctacctccctgcttttgaataaagtatgcacttggagatatcaggacttgtataaatggaactctcctatgtaataaactggagtttgaaaaggtaaagaaggtttgaaaaaaaaaaaaaaacgagagctc

SEQ ID NO: 61380 - protein, 63 aa, Zea mays
  misc_feature: Ceres CLONE 1523225
MCLVTTTAILQPHHGQGSWRLSRPCCARSLFLTEFPEEDDKIQEVVSEEESASVPAHQVMGAI

SEQ ID NO: 61381 - DNA, 683 bp, Zea mays
  misc_feature: Ceres CLONE 1523227
  misc_feature: Encodes the peptide sequence at SEQ ID NO. 61382
  misc_feature (404)..(404): n is a, c, t, g, unknown, or other
  misc_feature (570)..(570): n is a, c, t, g, unknown, or other
aagctggagctccccgcggtggcggccgctctagaactagtggatcccccgggctgcaggaattcgtctcacccctagaaaaaaacccttcgctgcgccgccgcctccgacatcgtctcttcgtccccacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgacacagccgtgaaggtggttgatattgttgacacattccgtctacaggagcaacctccttttgancagaaatcatttgtctcttacataaaaaaatacatcaagaatctcactgctgtgttggagccagagaaagcggatgagttcaaaaagggtgtcgagggtgcaaccaagttttctcttagcaagctgaaggacctttcatttttttgttgtgagagcatgaaagacnaaaccgtccgtgggtatcgccctatacaaggatggtgccactatccgactttctctatttccctcagggcttaagggaatcaggtgctaaattagttacccctgttgggtaca

SEQ ID NO: 61382 - protein, 161 aa, Zea mays
  misc_feature: Ceres CLONE 1523227
  misc_feature (1)..(156): Pfam Name: TCTP Pfam Description: Translationally controlled tumour protein
  misc_feature (82)..(82): Xaa is any aa, unknown, or other
  misc_feature (138)..(138): Xaa is any aa, unknown, or other
MLVYQDLLSGDELLSDSFTYKELENGVLWEVEGKWVTQGPVDVDIGANPSAEGGEDESVDDTAVKVVDIVDTFRLQEQPPFXQKSFVSYIKKYIKNLTAVLEPEKADEFKKGVEGATKFSLSKLKDLSFFCCESMKDXTVRGYRPIQGWCHYPTFSISLRA

SEQ ID NO: 61383 - DNA, 675 bp, Zea mays
  misc_feature: Ceres CLONE 1523229
  misc_feature: Encodes the peptide sequence at SEQ ID NO. 61384
ctggagctccccgcggtggcggccgctctagaactagtggatcccccgggctgcaggaattcgtctcacccctagaaaaaagccgccgccggcctccaactctaaccccgttgcttccggctcccggagcgtcgccgaccttcacagccggttccttcctccgccaccatggggaagacacgtggtatgggagctgggcgcaagctcaagacccaccgcaggaaccagaggtgggctgacaaagcatacaagaagagccacttgggcaatgagtggaaaaaaccttttgctggatcatctcacgccaagggcatcgttctggagaagattggtattgaggccaagcagccaagttcggccatccgtaagtgtgcccgtgttcagctggcgaataaatgaaagaaaattgctgcctttgtgccgaatgatgcgttgcctaactacatccaggagaatgatgaggtgttgattgctggatttggtcgaaagggtcatgctgagggagacatccctggtgtcaggttcaaggttggtagggggtctggggggtccctgcttgccctcttcaggaaaaaaaaggtaaccccaaggccttagatccctttcgggagtcaagactgggggaaactgccaagggctctattggtcaaagtaaagttcctgctaacaactcac

SEQ ID NO: 61384 - protein, 76 aa, Zea mays
  misc_feature: Ceres CLONE 1523229
  misc_feature (8)..(76): Pfam Name: Ribosomal_S12 Pfam Description: Ribosomal protein S12
MGKTRGMGAGRKLKTHRRNQRWADKAYKKSHLGNEWKKPFAGSSHAKGIVLEKIGIEAKQPSSAIRKCARVQLANK

SEQ ID NO: 61385 - DNA, 683 bp, Zea mays
  misc_feature: Ceres CLONE 1523233
  misc_feature: Encodes the peptide sequence at SEQ ID NO. 61386
  misc_feature (665)..(665): n is a, c, t, g, unknown, or other
ctggagctccccgcggtggcggccgctctagaactagtggatcccccgggctgcaggaattcgtctcacccctagaaaaaacccagcaacaagcaacctcgtccccaaacaagcaaccaccgcctccccgatctcgtcgagaggaagcccaatcccgaaaccgccgccctattccaatggcgcccaaggccgagaagaagcccgccgccaagaagcctgcggaggaggagccggcggcggagaaggccacggcggggaagaagcccaaggctgagaagcggctccccgcgggcaagtccgcaggcaaggagggtggcgagaagaaggggaagaagaaggcaaagaagtcggtggagacgtacaagatctacatcttcaaggtgctgaagcaggtgcacccggacattggcatctcgtccaaggccatgtccatcatgaactccttcatcaacgacatcttcgagaagctggcggcggaggcggccaagctggcgcggtacaacaagaagcctaccattacgtcccgcgacatccagacctccgttcgcctcgtcctccccggcgagctcgccaagcacgccgtctccgagggcaccaaagccgtcaccaagttcaccagctcctaggcgagcgatgcgacgtgcactcgtctcctcttcttgcangagtacaatagtagtacg

SEQ ID NO: 61386 - protein, 149 aa, Zea mays
  misc_feature: Ceres CLONE 1523233
  misc_feature (56)..(126): Pfam Name: Histone Pfam Description: Core histone H2A/H2B/H3/H4
MAPKAEKKPAAKKPAEEEPAAEKATAGKKPKAEKRLPAGKSAGKEGGEKKGKKKAKKSVETYKIYIFKVLKQVHPDIGISSKAMSIMNSFINDIFEKLAAEAAKLARYNKKPTITSRDIQTSVRLVLPGELAKHAVSEGTKAVTKFTSS

SEQ ID NO: 61387 - DNA, 741 bp, Zea mays
  misc_feature: Ceres CLONE 1523235
  misc_feature: Encodes the peptide sequence at SEQ ID NO. 61388
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (80)..(80): n is a, c, t, g, unknown, or other
  misc_feature (200)..(200): n is a, c, t, g, unknown, or other
  misc_feature (201)..(201): n is a, c, t, g, unknown, or other
  misc_feature (203)..(203): n is a, c, t, g, unknown, or other
  misc_feature (217)..(217): n is a, c, t, g, unknown, or other
  misc_feature (219)..(219): n is a, c, t, g, unknown, or other
  misc_feature (326)..(326): n is a, c, t, g, unknown, or other
  misc_feature (476)..(476): n is a, c, t, g, unknown, or other
nnaatttnnnnntatatgctggagctcaccgcggtggcggccgctctaaactagtggatcccccgggctgcaggaattcntctcacccctagaaaaaagaggaaacccatttacgtatatgcccttgtcccggttcctttccccatccccaactccattatttgcttgatccttgagaagagagaggaagacgagagctnnangcgaaggaaaaaancntttcttcagctaggcaggaggccacaagaaggaggaaatgccctcaaacagcattcccaaggacctccaggatctgcacaattacccacccaagagggggaacgccnatcatcttgctcaaaacattttccaatggcaagcaacaaaaagggtttttttttttccccccccggggaaaagaatggggttctttacactcctcctcccccccgtggctctggagaagaaaatcaaatggtaatggtttaggaggtggnatggttctaaagggaaaattggtggttttcgggcgccgtggcttccccggaattccttatcggaaggtgtagtttagaaaaagggttaagcgcaggggtccaggaatttttcctgcaagcgcgttccggggttttggggctaaaccttggtcctgccttgttttcagggatctatagggcgcctgataccctccagtttatcttttgtcgtaggaaaggcgacactatgtacaggcggggcgtctcgcccctcatatacgacgag

SEQ ID NO: 61388 - protein, 67 aa, Zea mays
  misc_feature: Ceres CLONE 1523235
  misc_feature: SWISSPROT Homolog: EC 6.3.2.19 Ubiquitin--protein ligase
  misc_feature (24)..(24): Xaa is any aa, unknown, or other
MPSNSIPKDLQDLHNYPPKRGNAXHLAQNIFQWQATKRVFFFPPPGKRMGFFTLLLPPVALEKKIKW

SEQ ID NO: 61389 - DNA, 635 bp, Zea mays
  misc_feature: Ceres CLONE 1523239
  misc_feature: Encodes the peptide sequence at SEQ ID NO. 61390
  misc_feature (450)..(450): n is a, c, t, g, unknown, or other
ctccccgcggtggcggccgctctagaactagtggatcccccgggctgcaggaattcgtctcacccctagaaaaaagcccagatagatctttcccccgtcctccctcgccttcgcctcgccggcaggagatttccaccaccaccgccggaccaccccgaccctccttccctctcgcgctatggcccagactgttgtgctcaaggttggcatgtcctgtgagggctgtgttggagctgtcaagcgggtcctgggcaagatggaaggcgtctagtcctacgacgtatacatcatggaacagaatgtcaccgtgaagggcaatgtgacacctgacgccgtcctgcacactgtttccaagactggctagaacacttcgttctgcgaggctgaggcccgtgacagtgcatccgccacacctgccggcgcccacgcctgaacagttcgatgatctgnaaatgcccaccaaaaaaatgtgaaagttttttacctggatcctgtccaaaatattggaaaattggaaagctccggcctgacatttttaccgttccccctttgaaacccgggaagttccccaggggtttggggggcgccaaaaaccccattttttttaaaaaaaatgggggccggggccccaaaag

SEQ ID NO: 61390 - protein, 30 aa, Zea mays
  misc_feature: Ceres CLONE 1523239
MAQTVVLKVGMSCEGCVGAVKRVLGKMEGV

SEQ ID NO: 61391 - DNA, 684 bp, Zea mays
  misc_feature: Ceres CLONE 1523240
  misc_feature: Encodes the peptide sequence at SEQ ID NO. 61392
  misc_feature (453)..(453): n is a, c, t, g, unknown, or other
ggagctccccgcggtggcggccgctctagaactagtggatcccccgggctgcaggaattcgtctcacccctagaaaaaagtgaagaggtggacccagataatgtgaggctgcttgaggaagaagcagctgatgccttgggacaagctgaaaaggaagctgaagctacaaaaatggcaataaagaggaaaattgaacaagcagcaacatctgattttcaggcgcgtagcttgccggccaaacttcgtatcgaaccaagtgaccctgaggatgttaaagctgcaaagcgtaagaaaatacatgctttcaaatcaaaatcccgctttgagcagcttgaattggcccaaacaaaaggcagaatgaatggtagcactttcaacccaaggaaagccaaaaaggggggttcttctccggtcgcaagagagagagcatcttcaagtccccggacagccccngaggcaaggggggtgtccctgggagttggtaaggcctgaccgaccttccccagggggggagagccccttcccccttaaaggagggccccgggggattccccccccactatgtggggggaaggaaaacttgcaaaaccccaccccccctgtttgggatcccccgcccaaaaaaacatttttccccaaaaccggtgtctctgctaacccgcccaaccataggtccccctcaca

SEQ ID NO: 61392 - protein, 163 aa, Zea mays
  misc_feature: Ceres CLONE 1523240
GAPRGGGRSRTSGSPGLQEFVSPLEKSEEVDPDNVRLLEEEAADALGQAEKEAEATKMAIKRKIEQAATSDFQARSLPAKLRIEPSDPEDVKAAKRKKIHAFKSKSRFEQLELAQTKGRMNGSTFNPRKAKKGGSSPVARERASSSPRTAPEARGVSLGVGKA

SEQ ID NO: 61393 - DNA, 705 bp, Zea mays
  misc_feature: Ceres CLONE 1523242
  misc_feature: Encodes the peptide sequence at SEQ ID NO. 61394
  misc_feature (169)..(169): n is a, c, t, g, unknown, or other
  misc_feature (172)..(172): n is a, c, t, g, unknown, or other
  misc_feature (204)..(204): n is a, c, t, g, unknown, or other
  misc_feature (288)..(288): n is a, c, t, g, unknown, or other
  misc_feature (289)..(289): n is a, c, t, g, unknown, or other
  misc_feature (291)..(291): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (324)..(324): n is a, c, t, g, unknown, or other
  misc_feature (370)..(370): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (390)..(390): n is a, c, t, g, unknown, or other
  misc_feature (396)..(396): n is a, c, t, g, unknown, or other
  misc_feature (397)..(397): n is a, c, t, g, unknown, or other
  misc_feature (551)..(551): n is a, c, t, g, unknown, or other
  misc_feature (619)..(619): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (663)..(663): n is a, c, t, g, unknown, or other
  misc_feature (686)..(686): n is a, c, t, g, unknown, or other
ccgcggtggcggccgctctagaactagtggatttcttgggctgcaggaattcgtctcactcctagaaaaaacacacaccacaccacggcaccgatagtgagaagcagagcgggaggacacgcggcgcggactgcgatggctcgtgcgctcggcgcttgcgtgctgctcnccntcctgctcggtgccctggcggcggcggccgcncgcgcccacaacgaccagggcatcggggccggcatacggcagccgagcgcctagtaccgcggtaggaccgtgggggccaggacnnantttccnnnacttttagggccacgccaaggtgcnagaccttcgctggtttctctccccccaccgggggaaagaagggggnaannnnnnnnnnnnnctccnatttcnncaagggtgggggcgggcgcaccggcggggggtggtcggggctcagtaacttcctcccccgtcgggcccggggaggaagggccccttccccctggtacctgtcgccaaccccggttttccaccccttgctccctcttcgaggcccgtggggttcnttttggggacgccgggtcgcggtttgcggcgggggccgcccgagtagcgggggtctccgcccgcccgntaaaacacgcttnnntcggagtgcctttggttcgaccccccccnggagggggtgggccgtgtgtatnggcggtctaatgggggttg

SEQ ID NO: 61394 - protein, 40 aa, Zea mays
  misc_feature: Ceres CLONE 1523242
  misc_feature (12)..(12): Xaa is any aa, unknown, or other
  misc_feature (13)..(13): Xaa is any aa, unknown, or other
MARALGACVLLXXLLGALAAAAARAHNDQGIGAGIRQPSA

SEQ ID NO: 61395 - DNA, 674 bp, Zea mays
  misc_feature: Ceres CLONE 1523243
  misc_feature: Encodes the peptide sequence at SEQ ID NO. 61396
tccccgcggtggcggccgctctagaactagtggatcccccgggctgcaggaattcgtctcacccctagaaaaaatcttgcaatcacaacgaacaaaagctctcgatctcaccgacacaggggaagaagagatcaatggcgtccgagcagggagtcgtgatcgcgtgccacagcaaggctgagtttgacgaccacatgaccaaggcccacgaagccggcaagctggtggtcatcgacttcactgccgcctggtgcggtccatgccgcgccatcgccccactgttcgtcgaacacgccaagaagttcactcaggccgtcttcctgaaggtggacttggacgaagtgaaggaagtcaccgccccctactacgtcgaagcgatgccgaccttccccccccccaagaaggggaagacggtcgtcaaccttcgtgggtgcaaggaaggacgagctcctggccctgaacaaaaataaggccgcgcctgcgcctgcaactgcatccgcctaaatgaaatcaaattcgtcttcgcccctcaattaagggcccccacgtaatggctgttaatgttcgccctaaacaaatcctggctttgttcgtttggtgggcgaatttgccgaaccaacaactatgtttggcttccaccctagccgggaagccaatacttaagccgtggagaa

SEQ ID NO: 61396 - protein, 111 aa, Zea mays
  misc_feature: Ceres CLONE 1523243
  misc_feature (8)..(102): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDDHMTKAHEAGKLVVIDFTAAWCGPCRAIAPLFVEHAKKFTQAVFLKVDLDEVKEVTAPYYVEAMPTFPPPKKGKTVVNLRGCKEGRAPGPEQK

SEQ ID NO: 61397 - DNA, 629 bp, Zea mays
  misc_feature: Ceres CLONE 1523244
  misc_feature (216)..(216): n is a, c, t, g, unknown, or other
  misc_feature (410)..(410): n is a, c, t, g, unknown, or other
aagctggagctccccgcggtggcggccgctctagaatagtggatcccccgggctgcaggaattcgtctcacccctagaaaaattgtagggtttgttgcatcgcttcttcctggttttcagcacaatgactaggcctcatcttgtcactgtggaataagctatgtgcagtgatttggttatggtgacataggggaagtaattatatgaagctgctcnagctttctgtttatattgtttcaagttcaagacttattgaacaatcctatcatacttccagcaatacttgcagctcacatgtaaagagtagcctggcaccccatcaaatgagctatgatttgagtttctgaaatatgggatgcctacacctgaatacagaatcagcccctggtgtaagatgtctgaaacatganggatgtggacgttttttcggggctgaaaccttgaataatgtgagtcccgttcagaaaggatgctccctttttacctaagaagccttcccagaccaaaaataaggtcgaaagggaatcccccatttttttttttttccgggggaatttggcggaatttctcatttacccccgttaaaaacccccaaataaaggggggaaaaaaactttccccccaaaaaa

SEQ ID NO: 61398 - DNA, 716 bp, Zea mays
  misc_feature: Ceres CLONE 1523246
  misc_feature: Encodes the peptide sequence at SEQ ID NO. 61399
  misc_feature (394)..(394): n is a, c, t, g, unknown, or other
  misc_feature (395)..(395): n is a, c, t, g, unknown, or other
  misc_feature (466)..(466): n is a, c, t, g, unknown, or other
  misc_feature (578)..(578): n is a, c, t, g, unknown, or other
  misc_feature (621)..(621): n is a, c, t, g, unknown, or other
  misc_feature (671)..(671): n is a, c, t, g, unknown, or other
  misc_feature (672)..(672): n is a, c, t, g, unknown, or other
ggagctccccgcggtggcggccgctctagaactagtggatcccccgggctgcaggaattcgtctcacccctagaaaaaaaccgagcagtagcgactcctctgcgtgaggcctgccgtcatcccccgtgggccgtggccgtggccgtgcgcaaaaaaacaaaccatcctcgattcgaccggaggggaaggagacgcgccgggagaagggggaagagacgcggcgaccatgtctccgatctgggtgttcgggtacggctcgctgatctggaacccaggcttcgcctacgacgaccgcgtcgtcggctttgtcagggactaccgccgcgtcttctaccaagggagcacggaccacaggggcacgccgcagttccgcgggaggaccgtcacgctcgannaccaacccccaccgacttgctggggagttgcttacagaataacggaggaagataaggagatagctttggantttcttgggggcagggagaagccatgtgatgaggaaggttaccttcgcttggaatactggatccttcccccccaggccccacctttcgaaaaatgttgaggttaacattcgncaaccagagaacacgggggaaacgatcaaaattaatcttcggncccggcccccgtttggagggaatgggcccgaagagatgtttccttgtgcnnaaaggtgccgatcgggagcctaaaggacaaaatttcgggtgttg

SEQ ID NO: 61399 - protein, 112 aa, Zea mays
  misc_feature: Ceres CLONE 1523246
  misc_feature (4)..(113): Pfam Name: ChaC Pfam Description: ChaC-like protein
  misc_feature (56)..(56): Xaa is any aa, unknown, or other
  misc_feature (57)..(57): Xaa is any aa, unknown, or other
  misc_feature (80)..(80): Xaa is any aa, unknown, or other
MSPIWVFGYGSLIWNPGFAYDDRVVGFVRDYRRVFYQGSTDHRGTPQFRGRTVTLXXQPPPTCWGVAYRITEEDKEIALXFLGGREKPCDEEGYLRLEYWILPPQAPPFEKC

SEQ ID NO: 61400 - DNA, 674 bp, Zea mays
  misc_feature: Ceres CLONE 1523252
  misc_feature: Encodes the peptide sequence at SEQ ID NO. 61401
ggagctccccgcggtggcggccgctctagaactagtggatcccccgggctgcaggaattcgtctcacccctagaaaaaaacgcggcacagagcctcattcatctccattcgaaacaccctcgcacccacactctcccttcgtccccagcctaaatccccgcaacgatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagctgctcatccgcaagctgcccttccagcgcctggtccgcgagatcgcgcaggacttcaagaccgacctccgcttccagtcctccgccgtcgccgcgctgcaggaggccgccgaggcttacctcgtcggcctggtcgaggacacaacctctgcggcatccaccgccagcgcgtcaccatcatgcctaaggacatccagctcgcccgccgcatccgcggggagcgcgccttaggcgccgggcggcccggaaggccgtggcgcaatctcctcctcgaagtttgtactaatgggccgggtcctgtggaagggaatggtgtactaaacaccaag

SEQ ID NO: 61401 - protein, 136 aa, Zea mays
  misc_feature: Ceres CLONE 1523252
  misc_feature (58)..(123): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLVEDTTSAASTASASPSCLRTSSSPAASAGSAP

SEQ ID NO: 61402 - DNA, 706 bp, Zea mays
  misc_feature: Ceres CLONE 1523253
  misc_feature: Encodes the peptide sequence at SEQ ID NO. 61403
ctccccgcggtggcggccgctctattttttctggatcccccgggctgcaggaatttctctcacccctagaaaaaaatagaaaaatagaaaaaaacccttcgctgcgccgccgcctccgacatcgtctcttcgtccccacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgactcagccgtgcaggtgggtgagggggtggacacattccgtctacaggaccaaccccccctttgacaagaaatcattttgtctcttacataaaaaaataccttcaagaatctcccttgctgtgttgggacccccaaaaaagcggaatgagttccaaaaggggtgtctaagggttcaaccaaattttcctccttagcaaggctaaagggaccctcccttttttgtttgggggagaagcatggaagaacaaaccccccccggggatttctgccattataaaaaagaagggggggcaccaaaaccgcgacatttccccccctttttccccaaggggcggttcaggagattccgcggtcctc

SEQ ID NO: 61403 - protein, 81 aa, Zea mays
  misc_feature: Ceres CLONE 1523253
  misc_feature (1)..(80): Pfam Name: TCTP Pfam Description: Translationally controlled tumour protein
MLVYQDLLSGDELLSDSFTYKELENGVLWEVEGKWVTQGPVDVDIGANPSAEGGEDESVDDSAVQVGEGVDTFRLQDQPPL

SEQ ID NO: 61404 - DNA, 680 bp, Zea mays
  misc_feature: Ceres CLONE 1523254
  misc_feature: Encodes the peptide sequence at SEQ ID NO. 61405
  misc_feature (413)..(413): n is a, c, t, g, unknown, or other
  misc_feature (485)..(485): n is a, c, t, g, unknown, or other
  misc_feature (486)..(486): n is a, c, t, g, unknown, or other
  misc_feature (616)..(616): n is a, c, t, g, unknown, or other
aagctggagctccccgcggtggcggccgctctagaactagtggatcccccgggctgcaggaattcgtctcacccctagaaaaaacggcagctctgaagcgagaaagagatcgatcgtattcgtatccgcggaacaagcagcgaaggatcggagcctatccaatggccgagggcaagagcagctccggcggcgacctgttctccagcggcaagctggtggcgggggccgccgtgtcggtgttccagcagaagagcgtggagaacgtcgacaagcaggaggtcgccggcgcggcggccgagctcctgcacgcggcgtccgcgtacggtaagctcgacgacaagccggccgggcagtacgtcgagaaggccgaggggtacctgaaggagttcagcgcgggacacgccaccgagcangagcagcctgcggcggcagcaggcgacgacgcggcgcccaagtcaccggcgccggaggcgcccaaggagccnnggcgcgtgcctgcgccggcccgcgaggaaagccagcagtcgtcggaggggttcggcctcggcgacgtcatgaagggcgccaagcagctggtgggagggaaataccagggccggcggaaggaaaacccccngcgccgtgggctgtttaagaagggccaaggcttccctcaagtaaaattgtctgggcaacctaat

SEQ ID NO: 61405 - protein, 173 aa, Zea mays
  misc_feature: Ceres CLONE 1523254
  misc_feature (84)..(84): Xaa is any aa, unknown, or other
  misc_feature (109)..(109): Xaa is any aa, unknown, or other
  misc_feature (152)..(152): Xaa is any aa, unknown, or other
MAEGKSSSGGDLFSSGKLVAGAAVSVFQQKSVENVDKQEVAGAAAELLHAASAYGKLDDKPAGQYVEKAEGYLKEFSAGHATEXEQPAAAAGDDAAPKSPAPEAPKEPXRVPAPAREESQQSSEGFGLGDVMKGAKQLVGGKYQGRRKENPXRRGLFKKGQGFPQVKLSGQPN

SEQ ID NO: 61406 - DNA, 667 bp, Zea mays
  misc_feature: Ceres CLONE 1523255
  misc_feature: Encodes the peptide sequence at SEQ ID NO. 61407
tggagctccccgcggtggcggccgctctagaactagtggatcccccgggctgcaggaattcgtctcacccctagaaaaactagaaaaatggccctcgcctcccgcgccgccgcagccgccgtggcgtgcgtcctcctggcgctcgccgcctccgccgcgggggcgggctccaactcccctgcaccggcgccggcggtggactgtatctcccaggccgccagcctgatcgactgcatcgactacgtccagaaggggagcagcgcgcgccgtccgtccgctgcctgctgcggcgaggtcaagaccgcagtggccagccccgtcatcgtgggctgcctctgctccctcgccggctccaactccagtaacctgggctttcccatcgacatgaagcgcgtgctggcgctccccggcgcgtgcggcgcgtccaacgccgccttcagcaagtgcaacatttccgcgcttcccccaaccgaagcacctgcaccgtccgccgccggggggtcatcgagcggtggcgcggcggcatcttcaccgcgcgccgcggcggcgagctctcctccgatgacggcgaccgccctgttggctgccgtggcggctcccctgctcgcctactactgctgctacctcttctgagggtttccttctgctgctgctgccgtctaggctg

SEQ ID NO: 61407 - protein, 181 aa, Zea mays
  misc_feature: Ceres CLONE 1523255
MALASRAAAAAVACVLLALAASAAGAGSNSPAPAPAVDCISQAASLIDCIDYVQKGSSARRPSAACCGEVKTAVASPVIVGCLCSLAGSNSSNLGFPIDMKRVLALPGACGASNAAFSKCNISALPPTEAPAPSAAGGSSSGGAAASSPRAAAASSPPMTATALLAAVAAPLLAYYCCYLF

SEQ ID NO: 61408 - DNA, 667 bp, Zea mays
  misc_feature: Ceres CLONE 1523256
  misc_feature: Encodes the peptide sequence at SEQ ID NO. 61409
  misc_feature (651)..(651): n is a, c, t, g, unknown, or other
ggagctccccgcggtggcggccgctctagaactagtggatcccccgggctgcaggaattcgtctcacccctagaaaaaatccaccttcacacagaagtgcaagcgagccctttcacgtcgaacgggagctgcgcacagaccaccaagcgtcggcaccaatggcttactaccaagaggtggactactgctcggacgacgtgaggtcggtggccccgggcggctcccgtcgccacgggggccgtttccagcggcacgtcctcaaggagaagatcgatgacgtcaacccggtctcatgccccggcgccaagccccaccaccaccatgatcgacacggcggccacgtgcttcctgctgctcgagaccaccgtcgaagaggacatcaacacctgcaccggcgagttccaccaccgcaaggagaccttccacgccaggactaactgagccgcatggtgtgtcggcatgcacacccgttagtgctggcctgcgtgacttatctatgtctgtggctgactggtcgtgcagggtcatcgaacttaggtatctgacgtgcactcgctcagctcatgtacgaatcacgataataatctcgggacctagatagacttctacgtgatattatacctcctcggagctgtaagaatatcaagtgcnctgcaaaactgaatta

SEQ ID NO: 61409 - protein, 92 aa, Zea mays
  misc_feature: Ceres CLONE 1523256
MAYYQEVDYCSDDVRSVAPGGSRRHGGRFQRHVLKEKIDDVNPVSCPGAKPHHHHDRHGGHVLPAARDHRRRGHQHLHRRVPPPQGDLPRQD

SEQ ID NO: 61410 - DNA, 694 bp, Zea mays
  misc_feature: Ceres CLONE 1523258
  misc_feature: Encodes the peptide sequence at SEQ ID NO. 61411
  misc_feature (455)..(455): n is a, c, t, g, unknown, or other
  misc_feature (516)..(516): n is a, c, t, g, unknown, or other
  misc_feature (540)..(540): n is a, c, t, g, unknown, or other
  misc_feature (645)..(645): n is a, c, t, g, unknown, or other
  misc_feature (688)..(688): n is a, c, t, g, unknown, or other
ggagctccccgcggtggcggccgctctagaactagtggatcccccgggctgcaggaattcgtctcacccctagaaaaaaacgaggactccaaacgggctgcgtgcacggacatctcgcccttatcgcggcgtcgtgcacccgagttccgtggagacgagacacgtcacgttacgatccccaacttaacgccgaccggaggccggagagaccggctcagcctcgctccgccgccgctggcgaacatgtccatggcggctatcttcgtcttcctcatcgtgtccgcgctgcagctgctcgatcgctacctcgacctcgccagaaagagcggaggacttagtgatgagcagatcaaagtgcggcttgaaatcaagcaacttctcaaggaggctgatcagttgtcaacgccgtccacatttgcacaagctgctaaactcaagcgcctggctgctgctanggagaaggaactggcaaaaatgcaggaacatgaccttaaagggaagcaatccttatacgancaatacacaaaatttttgttggtnagtaaggtcataatttatgctgtgctcgttctgtgcttttggagtactccctgtactgcagttcccacacatcttctacagcccttcggaaaaatgtttccctgnagaggtgttgatactgccacccggcaatgtgtggttgaatacntcccgg

SEQ ID NO: 61411 - protein, 150 aa, Zea mays
  misc_feature: Ceres CLONE 1523258
  misc_feature (71)..(71): Xaa is any aa, unknown, or other
  misc_feature (91)..(91): Xaa is any aa, unknown, or other
  misc_feature (134)..(134): Xaa is any aa, unknown, or other
  misc_feature (149)..(149): Xaa is any aa, unknown, or other
MSMAAIFVFLIVSALQLLDRYLDLARKSGGLSDEQIKVRLEIKQLLKEADQLSTPSTFAQAAKLKRLAAAXEKELAKMQEHDLKGKQSLYXQYTKFLLVSKVIIYAVLVLCFWSTPCTAVPTHLLQPFGKMFPXRGVDTATRQCVVEYXP

SEQ ID NO: 61412 - DNA, 652 bp, Zea mays
  misc_feature: Ceres CLONE 1523259
  misc_feature: Encodes the peptide sequence at SEQ ID NO. 61413
  misc_feature (383)..(383): n is a, c, t, g, unknown, or other
  misc_feature (512)..(512): n is a, c, t, g, unknown, or other
ctccccgcggtggcggccgctctagaactagtggatcccccgggctgcaggaattcgtctcacccctagaaaaaaactctattgcgacatacgaggctgtgattgatgcttaccttgatgggctagaggcttcgggcttgagcgacttatctcgagttaccagtgtcgcatccttctttgtcagccgagtcgacacccttatcgacaaaatgcttgaaaagattggaacacctgaggcacttgccttgagagggaaggctgccgtcgcacaggccaaactagcaaatcggctctaccagaagaaattctctggcccaaggtgggaggcgttggccaagaaaggtgccaagaaacagaggttgttgtgggcatccaccggtgtncagaacccagcttatcccgacactctttacatcgacagtctcattggacctgacacggtcaacacgatgcccgaccaagctttgcaggcattcatagaccacggcactgtctcgaggacagttgatgcnaatgtgtccgaaggcgaaggtggataacagcgctttgaagaagctgggcattgactggggccaaagtcggaaagcaacttgaccttggaaggggtgaactccttccaagaaaacttttgacgcccaatcccgggacccgg

SEQ ID NO: 61413 - protein, 178 aa, Zea mays
  misc_feature: Ceres CLONE 1523259
  misc_feature: SWISSPROT Homolog: EC 2.2.1.2 Transaldolase
PRGGGRSRTSGSPGLQEFVSPLEKNSIATYEAVIDAYLDGLEASGLSDLSRVTSVASFFVSRVDTLIDKMLEKIGTPEALALRGKAAVAQAKLANRLYQKKFSGPRWEALAKKGAKKQRLLWASTGVQNPAYPDTLYIDSLIGPDTVNTMPDQALQAFIDHGTVSRTVDANVSEGEGG

SEQ ID NO: 61414 - DNA, 697 bp, Zea mays
  misc_feature: Ceres CLONE 1523262
  misc_feature: Encodes the peptide sequence at SEQ ID NO. 61415
  misc_feature (320)..(320): n is a, c, t, g, unknown, or other
  misc_feature (399)..(399): n is a, c, t, g, unknown, or other
  misc_feature (533)..(533): n is a, c, t, g, unknown, or other
ggagctccccgcggtggcggccgctctagaactagtggatcccccgggctgcaggaattcgtctcacccctagaaaaagcccctgatccactctccgcttcccgctccgatcgacctgctccctccccaccaccgagcccatggcggaccagctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggncacggcaccatcgatttcccagagtttctcaaccttatggctcgcaagatgaaggacaccgactctgaggaagagctcnaggaggccttccgtgtgtttgacagggaccagacggcttcatctcgggcgccgagctccgccatgtcatgacaaatcttggtgagaagctaactgatgaggaggtggacaaaatgatccgtgaggctgatgtcnatggtgaatgccaaatcaactacaaggagtttgtcaagggcatgatgggcccattgacccccgaaacattaattggagggcagaaaaaaatatcgcttgccaattaacccaaaaggccactttttatttccctcccctttccagggaaactttcgggctagttt

SEQ ID NO: 61415 - protein, 109 aa, Zea mays
  misc_feature: Ceres CLONE 1523262
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature (87)..(87): Xaa is any aa, unknown, or other
MADQLTDDQIAEFKEAFSLFDKDGDGCITTKELGTVMRSLGQNPTEAELQDMINEVDADGHGTIDFPEFLNLMARKMKDTDSEEELXEAFRVFDRDQTASSRAPSSAMS

SEQ ID NO: 61416 - DNA, 689 bp, Zea mays
  misc_feature: Ceres CLONE 1523264
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (34)..(34): n is a, c, t, g, unknown, or other
  misc_feature (48)..(48): n is a, c, t, g, unknown, or other
  misc_feature (194)..(194): n is a, c, t, g, unknown, or other
  misc_feature (235)..(235): n is a, c, t, g, unknown, or other
  misc_feature (241)..(241): n is a, c, t, g, unknown, or other
  misc_feature (325)..(325): n is a, c, t, g, unknown, or other
  misc_feature (359)..(359): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (458)..(458): n is a, c, t, g, unknown, or other
  misc_feature (460)..(460): n is a, c, t, g, unknown, or other
  misc_feature (472)..(472): n is a, c, t, g, unknown, or other
  misc_feature (619)..(619): n is a, c, t, g, unknown, or other
nnaaccccnnnnccccccaaagaacccccccccnggccgccgctctanaatagtggatcccccgggctgcaggaattcgtctcacccctagaaaaaccaaaggtaccttgcaatcacaacgaacagaagctctcgatctcaccgacaccgaggaagaagagatcaatggttgtcccagcagggagtcgtgatcncgtgccacagcaaggctgagttccacgcccacatgaccaangcccangaagcctcgcagctggtggtcatccacttcactgccgcctggtgcggtccatgcctttccccccccccaggggggagcaaaccncccaaaatttttttctggccctcttcctgaaagnggaccnnntttttttttcccccccccccggggaagaaagggggnnnnnnnnncnnnnnnnncnnnnnnnnnnnnnnnaaaaaaaaaacacccccccccncngggggggggggnccaggcccccccccccaaaccaaaacaggacccccccgcgccagcccttcaacactccaacaaaaaaccatcttctttctccaacagagcaccccatctcccttatagcctccccacgcggtctctgttgcagttctcgcccggcgncacatcaccaggactcatgtcctatatacttacgtgattccctccaaacccccgcacccccgcactcccg

SEQ ID NO: 61417 - DNA, 679 bp, Zea mays
  misc_feature: Ceres CLONE 1523265
  misc_feature: Encodes the peptide sequence at SEQ ID NO. 61418
ggagctccccgcggtggcggccgctctagaactagtggatcccccgggctgcaggaattcgtctcacccctagaaaaagcggccgtgcggtgcgggcgtgcggcctccctttttttctcccgttcctccggcggcggcgtgcttggcggtgcgccaggtgctctcgatctccaccatcttagtcgccggcgacaagcgatcgccaggttcccgatgaccatggcgcggctgatgatgtgcctgcttcggcggcccattgggtttacagggccgcgggctcgaacagccctgatgaccactgccgcaccagcagcacacggtgcgtccctggctgaggctactgctactgatgctaaaagaagaaggaataatctgtttgacgtactgcagttcctgccagactgcgccattgtatacgaagttgccaagaccacctggcgtgctgtctcctatcagatcacctcgatctccctgtacgaagatggtcggcttgtatatgcgtgtgggcttctctacaccgtctgtgtgtcggctgcagacaccccttctaagatcagcgggagtaacaaacgatgggtggaagtccatggaaggaatctccgaatatactacatgaagccccctcgtgtggacgtagctgttgctgcctgcctagttttgaggtaccctgcttcgtctg

SEQ ID NO: 61418 - protein, 155 aa, Zea mays
  misc_feature: Ceres CLONE 1523265
MTMARLMMCLLRRPIGFTGPRARTALMTTAAPAAHGASLAEATATDAKRRRNNLFDVLQFLPDCAIVYEVAKTTWRAVSYQITSISLYEDGRLVYACGLLYTVCVSAADTPSKISGSNKRWVEVHGRNLRIYYMKPPRVDVAVAACLVLRYPASS

SEQ ID NO: 61419 - DNA, 633 bp, Zea mays
  misc_feature: Ceres CLONE 1523266
  misc_feature: Encodes the peptide sequence at SEQ ID NO. 61420
acccgcggtggcggccgctctagaactagtggatcccccgggctgcaggaattcgtctcacccctagaaaaaatcttctcccccagctccccagcaccagtccccaattatttggcctccgtcagagaggggagaaagacccgttcgaggcggcggcgatgtcggggcgcggcaagggcggcaagggtctgggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggatgtcgtctacgcgctcaagcgccaggggccgcaccctcctacgggttcggaggctaaggccccctcttcctaactgggggaaagcctttagggggaaaaccccctccctctcccccggggggccccaaaagggtgttccccccccccccccgggaaaaaacccccctttttttttttttttcccccaaaaaaaaaaaaaactccttccccccccaccc

SEQ ID NO: 61420 - protein, 109 aa, Zea mays
  misc_feature: Ceres CLONE 1523266
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGPHPPTGSEAKAPSS

SEQ ID NO: 61421 - DNA, 662 bp, Zea mays
  misc_feature: Ceres CLONE 1523270
ctggagctccccgcggtggcggccgctctagaactagtggatcccccgggctgcaggaattcgtctcacccctagaaaaacatggatccaccggagagatctggtctgccattcccacgctccttcctgtgaaccacaaacctaacgcggagcggcgcgggccggccgccgggtgaggtgttcgtacctgccatcaatcgtcaagcgatccatcgacagtctggcgtgcccggcgacatccttcttcgatgcgccgctagccgccattgcagactacatggggtccacggtccagcagatgccggccacctccaccgccttgatcatggactacacggtgagaaagaatggctacatgaggaccacgcacgacgtgtcggccaagcagctcctggagaccggcacgggcaagatgatgtggagcagcgcttccagcatctaatgctcgccaggaatgaacttagcacaagagatgctctggaaatagtgctgtccacggagcgactacacgatgttaggttgcactgcctacctcaagtgataggagagtcagtgagattacacgtcatcagaaatcatgaggtgtcctctcctgatcgaattgtggtatcttcactgtattacgtctcaaaatgctgagcatcatttaacagaagcaaaac

SEQ ID NO: 61422 - DNA, 668 bp, Zea mays
  misc_feature: Ceres CLONE 1523271
  misc_feature: Encodes the peptide sequence at SEQ ID NO. 61423
  misc_feature (400)..(400): n is a, c, t, g, unknown, or other
  misc_feature (407)..(407): n is a, c, t, g, unknown, or other
  misc_feature (436)..(436): n is a, c, t, g, unknown, or other
tccccgcggtggcggccgctctagaactagtggatcccccgggctgcaggaattcgtctcacccctagaaaaaaccgaagcttctcgctagtaaatggtggctgcctcctccaccgccgcgaccattatcagctcctgctgccgcctcgggcctccctctccgcccgaacaagccgctgcaggagctcgcatgccgcacgcgccggcagcaggcgtgtcggcgtcgcacgcgctgcgcggggcgtgcgtggcagcctcggcgtgcgcggttatggggatggcgggtggcggcgacatactgctggcgcgggacggggcattcgtcgccacgtggactgacgccatgggtgccgcgcgcaccaaggcgccggcgtcgtggagcgagctcaccccccccccnccgtggngcgccaactcgctggagaacgtcgtgccnaaaaacctgccccgcccgcccccgcccaggaggttttaaaagcgtctcggtctcggcggccccccccgacttggggggcgcggccgcccttctgtcctcccccgcggtgcgccccgggaaggggtgtgttcttggttatgaaccccccctggggcaacttttggaaaacccgaaggttttttaaaaaaaaaaaaatcgatcgaatgccggaaatcccaaggtttacattggt

SEQ ID NO: 61423 - protein, 94 aa, Zea mays
  misc_feature: Ceres CLONE 1523271
  misc_feature (73)..(73): Xaa is any aa, unknown, or other
MPHAPAAGVSASHALRGACVAASACAVMGMAGGGDILLARDGAFVATWTDAMGAARTKAPASWSELTPPPPWXANSLENVVPKNLPRPPPPRRF

SEQ ID NO: 61424 - DNA, 691 bp, Zea mays
  misc_feature: Ceres CLONE 1523272
  misc_feature: Encodes the peptide sequence at SEQ ID NO. 61425
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (253)..(253): n is a, c, t, g, unknown, or other
  misc_feature (404)..(404): n is a, c, t, g, unknown, or other
  misc_feature (407)..(407): n is a, c, t, g, unknown, or other
  misc_feature (409)..(409): n is a, c, t, g, unknown, or other
  misc_feature (412)..(412): n is a, c, t, g, unknown, or other
nnaatcgnnnnagatcatctggactccccgcggtggcggccgctctagactagtggatcccccgggctgcaggaattcgtctcacccctagaaaaaaatcagatagagagagcatagtcgatcatgaagggtggcaagaaggaagtggccggtgcggtggtggccatactgctggttctgcagctcatggcagctccaccgacggccatggccgcccgctcgccgcgcggagccgtgccggatggctccctcnccacgacgcccaaggtgacaatgctgtcggccacgctgtgctacactttgcacacatgaaaaaaactccctgcttccctctgtttgttctgcagctttagaggtccgctctgctattttatcccccccccgggggaaaagaaaaggggatntcncnaanccccccccccacctgtgtgggcggggcaaataccacgacgcggcctcccgtggcctactactcagtttaccactttttcaggcgccccggctcctttaggcatccgctatgcattaccctggccgggcccctgcacaaaaggaacgtccccttgttacacctttaggccgcgaaatcccggcgcagaaaagtagggatccgtgccccaatagtcaccatctcctccctctcgtagcttccctttcgtcccggccagtggacccgtgttcttaaccgcgg

SEQ ID NO: 61425 - protein, 62 aa, Zea mays
  misc_feature: Ceres CLONE 1523272
  misc_feature (44)..(44): Xaa is any aa, unknown, or other
MKGGKKEVAGAVVAILLVLQLMAAPPTAMAARSPRGAVPDGSLXTTPKVTMLSATLCYTLHT

SEQ ID NO: 61426 - DNA, 682 bp, Zea mays
  misc_feature: Ceres CLONE 1523276
  misc_feature: Encodes the peptide sequence at SEQ ID NO. 61427
  misc_feature (449)..(449): n is a, c, t, g, unknown, or other
ctggagctccccgcggtggcggccgctctagaactagtggatcccccgggctgcaggaattcgtctcacccctagaaaaaagacacagacacggacacagcaaccaacaagtcgtccaacgtccaggcttttctgttttgtttcactctcacgcaagtcgaaaagcaaagcgtcccccaccatggcttccacgacgacgacggcatccaacaacctggcgggcgtgtggctcggcgagctctcgtcggcgctgcatgggacgtgtgatgcggtggccgtggccgccacccacgggttcggcgaggacaacgacccgcggctgccgtgccagcatcaccaaaggccgtggcgaggcaactacaggagcaccagcaacaacaaggcgttgcgaggagccgcggcttccggtacggacaggcgggaggaggacttcgcagagtgcggcggcnccatgtccaacaccacgttctacctcctcatagacaggttcgcgcccagctgaccggtccccttgctcacccgacactgccgccgccgccgcctcgatcgatcggcgcgtgctgtactgtacaggcggaatcactgcacgtctgcacgctatggtttcatgtaatactgctgtatataagctgcaatgccatcttgaggtgctttcaaacatgaaaactaacgagactctcat

SEQ ID NO: 61427 - protein, 106 aa, Zea mays
  misc_feature: Ceres CLONE 1523276
  misc_feature (90)..(90): Xaa is any aa, unknown, or other
MASTTTTASNNLAGVWLGELSSALHGTCDAVAVAATHGFGEDNDPRLPCQHHQRPWRGNYRSTSNNKALRGAAASGTDRREEDFAECGGXMSNTTFYLLIDRFAPS

SEQ ID NO: 61428 - DNA, 575 bp, Zea mays
  misc_feature: Ceres CLONE 1523381
  misc_feature (18)..(18): n is a, c, t, g, unknown, or other
  misc_feature (21)..(21): n is a, c, t, g, unknown, or other
  misc_feature (24)..(24): n is a, c, t, g, unknown, or other
  misc_feature (32)..(32): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttggtttttattaccctnttnttnccctcttnccttcgttttnnnttttttttttttcatactggactccaccgcggtggcggccgctctagaactagtggatcccccgggctgcaggaattcgtctcacccctagaaaatccgacggcgccgacaaaaccagaccatcaaacaagtgccagcgccctctcgcagtcgccgcaatggagagcaccttcatcatgatcaagccttgacggcgttcccaaagggggccccccatttgggggggaagaaccttccacgcccggttttttttagaaaaaaaaaaaaaggggggggggttttttttataacccccccccaaaaggaggggccccccttttttttaaaactctcttttggttaaaacaacccctgggaaaaaaaagagggccctttttttggccccgagaaaaaaaaaacacttttcccccgccgaagtatttttcccccccccccccaaaaaacccctttttttttttttaaagggggggccccccccgggggagaaaaaaaaaataattttttttgtgggggcccccgggggggggggg

SEQ ID NO: 61429 - DNA, 670 bp, Zea mays
  misc_feature: Ceres CLONE 1523420
  misc_feature: Encodes the peptide sequence at SEQ ID NO. 61430
  misc_feature (415)..(415): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
aaagctggagctccccgcggtggcggccgctctagaactagtggatcccccgggctgcaggaattcgtctcacccctagaaaaactcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcangaagggagactagagcggatgtggtcttcaagttttgctctatgccagatactagcgtcatgaactgcctttagctaagattttccataagttgttctcgagcaactatgtgttgcatgttggctacttccaaactttatatctgggttggttttgggattgtgatgaactaatggcccctcccacccccccctattgatgtttgaccaatatttgggcgggaaaaaaaaaaaaccgtttnnnnnnnnnnnnnnn

SEQ ID NO: 61430 - protein, 86 aa, Zea mays
  misc_feature: Ceres CLONE 1523420
  misc_feature (30)..(84): Pfam Name: Ribosomal_S27e Pfam Description: Ribosomal protein S27
  misc_feature (83)..(83): Xaa is any aa, unknown, or other
MVLQNDIDLLNPPAELEKLKHKKKRLVQSPNSFFMDVKCQGCFSITTVFSHSQTVVVCPGCQTVLCQPTGGKARLTEGCSFRXKGD

SEQ ID NO: 61431 - DNA, 687 bp, Zea mays
  misc_feature: Ceres CLONE 1523446
  misc_feature: Encodes the peptide sequence at SEQ ID NO. 61432
  misc_feature (28)..(28): n is a, c, t, g, unknown, or other
  misc_feature (36)..(36): n is a, c, t, g, unknown, or other
  misc_feature (37)..(37): n is a, c, t, g, unknown, or other
tgggtttggtgttgtttgcggggggggngggagggnntaggaatctttccccccccccctcaatactgagactccccgcggtggcggccgctcttcactagtggatcccccgggctgcaggaattcgtctcacccctagaaaaaggatctctcggaggtgggctggcttctcctccccctcttaccaagtcctcttcgggttagggttacttacggatgtggggaggggaagatggcggcggccgatgtggaggaccgttgcatagcaacccgcaggcttggccgggccacgtgccaagagtaggtggagaatgccttgcacctcctacggcgagatccatcgatcgtgcaacgccatcaccgacccggagacggggcaggtctcgcggtcttgggatcctggacacttgtccctccgagaactacgtgctcgtacctatcgagaacatcaaaggcaaggagctcatcggccgcctcctccccactgacattgactactcccatgtcgatggctgtgtgcgcgatggccacggctgcgggcgcgagaaagcgccgccatcgcgtccggcgaccatgacggaaggtatagaaaccgtatcggctaccccagccggcacatgtgtcgaagcagcgatctacgcattccgtggctgctaccggctccagccttacgaaaacggtggctgc

SEQ ID NO: 61432 - protein, 157 aa, Zea mays
  misc_feature: Ceres CLONE 1523446
MWGGEDGGGRCGGPLHSNPQAWPGHVPRVGGECLAPPTARSIDRATPSPTRRRGRSRGLGILDTCPSENYVLVPIENIKGKELIGRLLPTDIDYSHVDGCVRDGHGCGREKAPPSRPATMTEGIETVSATPAGTCVEAAIYAFRGCYRLQPYENGGC

SEQ ID NO: 61433 - DNA, 664 bp, Zea mays
  misc_feature: Ceres CLONE 1523454
  misc_feature: Translation starting site: 175
tccccgcggtggcggccgctctagaactagtggatcccccgggctgcaggaattcgtctcacccctagaaaaaaaaaggcaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgcccccatggcgggccccaggaccgggacccccgaggcgaagaaaagtacgcggccatctgcgtcaccatgcccaccgccaaggtctgccacaactgagcacgcccgctttgcagctgcagggccgggggggtggtatataattaatggccgtgccacggttgttggttgcccccaatttgttggtttcaagcttttaaaagccttccctgaacgtgaggcccgctttaatttggttttctgaccggccctcgggagctttaagaaaatattca

SEQ ID NO: 61434 - DNA, 640 bp, Zea mays
  misc_feature: Ceres CLONE 1523466
  misc_feature: Encodes the peptide sequence at SEQ ID NO. 61435
tccccgcggtggcggccgctctagaactagtggatcccccgggctgcaggaattcgtctcacccctagaaaaaaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacaatatgcatgcgccggccgacgacgacgcgcgctgcctctcgtgagcttctgttcaagtgatgcatgtttcaaggcatccatggatgctttacgtatatgcgtattaattagccgtgtcaggaaaccggacagaagggggtgttgttttatatttacgtcttctggtgatcaaataaaggggaaatatatgttggatgtgtgcaatgcatagaatttcaaaaaaaaaaaaaaaaacgag

SEQ ID NO: 61435 - protein, 90 aa, Zea mays; identical to SEQ ID NO: 58696
  misc_feature: Ceres CLONE 1523466

SEQ ID NO: 61436 - DNA, 597 bp, Zea mays
  misc_feature: Ceres CLONE 1523486
  misc_feature: Encodes the peptide sequence at SEQ ID NO. 61437
tccccgcggtggcggccgctctagaactagtggatcccccgggctgcaggaattcgtctcacccctagaaaaactgctcagactcgtctgctgcagctcctcctccgccgccgtatcaaacgcactctcctccgccgccgcccgaggcaagatggttctccagaacgacatcgaccttctcaacccgccggcagagctcgagaagctcaagcacaagaagaagcgcctcgtccagtcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggaagggagactagagctgagtctgttattagtactgggatcggttgtcaatctccagtatgtgggtcttcaaagttttgctctgtggccccagacgttaggggtcatgaacttccttaagctaaggcttttcccgcatggttggttctgtggccgctatgttattcgccaccgttgggtccctggctgaaacttataa

SEQ ID NO: 61437 - protein, 86 aa, Zea mays; identical to SEQ ID NO: 44315
  misc_feature: Ceres CLONE 1523486
  misc_feature (30)..(84): Pfam Name: Ribosomal_S27e Pfam Description: Ribosomal protein S27

SEQ ID NO: 61438 - DNA, 630 bp, Zea mays
  misc_feature: Ceres CLONE 1523504
  misc_feature: Encodes the peptide sequence at SEQ ID NO. 61439
tcttaactagtggatcccccgggctgcaggaattcgtctcacccctagaaaaaaaggcgcatcccttctttcattcgccgtcgccgcctgatctctgctggcgcatgcaacgatggggagaatgcctgcgaggatgctatcgtcagatcaagaacaagccatactccctagtgcaggtactgccgatggatggccctgatcccaagatcaggatctatgatgttggaatgaagagaaaaggtgttgatgagttcccctaatgtgtgcacgttgtctgcttgtgacaaagaattgtatcccgtgaggctctggaggctgcggaaattgcctgaaaagctatatgacttaagatgcacaaaaagatgacttcccagcttcaggtggaggttcacccctgccatgtcgttggaagcgaaacatcctgttgcatgcaggagctgatcgtctccgatacgcgaaagagaggtggctctttgtcttacctcatgggcacgcggtgtaagtggattacattcggtcagggtcccgtctttgtctaatccaatggtcgggggtcaattaatgttaggctttttttccacgttggaaagacaagatgctttttgcctatcctcactgttatttatttga

SEQ ID NO: 61439 - protein, 51 aa, Zea mays
  misc_feature: Ceres CLONE 1523504
MQRWGECLRGCYRQIKNKPYSLVQVLPMDGPDPKIRIYDVGMKRKGVDEFP

SEQ ID NO: 61440 - DNA, 738 bp, Zea mays
  misc_feature: Ceres CLONE 1523553
  misc_feature: Encodes the peptide sequence at SEQ ID NO. 61441
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (738)..(738): n is a, c, t, g, unknown, or other
tttttttnnnnnnnnnnnnnnnnnnnnnnnnnnnnnnnnnnnnnnnnnnnttaaagttttttcaaagctggggctccccgcggtggcggccgctctagaactagtggatcccccgggctgcaggaattcgtctcacccctagaaaaagttgcttgctcccaagatcaagcgcctcccgcctccagcactcttaactcaggggacacgatcgccatggccgccacatcgaccgccgccgccgtgctgtgcccgccgtccgtggccgggctccgcctggcgccgtctcccggccgggcgcgcgtgtcgttccgcgcggcgccggcgcctgcgcggcggtcccttggcggcacgcgcggagctgaagctcggcgctggtgataaccctgagcacgggcgtgtcactcttcctggggcggcttcgtcttcttcaacttccaacgggaagaacctgggggaaacaaggtgcccgcacaaaaaccgcaaagacggcactttttgaccgcctggcgaacaagcccccccaaagaaattccacgggccctggcctcaagttcccaaccgaccccccggggggctttccaaccctggttgaaaggtccctttccctttggggatattcgaatcggggccacaaatctgaccgcccctaataaagatgcccgtgaccacacctcccagtaaaaaagggaaataacaaaaccccccacatttttttttatagaaaacgaggaactcttn

SEQ ID NO: 61441 - protein, 54 aa, Zea mays
  misc_feature: Ceres CLONE 1523553
MAATSTAAAVLCPPSVAGLRLAPSPGRARVSFRAAPAPARRSLGGTRGAEARRW

SEQ ID NO: 61442 - DNA, 539 bp, Zea mays
  misc_feature: Ceres CLONE 1523591
  misc_feature: Encodes the peptide sequence at SEQ ID NO. 61443
  misc_feature (105)..(105): n is a, c, t, g, unknown, or other
  misc_feature (119)..(119): n is a, c, t, g, unknown, or other
  misc_feature (452)..(452): n is a, c, t, g, unknown, or other
gaagctccccgcggtggcggccgctctagaactagtggatcccccgggctgcaggaattcgtctcacccctagaaaaagagagtgagacaaccatggcgtctctnggccctccgccccngtcatcccggccaccaccgcttcatccaggaccctcacgatcgtcgttggctcccgctcctgccacgctgccacactccaccgtggctttcgctcgcggcgcctcatcacctgcaaggcggagccgagcggcggcaacagcaccctcgagctgggcgcaggggccgcagggctggcatcgagcgcggtcgtggcgtggtccctctacacgctgaacacgaacggggtgcgggcctgcctccaggggccccgggggggggccccctcggggcccccggaaaggggccaaccaacccccccccggggggggggttaaaaacggggggggggtccnacaaacccccacccccaacaaaggggggggggggggcacccctttttttttttttttttggcgggattaactccccccccgggggta

SEQ ID NO: 61443 - protein, 79 aa, Zea mays
  misc_feature: Ceres CLONE 1523591
  misc_feature (9)..(9): Xaa is any aa, unknown, or other
MASLGPPPXSSRPPPLHPGPSRSSLAPAPATLPHSTVAFARGASSPARRSRAAATAPSSWAQGPQGWHRARSWRGPSTR

SEQ ID NO: 61444 - DNA, 846 bp, Zea mays
  misc_feature: Ceres CLONE 1523594
  misc_feature: Encodes the peptide sequence at SEQ ID NO. 61445
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
tttttttttttttttttttttttttgnntnnnnnncnnccccnnnggaannnnnnccaaactggagctccaccgcggtggcggccgctctagaactagtggatcccccgggctgcaggaattcgtctcacccctagaaaaagcaacagccaacatatctcctcgcatttccttgcaaccgattgccttcccccctcccaacccaagaccgatggcgcccaaggccgagaagaagcccgcggcgaagaagccggcggaggaggagcccgcggcggagaagacgaccgccgggaagaagcccaaggcggagaaccggatcccccctggcaagtccgccggcaaggagggcggccagggcaagcgtgtcataaagaagggcaagaagagcgcggacacgcccaagatctaccatcttcaaggtttttgaacccccgcccaccgggggggggggggggttctccttccaagggccattatccattcaatggaatttcccttcataaaccaactttcctccccaaaagcttgggtcgcgcaaaggcgcgatcaaaatattcgcgcttacataaacgacaaaagagggcccccactaattcttccgttgccctctaagatatcccggaacctttccgcggggggcctgcgtgtggtgctccccgggcaaggctcctgccccaatgccccggcccccccctcctaaagagggggccccagagccccgtgctaccaaacctctgccccccccccctcccacccaacctcccccccttcgcctccccttgttgtgcccccgccctccacttgggcccccccccacgcccccccggtccgcgccgcgcagacccct

SEQ ID NO: 61445 - protein, 71 aa, Zea mays
  misc_feature: Ceres CLONE 1523594
MAPKAEKKPAAKKPAEEEPAAEKTTAGKKPKAENRIPPGKSAGKEGGQGKRVIKKGKKSADTPKIYHLQGF

SEQ ID NO: 61446 - DNA, 796 bp, Zea mays
  misc_feature: Ceres CLONE 1523906
  misc_feature: Pfam Name: Metallothio_PEC Pfam Description: Plant PEC family metallothionein
gaggcgcggcggggggggggggggggggggggggggcccctgtgttcctcttgtggtgattcaaaactggaactccaccgcggtggcggccgctctagaactagtggatcccccgggctgcaggaattcgtctcacccctagaaaaaagcagcgctacttgtgctcccccaacgctactaccgccgctagctggttcaagtgcggcgagcggagccggagaccggtagaggaaattaagaggcgtcgatcgggcatggggtgcgacgacaagtgcggggtgcgccgtgccgtgccccggcggcaaagaatgcatgtgcacgtcgggggaacggtcgtcattcgagaccacaagaatatgaggcgggcaggagaaagaactgcgtagagcggcgcgcggggcgaatgggggaaagggccacgcatgccgggccagacaacaaagaaaccaaaaaaggcctaaactgggtgcggggagggacaaaacgggcaatcatggctcgcatacatattggcccacaatccttggatcaaaaggcggcgtcgccccaccgatgcctatcccgcacactcacctcacaaaaaggggaaatagacataacccgccgccgttgggggtgtctgggaacaaacccgagacacgggactcacattctagggtgggaggtacgccacatcaggggattcaccaaatgggggcttgggtcttccaaacaataaaacaaaaaggatgtgagcctgacttctgggggaaccataactccctctcctatttggtgggggctccgttgttgtggg

SEQ ID NO: 61447 - DNA, 759 bp, Zea mays
  misc_feature: Ceres CLONE 1523911
  misc_feature: Encodes the peptide sequence at SEQ ID NO. 61448
  misc_feature (42)..(42): n is a, c, t, g, unknown, or other
  misc_feature (44)..(44): n is a, c, t, g, unknown, or other
  misc_feature (53)..(53): n is a, c, t, g, unknown, or other
  misc_feature (54)..(54): n is a, c, t, g, unknown, or other
taacacaaatggggggtactcggcgagcagttttatccaccnanaaacataannggacaaagctggggctccccgcggtggcggccgctctagaactagtggatcccccgggctgcaggaattcgtctcacccctagaaaaagcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcaaagctgagaaggcaaaccagttgaagcgatctcttcccccaggtttgaccggcaaggaggcctgattgggataaagggcagaccccgaagttgaagtacccaagccttccattatcggaagcaaaagatgctgactctatgtgactttgagggaacctgatcttgttgggccggtgcggtggtgaaactcccgggaccccgactttgtttgggggaccataataagtgtgtacgtggggaccggggaatcgatgaccctagagaggacggcggccgcaacgaggggttcacacaatgcggaccccgcatgagagcgagggccgggatgtagccacggcatggctcgtgctggggggcgcggggtgttgcttcggctgaacgttcgatgtgtgcat

SEQ ID NO: 61448 - protein, 69 aa, Zea mays
  misc_feature: Ceres CLONE 1523911
  misc_feature (2)..(69): Pfam Name: Ribosomal_L38e Pfam Description: Ribosomal L38e protein family
MPKQIHEIKDFLLTARRKDARSVKIKRSKDVVKFKVRCSKYLYTLCVFKAEKANQLKRSLPPGLTGKEA

SEQ ID NO: 61449 - DNA, 710 bp, Zea mays
  misc_feature: Ceres CLONE 1523912
  misc_feature: Encodes the peptide sequence at SEQ ID NO. 61450
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (88)..(88): n is a, c, t, g, unknown, or other
  misc_feature (89)..(89): n is a, c, t, g, unknown, or other
  misc_feature (112)..(112): n is a, c, t, g, unknown, or other
  misc_feature (115)..(115): n is a, c, t, g, unknown, or other
  misc_feature (116)..(116): n is a, c, t, g, unknown, or other
aaaaaaaaaaaaaaaaaaaaaaaatatgtttgttttnctccnnnnnggggggnnnnaaaaagggggggatcagcgtggtggaaggagnntccctctacacaatcccccgggntgnngtttccccctcacccctagaaaaaaaaaaagaagacgcccccgaatcagtgtccgcctcctgtcgctcgatctccctgtctcccgcacgccgacccgcagccgccgccgttcgccatgggtttcctcgacgcgctctaccgtgtggtgatgagccgaaacgccgtctacgataccttcggtcgtcgcggagctttcgcgggcgagcggggggtggaataaggagttaaaagatctgggaaatgaacgaacccagggaaaggggcaaagaaaaaagcagtgttgggggggaagacatctgcaaaactaaaaaggggggggggggggggaaaaacgaaacgagcaaacgaacccacccccaaaaagaacccgaaacagtgtccaaaacagagaaaaacccccatcaacataaacaaaatcttaagaaacatatattcggcgaaaaaacagacagcaccgaatacaaacccaaaaagcagcgacacaggaaaaaaaacgaagcgggaccatcaaaaagacgacatgcgaagagaaaaaatagacagaggccacagttgtaaaagaggcagggaaaaaaacaaaactagcgcaaaaac

SEQ ID NO: 61450 - protein, 34 aa, Zea mays
  misc_feature: Ceres CLONE 1523912
MGFLDALYRVVMSRNAVYDTFGRRGAFAGERGVE

SEQ ID NO: 61451 - DNA, 681 bp, Zea mays
  misc_feature: Ceres CLONE 1523923
  misc_feature: Translation starting site: 167
  misc_feature: Pfam Name: TFIIS_C Pfam Description: Transcription factor S-II (TFIIS)
  misc_feature: SWISSPROT Homolog: EC 2.7.7.6 DNA-directed RNA polymerase
  misc_feature (439)..(439): n is a, c, t, g, unknown, or other
  misc_feature (461)..(461): n is a, c, t, g, unknown, or other
aaagctggagctccccgcggtggcggccgctctagaactagtggatcccccgggctgcaggaattcctctcacccctagaaaaaacgaagcagccagacgacgggcaggtagcaccggggtcaacgcggcagacaaacaggctctcccgctcgtcagctagcagccatgagtaccatgaagttttgccgtgaatgcaacaacatcctgtaccccaaggaggaccgggagcagaaggtgctcctctacgcctgccggaactgcgaccaccaggaggtcgcggacaacaactgcgtgtaccggaacgtggtgcaccacagcgccggggagttcacccaggtgctccaggacgtggccggcgaccccacgctgccccgcaccaagtccgtgcgctgctcctcctgcggccacggcgaggccgtcttcttccagccactgccnaagaggggaggaagggatgacnctcttcttcgtctgctgcaccccgagctgcggcaaccgttgggagagaataatggacggttccttcaggcgcaacagcccaggacgacatgatttttttttgcaagatttttcattccgacaaaccttgtctgctccccccccattatgagccatgtccaactgaattggaattgggatttggattgggaattgtaacatactaatggtctcccaatggg

SEQ ID NO: 61452 - DNA, 617 bp, Zea mays
  misc_feature: Ceres CLONE 1523930
  misc_feature: Encodes the peptide sequence at SEQ ID NO. 61453
ggagctccccgcggtggcggccgctctagaactagtggatcccccgggctgcaggaattcgtctcacccctagaaaaactagaaaaatagaaaaatttaatacgatgtatgctttatattgcaaatttgttctgttctttagtcaattcaacctttcttttgtttctcataagctcacaattgatggatacaaattccagggcatacttgggtcactaccagaggggtttgatcgctattttgctagccgatttccaaagttgctaattgaggtgtacaaagtcttgtgggtgcactgcaaggacgaggaagctttcagtaaatatttcaaaggaagttagttatagctggagaggattgtcctttcctactgtacatactaaccctgatgtagaacaagtacatgtgtaccatatgactcgtattataggataaaaaagagctcaatctgtacattatgcaaaaaaaaaaaaaaaaacgagacgctcgaggtacccaattcgccctatagtgagtcgtattacgcgcgctcactggccgtcgttttacaacgtcgtgactgggaataccctggcgttacccaacttaatcgccttgcagcacatccccctttcgcc

SEQ ID NO: 61453 - protein, 78 aa, Zea mays
  misc_feature: Ceres CLONE 1523930
  misc_feature (15)..(77): Pfam Name: Ribonuc_2-5A Pfam Description: Ribonuclease 2-5A
  misc_feature: SWISSPROT Homolog: EC 2.7.11.1 Non-specific serine/threonine protein kinase
MYALYCKFVLFFSQFNLSFVSHKLTIDGYKFQGILGSLPEGFDRYFASRFPKLLIEVYKVLWVHCKDEEAFSKYFKGS

SEQ ID NO: 61454 - DNA, 800 bp, Zea mays
  misc_feature: Ceres CLONE 1523939
  misc_feature (47)..(47): n is a, c, t, g, unknown, or other
aaaaaaaaaaattttaaatccggcgggcgtatattgtggggcgcccnaaacaaccccaccacaaaaaaaaaaattcacgtagatggggaaaagattttcccctataagacccccgggctgcaggatttcctctcacccctggaaaaagaaattttaagagtctttagaattgtcgtgccaccataagtatcccctgtgttttacttcttcgggatttaggcaaacctggccaaacatcccatgtggtggctgtggttgattttgtaaactcataccttgatatggcatcaatgatttaattcagacattttttttcaagcatatgcttgccaatgtaataaaaaaaacctcttttaaaaaaaaaaaccggatggttcctttaaaccaaattaaaaaaacctcctttgtttgattcgcaataattacttacacacccgggaataaaaaagagggggtaaaaaaaaaaggtctgacccgcaccccccccccaaatgaccccaatcccccccaatatacgctaaggtagaatttaaccccccgccttctcctttggtcaatacggtattatagcaagggacgcaaacccacgcgtaaaaaccaacatgcgctttatgcggacctataattactccacttttgtggtaacatatacacacgttttactctcgacccttgccccctaatatatctatctccaatctctacatctgcaaaaataaactacttatccagaaggtgttattgcaaccgtccctatatgtctacataaaagcggagaccttctggttagtcaccatatt

SEQ ID NO: 61455 - DNA, 737 bp, Zea mays
  misc_feature: Ceres CLONE 1523945
  misc_feature: Encodes the peptide sequence at SEQ ID NO. 61456
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (737)..(737): n is a, c, t, g, unknown, or other
ccccattggttttgtatggatgtatatcctcacaccnccgcnngnngggggannnnnnnnntatactggtactccccgcggtggcggccgctctagaactagtggatcccccgggctgcaggaattcgtctcacccctagaaaaccgtggcctcgtctccttccccacttcggcctcggcagttccgacttccgcgtgccggccggagcctcgtcccgcttcgcatctcgcacttcgcgccttcgccgctgcgattccttagcagctcctcggccgctccacccacccctgcgccggcgagatggagctcaagcccggcatgtcggcgctcgtcaccggcggcgcctccggcatcgggaaagcactttgtattgcttttgcaaggaggggtttatttgagactgtcgttgatttctcttaccccaccggaagagaggggggggggttagttcaaaaaaaaaaaaaaaaaccagacggttgggggttccctattccgccctatactagagccgtatttaaggcccgcctcctggcccgtcccttctaaaccgtccgggactcggggaaaacccccggccgtttcccccaactttaattcgcctctggcagctacatccccccccttttccctccggcttgggcgttaaaacccggaaaaaaggccccccaccccgtaattgcccccttcccccaagaaagattactccctacccttggtacggggccaaatctggcgn

SEQ ID NO: 61456 - protein, 81 aa, Zea mays
  misc_feature: Ceres CLONE 1523945
MELKPGMSALVTGGASGIGKALCIAFARRGLFETVVDFSYPTGREGGGLVQKKKKKPDGWGFPIPPYTRAVFKARLLARPF

SEQ ID NO: 61457 - DNA, 576 bp, Zea mays
  misc_feature: Ceres CLONE 1523948
  misc_feature: SWISSPROT Homolog: EC 3.2.1.23 Beta-galactosidase
  misc_feature (356)..(356): n is a, c, t, g, unknown, or other
aaagctggagctccccgcggtggcggccgctctagaactagtggatcccccgggctgcaggaattcgtctcacccctagaaaaactgaaaagatcgacaaggtcagtgatgagattgatgctgctgtggagccggtcatcgcggagcttgaaaaggaactcgatcagagcacaacctcagacgatggagttgacacaaagaattgatcaacttcatgttaggtgtgctcttcattgtacatagcgtgtgtactgttgtttttctctctctctctcctctttggagaaactgcttgtacatatgtatgtatggaccatgaagaatattggtactctatcaagtgactatccataaantaatacacgttggcggttggcctgtgaaaaaaaaaaaaaaaacgagacgctcgaggtaccccattcgcctatagtgagtcgtattacgcgccgctcactggccgtcctttttacacgtcgtgactgggaaaaccctggccttacccaacttaatcgccttggagaaaatccccttttcccaggtgggggaataacgaaaaagcccccccccgatccccct

SEQ ID NO: 61458 - DNA, 653 bp, Zea mays
  misc_feature: Ceres CLONE 1523949
  misc_feature (205)..(205): n is a, c, t, g, unknown, or other
  misc_feature (206)..(206): n is a, c, t, g, unknown, or other
  misc_feature (212)..(212): n is a, c, t, g, unknown, or other
  misc_feature (214)..(214): n is a, c, t, g, unknown, or other
  misc_feature (216)..(216): n is a, c, t, g, unknown, or other
  misc_feature (217)..(217): n is a, c, t, g, unknown, or other
  misc_feature (219)..(219): n is a, c, t, g, unknown, or other
  misc_feature (220)..(220): n is a, c, t, g, unknown, or other
  misc_feature (222)..(222): n is a, c, t, g, unknown, or other
  misc_feature (223)..(223): n is a, c, t, g, unknown, or other
  misc_feature (227)..(227): n is a, c, t, g, unknown, or other
  misc_feature (228)..(228): n is a, c, t, g, unknown, or other
  misc_feature (231)..(231): n is a, c, t, g, unknown, or other
  misc_feature (232)..(232): n is a, c, t, g, unknown, or other
  misc_feature (235)..(235): n is a, c, t, g, unknown, or other
  misc_feature (260)..(260): n is a, c, t, g, unknown, or other
  misc_feature (274)..(274): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (282)..(282): n is a, c, t, g, unknown, or other
  misc_feature (653)..(653): n is a, c, t, g, unknown, or other
tggagctccccgcggtggcggccgctctagaactagtggatcccccgggctgcaggaattcgtctcacccctagaaaaaactcatagaatggcagaggcaaatagagctcttgcacattttcgttaatccatgaacagaatctaggtatgtagacacatggatccatacatctcgatcggaaaagaatcaatagaaggagaatcnnggacgnantnnanntnncccnnttnnttnttttttttttccccggggaaaaaanaccccagggggaanaannnaanaagaaaaaaaaaagaaaagaacaataaaaaaaaaaacccccccggaaaaaggaaaacccgcccctttctccggaaagagggggggggacaccccccccccaaaaattttttttccggggccccccccccctcttaataaaaaaaagggtgggagggaaagccccccccgaaaattttttaaaacacccgcgggccggcgcccccccctacaccccggggggggggggcccgcccgacaccccccaaatattttttttttttttttacaacaaaaaaaaccacacacctccccccctttacgagggaaggaagtcccgcgggggggggggggagaaaaaaaaaaaaaaaaaaacccccccccgcccgctggn

SEQ ID NO: 61459 - DNA, 661 bp, Zea mays
  misc_feature: Ceres CLONE 1523952
  misc_feature (661)..(661): n is a, c, t, g, unknown, or other
atagctggagctcaccgcggtggcggccgctctagaactagtggatcccccgggctgcaggaattcctctaacccctagaaaaatacttatttatagaactgcgcacacctaatcttccgtcgaggagccgaacggggatgtatacggccatggaaaaggctaaggtggccatagtcgaaaggtgcggatgagcacgtgttgttggtaatgagacacacgttgtatcgagcaagcgcttcctgtgcggggtggctctttttaatggggggtatcaatttatttgcgaggaaataatgatgactaatttgaggcggcatcaggacagacataggtggcatgggatgggagttcttgcatatttctgtggccacgcattcacgctaaataaaaggaaagtgttatatcgtgctgtcaagttgatatattgtggcagacaggttaagattatggaggcaatattttgacaagctactcatatcactccccctttgacctcctgtaggagaatgaaagaaatgtggtacttctaccctgccatagagttgacgtctcacctcgtgctttggaaatagaaaagcgttaaatccttcaaataccccgattccctctatagtgaactcaaattaattctttatacccaggacgcccaaaataacaacn

SEQ ID NO: 61460 - DNA, 600 bp, Zea mays
  misc_feature: Ceres CLONE 1523953
  misc_feature (340)..(340): n is a, c, t, g, unknown, or other
tggagctccaccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgaccacgaggcgccgtcnacgagtcgggttgtttgggaatgcagcccaaatcggggcgtaaactccgtcccaaggctaaatacaggccggagagaccgatagcgaaacagtacggccgaggaaagatgaaaaaaaaaaaaaaaacaagacgctccgaggacccaattccccctaaaggggagcctattacccccgcctccctgggccgccgttttacaaacgccttgactggggaaaccccctgggctttccccaaacttaaaccccctttggagaag

SEQ ID NO: 61461 - DNA, 667 bp, Zea mays
  misc_feature: Ceres CLONE 1523954
  misc_feature: Encodes the peptide sequence at SEQ ID NO. 61462
aagctggagctccccgcggtggcggccgctctagaactagtggatcccccgggctgcaggaattcgtctcacccctagaaaaaatcaccacccgcaccacacacgagcatacgcgacgactgacaaggcgaggggagcactcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggatggacatgatgaccactctcatggtcatggacacgggcatgaggcatcatcatcgtcatcttcacattaagttccttactggctgcggacgatgcttggcatgttccaacagctaaagtttgagttaataaattctatcaccctgcatgggactcatgttgtttgcaactggtttaacaacaaactggtcttggttactattggcgctaatgaaatttgttttccaaattttcagttaaccaaaaaaaaaaaaaaaaaaccaagaccgctccgaaggtaccccaatttccccccctaaaacgggggggctcgaatttacccgcggggcctaatacgtgggggccg

SEQ ID NO: 61462 - protein, 80 aa, Zea mays
  misc_feature: Ceres CLONE 1523954
MGGGGAHGGTTYKGYTIPHNKRWHTVAGKGLCAVMWFWVFYRAKQDGATLLGLRHPWDGHDDHSHGHGHGHEASSSSSSH

SEQ ID NO: 61463 - DNA, 631 bp, Zea mays
  misc_feature: Ceres CLONE 1523956
  misc_feature: Encodes the peptide sequence at SEQ ID NO. 61464
  misc_feature (278)..(278): n is a, c, t, g, unknown, or other
agtggatcccccgggctgcaggaattcgtctcacccctagaaaaaggaaacctaggctttctactctctcagccgaaaactctggccggcggcttccttctgtctcagccgcctgggagctgtggcactgccgaccgcacctccctcttccttttttttctgccgctcactttcgttcgtccgccaggaagcaccagcggctggctctggccgactgcgccctgcacagagccacacagccgcccactctctatttgctttctgttttttttattcgnttctacttgccgcatggacatttctgtatgcacttgggtgcatggccacctcaggaaggattggtgtccctttttttttatttcatttccccccccgccgaaatggtatgcctggtagggaatggaataatgggggaatgggggaatccaaaaaaaaaaaaaaaaaacgaagaacgctcgaaggtacccaaattcccccctaaaaggggagcgggaattaaggcgccgcccactgggcccgggcggttttaaaaccggccgggaccgggggaaaaacccctgggggtttccccaagctttaaaccccctttgggagaaaatccccccttttccgccaagtgggggggaataaa

SEQ ID NO: 61464 - protein, 175 aa, Zea mays
  misc_feature: Ceres CLONE 1523956
WIPRAAGIRLTPRKRKPRLSTLSAENSGRRLPSVSAAWELWHCRPHLPLPFFSAAHFRSSARKHQRLALADCALHRATQPPTLYLLSVFFIRFYLPHGHFCMHLGAWPPQEGLVSLFFYFISPPAEMVCLVGNGIMGEWGNPKKKKKNEERSKVPKFPPKRGAGIKAPPTGPGRF

SEQ ID NO: 61465 - DNA, 715 bp, Zea mays
  misc_feature: Ceres CLONE 1523961
  misc_feature: Encodes the peptide sequence at SEQ ID NO. 61466
ccatgctggagctcaccgcggtggcggccgctctagaactagtggatccctcgggctgcaggaattcccctaactccgagaaaaaacaaccccgtaaaaaactgcagacacaactctgatatcccagctgaatgaaggcaacactgataaaacatttcttgcatcagtggttccagcccattgctgggagcattatcgatgcgttcgtcataaaattagatttgtacagttgtggcggttgtgctgtgatgatgttggttcgtgtatgtatatgactgtatatatatgtttgtgctaatactactgctgcggcctgtatatttggccagttgacgacttgtcaccggttgtggtcagaagtttattatcaccgcttcaaaaagggggggggaggacaagaccctccacttacccaattttggcttataacgagtccaaataaacccccgctcccttggccgtcggttttacaaacctccctgactggggaaaacccctggcggttaccccaacttaaaatccccttgaagctacatatccccctttttgccccccggccgttaacacccaaaaaggccccttaaccccatactccctccccaaaaaacccccccctttttccccccttgggcgatttgtgaaaattttacgccgtttaatcaccctcgttgtaaacaatccgcccgcctagtgtccttgggtacacccccgcccc

SEQ ID NO: 61466 - protein, 47 aa, Zea mays
  misc_feature: Ceres CLONE 1523961
MKATLIKHFLHQWFQPIAGSIIDAFVIKLDLYSCGGCAVMMLVRVCI

SEQ ID NO: 61467 - DNA, 877 bp, Zea mays
  misc_feature: Ceres CLONE 1523962
  misc_feature (12)..(12): n is a, c, t, g, unknown, or other
  misc_feature (13)..(13): n is a, c, t, g, unknown, or other
  misc_feature (22)..(22): n is a, c, t, g, unknown, or other
  misc_feature (24)..(24): n is a, c, t, g, unknown, or other
  misc_feature (27)..(27): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
  misc_feature (877)..(877): n is a, c, t, g, unknown, or other
tttctttttttnnctttttttntnctnctgcttcanaannnntaaacctnnaaaaaaaatggtgatcaccacggagggggccgctctagactagtggatcccccgggctgcaggaattcctctcccccccggaataattaatctgtttccattgaacagaccaaaatatgctcactaaatataaaaaacaaatgtatctgggattttttttattccctaagttagattcattatctaatccgatatatagaattcccttccatatggaactggatttcatatctagttctatgccccatactgttatccattggatatctcgatcccactcccactggacctggacccaggttgagtttaaaaccgggccctttctttgtaaccccgggcaccccatatcccccaggactgaaccccgaattttttttccccaccccccctgagaggcgggggggggggggcccctattccccccccaccctaattttgcccttctgtttttcgcccttctctgacatagtgtacgaccgttagtgtgctttcttcacgcccgccgtgatctacacccctttcccctaaactctcggactgtttagccccccctcgaaccgcgctagctcctccgaataacccgccaacacaatctcctctatctattcacccccacaatacgcaaaccacagactccctgccatcctccctcatcgtgtgtcggtataccccctcctgcgccgtttcaatctttaccgtgtaatcgctggaaagcttgtcggggagcaccctactgccggtttgtcccgccgccccatttccccccccgccatccaccccatatagccccgttcttatatttcccaccgcgccctttttccccccn

SEQ ID NO: 61468 - DNA, 695 bp, Zea mays
  misc_feature: Ceres CLONE 1523964
aaagctggagctccccgcggtggcggccgctctagaactagtggatcccccgggctgcaggaattcccctaaccccgggaaaaattacaaccagcagacctggcagaaaaagggcataatgttttgagtttgggtgctgtgagtttgatatccccttgttcgttttggactcgcaataaaacttttttgagttatcgtatttatgactgggaagtgcctttctgagtttcattttcagaatttaatgaaaggcctttgtggttgcaaaacggtggtgtaattgtgctttaaattgttcatccaatgataaacttcatgaacaactccaaaaaaaaaaaaaaaaacgagacgctcgaggtacccaattccccctatagtgaggcggatgacgcgcgctcactgggccgtcgtttttaaaacgtcgtgaccgggaaaaccctgggcgtaccccaactgaatcgccctgcagcccatcccccctttcgccagctgggggaatatccgaaaaggcccccaatcaatcggcccttcccaaaaaggttggcgccatcttgaagggggaaatggcaatatgcccccgtcccaccattttgccccacaattcccccgccaaatttcttgcttcaatcctggccccctttttttcaccctaatagatctcgaaaccccggttaaaacttccttccctaaaaccc

SEQ ID NO: 61469 - DNA, 790 bp, Zea mays
  misc_feature: Ceres CLONE 1523972
aaagctggagctccccgcggtggcggccgctctattatactagtggatcccccgggctgcaggaattcctctcacccctagaaaaagctgcgattccgcagtagttatagcgtgcgctacaatggcaataactagtcgaggagcacttctgtagctgtaactgtaaggagaggagcgatagagagagcagtcgaggggagtacaatctcctcattgacaagtgcaacagaaaagctggaattttggtagaagagcttggtgataatgatcattggactctttactggcggtgaccaccaacaagaaaaaaaaacactccccgcttgtttttccctcttagttttgcccatagagtgaggcggggggtttttttttcccccccctacaagggggggggggagggccgcccccccccacgtgacccccacctttggacccaatacgcagatgcctaaaaaacccctgcagtccccgtgccccgtttttctcgccaaactcgcgtctgccgttccgtggggatataaccctcagcgggccctttctcacgcctaccacagcgccccttttgcaccgcaccaacccccctttttccccgcccgccccgctgtgtctcacccccctccccctaccctattacgcccccacgtttcgccctccctattcctccccctctctgactttccccctcgttccccgctccctccgcctacttcccccccgattactttttcccttttgtttattttcctaccccccccttatttccccctactcttccacctctcccccc

SEQ ID NO: 61470 - DNA, 710 bp, Zea mays
  misc_feature: Ceres CLONE 1523982
  misc_feature: SWISSPROT Homolog: EC 3.2.1.23 Beta-galactosidase
ccatgctggagctccccgcggtggcggccgctctagactagtggatcccccgggctgcaggaattcgtctcacccctagaaaaagccatgcccgcgagcgctgctgtttcccgtgtcgtgttcgtacctgcgtgggagctatagatgcactcgtgttgtgtgtataaatcattctgtatataaacttcacttgtaatgttgatgttgttgtcatggcgtccagcgtctcaattcttcgttcagttgcagagtgggtttgttgtaaaaaaaaaaaaaaaaacgagactctcgacgtacccaattcgccctatagtgagtcgtattacgcgcgctcactggccgtcgttttacaacgtcgtgtctgggacacccctggcgtgagggaggggagtccccttgcaacacatcccccttttcgcagctggcgaaataacgaaaaggcccccaccgatccgcctttcccaaagtttgcccagcctgaatggcaaaatggaaatttgaaacccctaaaaactttcgttaaaatcccccgtttaaacttctccctaaatccccccccttttttgtttaaccaaataggtcccaaacctgtgtacaaaccccttttattacattctaaaccattataacctctaaattcccgcgcttttatctccttattttccccgcttcgccccaccagaaacgccctcctattctctcaccgacac

SEQ ID NO: 61471 - DNA, 665 bp, Zea mays
  misc_feature: Ceres CLONE 1524030
  misc_feature: Translation starting site: 161
aagctggagctccccgcggtggcggccgctctagaactagtggatcccccgggctgcaggaattcgtctcacccctagaaaaaagtcgtcctcgtttcgcgtccgcctcaacccgccgcaaggggaggtaagttcatgaaacaccttccagtaagctgaaatggctcctaaagctgctcctgccaagaagggtgatgccaagacccaggccttgaaggttgccaaggctgtgaagtctggggcagccaacaagaccaagaagatccgcacatctgtgacatttcaccgccccacgaccctgaacaaggctagcgacccccactacccacgaatcagcactacctgaacgaacaagcttgatcagaaccaacattctcaagtacccccttaccacagaatcagcgatgaatactattgaagataacaccactctggtcttcattgttgacctccaggcacaccagacgaagatcaaggctgccgtccacaagatgtatgacatccaaccaaagaaagtcaacaccttgatcatgcctgatcggaagaataaagcttacctgaaactgactcccaactatgatgctcttgatgtgaccaacagaattggcatcatctaaatgctgcattaggcatctgcttgtctcctagctcatctgttgcgtcct

SEQ ID NO: 61472 - DNA, 484 bp, Zea mays
  misc_feature: Ceres CLONE 1524032
  misc_feature: Encodes the peptide sequence at SEQ ID NO. 61473
ctggagctccccgcggtggcggccgctctagaactagtggatcccccgggctgcaggaattcgtctcacccctagaaaaaactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcagggatcacctgcatgacgtttcccgggactggctgcggagggactgagcgtcatcggcttcggctctcggctggagggccgtcagcgtccggcatcacggcacagctcacgggctcttctctcagcatcggccagagtggccacttcccacgccccgcccgtaactccagttctggctgtgctagggacatgcacctgggcttgtcatcgtgctcaccttcggcagattggattcaagggc

SEQ ID NO: 61473 - protein, 62 aa, Zea mays
  misc_feature: Ceres CLONE 1524032
MAASASTVSGLAGASLASRPAFSTSFTRGSRVSARNPLMSRNLERNGRDHLHDVSRDWLRRD

SEQ ID NO: 61474 - DNA, 680 bp, Zea mays
  misc_feature: Ceres CLONE 1524033
  misc_feature: Encodes the peptide sequence at SEQ ID NO. 61475
aaagctggagctccccgcggtggcggccgctctagaactagtggatcccccgggctgcaggaattcgtctcacccctagaaaaaccccacctccatccagcttgagccagcccgtcgcctgcgcgcatctctctacacttctactgcttcatactctcgtagagagatccccgcggcccaataaaaacccgactcgctagctgcactacacactcgcagatggccggcctcaggatgaagttcgtcgccgtcgccgccatggccgccgcgctcgtggcgtccgccgcagccgccgaggcccccgccccggcccccgcctccgacgccgcggccgccgtgcccctcgccgcggcctccctcgccgccgccgccttcgggtagggggtgtgctagatccgcgctggacgcgtggtttgtgcttgatttgtgattcgtctggcgcgagtggagtccgtgtcgtgcgcgtgtctgtgtgagttgtttcggccgggcgtgtgtctgtatgtatggagtccggcggcggacggaggtgtgcccgtggtaggaacgtgccttcaaccctcccttgtttgtggcgggcaattatgttgccttggcccggttttccgggtttccaaagggagaggaatttaatttgaattccctttccccccctggaagaaaaaaaaaaaaaaaaagcg

SEQ ID NO: 61475 - protein, 53 aa, Zea mays
  misc_feature: Ceres CLONE 1524033
MAGLRMKFVAVAAMAAALVASAAAAEAPAPAPASDAAAAVPLAAASLAAAAFG

SEQ ID NO: 61476 - DNA, 659 bp, Zea mays
  misc_feature: Ceres CLONE 1524034
  misc_feature: Encodes the peptide sequence at SEQ ID NO. 61477
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
aagctggagctccccgcggtggcggccgctctagaactagtggatcccccgggctgcaggaattcgtctcacccctagaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttccctggatgtcatttgattaattataagcaagtacgtgaagaaacgagggccagacgactgtcgtccagcgattggttatttgtgaacttgtcgtttgtcttcttatttcaactttccaataagccccttcgtgaagtgtatccccttcaaagtctgtcgactgttacgtatacaaatctatatatcaaataaagacggcgccgtacgtgtgtnnnnnnaannnnnnnnnnnnnnnnnnnnnnnnnnnnnnnnnnnnnnnnnnnnnnnnnnnnnnnntnnn

SEQ ID NO: 61477 - protein, 90 aa, Zea mays; identical to SEQ ID NO: 53771
  misc_feature: Ceres CLONE 1524034

SEQ ID NO: 61478 - DNA, 693 bp, Zea mays
  misc_feature: Ceres CLONE 1524036
  misc_feature: Encodes the peptide sequence at SEQ ID NO. 61479
atagctggagctccccgcggtggcggccgctctagaactagtggatcccccgggctgcaggaattcgtctcacccctagaaaaagtctattttgtagtcctcgacttcccaatgtgtgggttgcaggattgggtccgatcagtggagaattcatcatgatgacatgttgcgaggagatggaggcaggtcagtcttctgtcagatccggcggttcattgattttgtcgattggacatggattggtggtttcaggctcaaatgtctccgggtgtggtaccaccagaaccttcgatccattcttactttaacggcagagaagaaagggtccttgctggttacagggagaggtttgcttatggttcattccttgtttttggttttgatgttgtcatattggtgtgaagatcgccaccgcacttactataagcttctttacccttcattggaaatgctgctggctggatcttcaggggcaaccgagttttggaagtagattgaggcattgattggaccggtatattgggaagaagatcgtcccgatatacatacctaaattcacttttggaattggttcatctttcagttttttggcccgctgccaattccttaaatttccttatattggcgggctgggtggttttttttctcccgcaataatatatttttggattaaattgaaatgggtttggcaag

SEQ ID NO: 61479 - protein, 52 aa, Zea mays
  misc_feature: Ceres CLONE 1524036
IAGAPRGGGRSRTSGSPGLQEFVSPLEKVYFVVLDFPMCGLQDWVRSVENSS

SEQ ID NO: 61480 - DNA, 678 bp, Zea mays
  misc_feature: Ceres CLONE 1524037
  misc_feature: Encodes the peptide sequence at SEQ ID NO. 61481
aagctggagctccccgcggtggcggccgctctagaactagtggatcccccgggctgcaggaattcgtctcacccctagaaaaaagatagaaacgggagggaacacccactcgatcgtcagccatgacccggggagagaaccaggagtcgcaaaccggtaacgtccccgccgcatccgcggcgacgccggggccgaagccggcgtcggcggggggcgggaaaggcgcggagggccagtctgtggtgcggcggctgcagtcggagctgatggcgctgatgatgggcggcgacccgggcgtgtcggcgtttcccgagggggacaacatgctccactgggtgggcaccatcgacggctccgccgggacggcctacgagggcacctcctaccgcctcgcgttggccttcaccaccgagtacccgtacaagccgcccaaggtgcggttcgacaccccctgcttccactctaacgtcgacgtgcacggcaacatctgccatgacatcctccaggacaagtgggtcctccgcctacgacgtgcgcaccattctccctctccatccagagcctgcttgggagaagccgaacaacgacttgccgctttaaaactcaagcgggcaacgccttttgggcgaaaccaggaaaaaattttaggaaagatgggtgggaaaaaaatcttccagc

SEQ ID NO: 61481 - protein, 185 aa, Zea mays
  misc_feature: Ceres CLONE 1524037
  misc_feature (43)..(165): Pfam Name: UQ_con Pfam Description: Ubiquitin-conjugating enzyme
  misc_feature: SWISSPROT Homolog: EC 6.3.2.19 Ubiquitin--protein ligase
MTRGENQESQTGNVPAASAATPGPKPASAGGGKGAEGQSVVRRLQSELMALMMGGDPGVSAFPEGDNMLHWVGTIDGSAGTAYEGTSYRLALAFTTEYPYKPPKVRFDTPCFHSNVDVHGNICHDILQDKWVLRLRRAHHSPSPSRACLGEAEQRLAALKLKRATPFGRNQEKILGKMGGKKIFQ

SEQ ID NO: 61482 - DNA, 655 bp, Zea mays
  misc_feature: Ceres CLONE 1524047
  misc_feature: Encodes the peptide sequence at SEQ ID NO. 61483
aagctggagctccccgcggtggcggccgctctagaactagtggatcccccgggctgcaggaattcgtctcacccctagaaaaaagcctccgcccatacacacacagccccatcccgccgccgcaggcgagaaccagcgccaccttaggttagggcggccgccgccggagaagtgcgcggttgccaagatgcagatcttcgtgaagaccctgacggggaagaccatcacgctggaggtggagtcctcggacaccatcgacaacgtgaaggccaagatccaggacaaggagggcatcccgccggaccagcagcgcctcatcttcgccggcaagcagctcgaggatggccgcaccctcgccgactacaacatccagaaggagtcgacgctgcacctggtgctccgcctcaggggaggcgccaagaagcgcaagaagaagacgtacaccaagcccaagaagatcaagcacaagcacaagaaggtgaagctcgccgtgctccagttctacaaggttgacgacgccaccggcaaggtcacccgcctccgcaaggagtgccccaacgccgagtgcggcgcgggggtcttcatggccaaccacttcgaccgccactactgcggtaagtgtggcctcacctacgtctacaaccagcaagcgtag

SEQ ID NO: 61483 - protein, 155 aa, Zea mays; identical to SEQ ID NO: 61133
  misc_feature: Ceres CLONE 1524047
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a

SEQ ID NO: 61484 - DNA, 659 bp, Zea mays
  misc_feature: Ceres CLONE 1524050
  misc_feature: Encodes the peptide sequence at SEQ ID NO. 61485
  misc_feature (659)..(659): n is a, c, t, g, unknown, or other
ctatgctggagctccccgcggtggcggccgctctataactagtggatcccccgggctgcaggaattcgtctcacccctagaaaaaattccttcactgccagtcttgcatcccgtccccgtccgcgccggccgacgccgccttttcgtccccgcgtcagcgtcgcggctccactgagcgtgcgtgtcaccggcgggaggcaagggcaggcggtggtggcgatggcgtccgctgacgcgcgcttggcggggatcgcctcctccatccgcgtcatccccgacttccccaagccagggatcatgttccaggacatcacgacgttgctgctcgatcccaaggcgttccgtgacaccatcgacctctttgtccagcggtacaaggaccgagggatcaccgtggttgctggtgttcaacctacacggttcatttttggtcctcctatcgctttagccattggcgcaaaatttgtgcctttgaggaagccgaaaaagttgccaggcgaggtgatctccgaagaagattctttggaatatggaactgaccagatagaaatgcctgtccgagctgtaccaggccaagaccgggtgtcttgtagttccaagaaccttattggctaccggggggaaaccctatgtggccagctttccaaacttacttggan

SEQ ID NO: 61485 - protein, 146 aa, Zea mays
  misc_feature: Ceres CLONE 1524050
  misc_feature (30)..(142): Pfam Name: Pribosyltran Pfam Description: Phosphoribosyl transferase domain
  misc_feature: SWISSPROT Homolog: EC 2.4.2.7 Adenine phosphoribosyltransferase
MASADARLAGIASSIRVIPDFPKPGIMFQDITTLLLDPKAFRDTIDLFVQRYKDRGITVVAGVQPTRFIFGPPIALAIGAKFVPLRKPKKLPGEVISEEDSLEYGTDQIEMPVRAVPGQDRVSCSSKNLIGYRGETLCGQLSKLTW

SEQ ID NO: 61486 - DNA, 665 bp, Zea mays
  misc_feature: Ceres CLONE 1524054
ggagctccccgcggtggcggccgctctagaactagtggatcccccgggctgcaggaattcgtctcacccctagaaaaatctccacagcaaccagcacacatttccctttggcggatccaacgaaggaaggaaggaggagatgggtggcggcatggaggtgcacaaaaaccggtggatcgaatagtggaacgccggccgcgagaacctcgagttcaatttcagctggacccagccgcagcctcgccgtcgtcgagcctcttcggactcgctgtcccgcatcctcgtctacaagggcatcgtccgcaaattccctatgccggacgaggatgcagggcggccatacaggaagttcctgtaagcggcgtccagggtcgcaggagacgtccatccctcgatcggggctgcgaggaggggagtttccattcagatttgtgtcggtattgttttagtctgaattctgatggagcagtttggaatgctgaatctattgtgcctgcatctcaatgcatagcgtgtaatgactcgatcttttccacttactgaaattgatacatgtttcgacactacaaaaaaaaaatattgaagacacttcgggggaacccttatttcggccccataagtgaagtccgaattaaggccgcgcttcagctgggcccgtttgtttt

SEQ ID NO: 61487 - DNA, 626 bp, Zea mays
  misc_feature: Ceres CLONE 1524055
  misc_feature (27)..(27): n is a, c, t, g, unknown, or other
ggagctccccgtggtggcggccgctcnagtcccaaaggagccccgggctgcaggattccctctcacccctagaaaaagttcgtccctccgaatcagacggataatatcgtccttctcgggacaaggcacctcacgagcccttctcatccgcatcagatctagcgccgcctccttcatcccgctggccggcgagctcctcagcacggtgagtcccctttcccctctactctcctcttcccctatgctctcctcttcctccatcctgctgaccggcgagctgctcagcaaggtgcggtgagtcgcctatcctctgctctcattttcctcctttatcccgctagccggcgagctcttcagagccaggcgcggtgagttcctttccactctgctctcttcttcccctctgctttccctctaatcccctctgctctcttccgcgcggtgagcccggcgcggcgagctcttcccccataggctcgtgaccagcagacacatcaggatcaggctccatggacaacagctctccgaccccttcctgatgcctgatgcttggtgtagtcgtgtaggtgagagagggagagagccatgctacagccggccagcatcaaggaaaaagtcttgtcaat

SEQ ID NO: 61488 - DNA, 639 bp, Zea mays
  misc_feature: Ceres CLONE 1524058
  misc_feature: Encodes the peptide sequence at SEQ ID NO. 61489
aagctggagctccccgcggtggcggccgctctagaactagtggatcccccgggctgcaggaattcgtctcacccctagaaaaaaaaaaccctaatcgcatctgcttccagagccccccgccgccgctgcgccctcctctcggtcctgccgtccgtcaaggtaaaaggacagcatggtgagggtcagcgtgctcaatgatgctctcaagtccatgtacaatgctgaaaagatagaggaaacgtcaggtcatgatcaggccgtcatccaaggtgatcatcaagttcctgacggtcatgcagcgccatggctacattggcgagttccagtacgtggatgaccacagagctgggaagatcgtggtggagctgaatggaacactgaataaatgtggtgttattagcccacgttttgatgtaggtgttaaggacatcgagggatggacggcgaggcttcttccatctcgccagattggctacatcgtcctaacaacttctgctggaattatggaccatgaagaggcccgccgtaagaatgttggtggcaagcttctaggtttcttttattgaaaatgtgtttttttacccacagatgcgtccaaaaactcgtctgatgttttgaggtttgtaaacactgggtgtc

SEQ ID NO: 61489 - protein, 105 aa, Zea mays
  misc_feature: Ceres CLONE 1524058
  misc_feature (1)..(105): Pfam Name: Ribosomal_S8 Pfam Description: Ribosomal protein S8
MIRPSSKVIIKFLTVMQRHGYIGEFQYVDDHRAGKIVVELNGTLNKCGVISPRFDVGVKDIEGWTARLLPSRQIGYIVLTTSAGIMDHEEARRKNVGGKLLGFFY

SEQ ID NO: 61490 - DNA, 714 bp, Zea mays
  misc_feature: Ceres CLONE 1524062
  misc_feature: Encodes the peptide sequence at SEQ ID NO. 61491
caaagctggagctccccgcggtggcggccgctctagaactagtggatcccccgggctgcaggaattcgtctcacccctagaaaaaatccgccgcggctcgtctccgtctcccggctcctcggcgtctagctcgacaacgcgcgcgtgcgccgtcggctcctccgaccggagtcccaccacaggggaatgcagatagacgatccgctgggcttgcaaacatgtatatcccactgaagcgcaacaagagtacctacttcattcaatgtgaaccaacagagacagctttgagcatcaaacagaactcgcactcgctgatagatcaacctcctagcagtcagcagatggtcttgtggcctaccactgatgtgcttgaagactctaagacttttggagatcacaaggcggataacgattccattgttgcgttggcactaaaaaaaatgcccgcgagcttgacgaagttttcctcactcggccggaagatttcaggtcatcctctggatgaacattaagcgcatcatttccaccaaagggaccccctcgcccgcttctttggaagtggaccgcccgctcctatgcttgcttccttcctaaaatacttaaaataggggcttttgccttagatcacatattggggaagggcaacaataaaaaaattctgtttttacggtttgaggaccccctcagaacaaacccgcatctggttgggaatcc

SEQ ID NO: 61491 - protein, 97 aa, Zea mays
  misc_feature: Ceres CLONE 1524062
MYIPLKRNKSTYFIQCEPTETALSIKQNSHSLIDQPPSSQQMVLWPTTDVLEDSKTFGDHKADNDSIVALALKKMPASLTKFSSLGRKISGHPLDEH

SEQ ID NO: 61492 - DNA, 413 bp, Zea mays
  misc_feature: Ceres CLONE 1524065
aagctggactccccgcggtggcggccgctctagaactagtggatcccccgggctgcaggattcgtctcacccctagaaaaaagcttgcagcgccgcctggatcgagcagccgagcgactaagcgaagactcccttttccccgagcacaagtagaaccatgggcggcggcggcagtttacggcggcttcaaagggaagcttggcgtcgaggatgcccccgagctgcagtctcgaaacggtcttccgcatcacactctcatccaagacgtccagaactgaaaaagtttgtgccgatttgggtaaagggaccccaggggaacaacccttttttggggggttaagggggacctgtccccggaatccctcttttaagggtttttccccataccccccttttaaaaaatcccccccccg

SEQ ID NO: 61493 - DNA, 750 bp, Zea mays
  misc_feature: Ceres CLONE 1524075
  misc_feature: Encodes the peptide sequence at SEQ ID NO. 61494
acagctggagctcaccgcggtggcggccgctctagaactagtggatcccccgggctgcaggaattcgtctcacccctagaaaaaatcacaattcactccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggtcggatcgggcgctacctgaagaagggccggtacgcgcagtgcgtgggcactggggcccccgtccatctcggcgtttttttttgcactacctcggggggggggggggtgggaattcaccttggacttctttcgccccacccaaaataaaaccgcgcttcatccccaccccacccccctcctcgcgccccaccccccgccccacccaccccaaccaacctaccgccgacaggcatccccagcccgtcaagatcaacaggcacctcaccacacaaaggacgcacgccggcccccgggccaagattgcacgccgcccgcgcgtagggctcgtgtacgcgccgcggcttgcagggaacgagcccaccgcgcgatcggagagcagggggtgcaccaccccctcccaacggccatgagccaaaacgcgagaagtgcgaccctcaaaatcgttcactgtactcgcataccg

SEQ ID NO: 61494 - protein, 88 aa, Zea mays
  misc_feature: Ceres CLONE 1524075
MDASGAGSKGKKGAAGRKAGGPRKKSVTRSVKAGLQFPVGRIGRYLKKGRYAQCVGTGAPVHLGVFFCTTSGGGGVGIHLGLLSPHPK

SEQ ID NO: 61495 - DNA, 677 bp, Zea mays
  misc_feature: Ceres CLONE 1524079
  misc_feature: Encodes the peptide sequence at SEQ ID NO. 61496
catagctggagctccccgcggtggcggccgctctagaactagtggatcccccgggctgcaggaattcgtctcacccctagaaaaaaagcagagggagagcactcacctcaccaaaaccgctactcgagtctccctccattctactgccgcctacatccgcagctctacgagtctccagctctagctagccttaccctcgtccaagggacgaaggggccaccatgagcgtggtgatcctggacggctccacggtgcgcggcttcatgtcgcacgaggcagccttcgcgcgcagactgcacgcgcggatcgccgcgctggacaccaacggcgaccgcgtgctgtcccgagccgagctccagcacgcgctcgagtcctttcgcctcctcgacggcggctgcttccggtccgcacagccagcgccgctccccgccgaggtctccacgctctacaacgccgtctgcaaacagttgaacgcctaccactgaggctccgtcaaacgctgcgatgtccacgacgagatgccccgcatcatgctcgccgtcggctacgggctcggatcacagccgctccaggccgccttggacgatgaaggcgggagcttcctgctctaggtaacaaacacgaggccgctgggatcggcgctaagatcgaagctacccgcaggggccatgcggacg

SEQ ID NO: 61496 - protein, 87 aa, Zea mays
  misc_feature: Ceres CLONE 1524079
MSVVILDGSTVRGFMSHEAAFARRLHARIAALDTNGDRVLSRAELQHALESFRLLDGGCFRSAQPAPLPAEVSTLYNAVCKQLNAYH

SEQ ID NO: 61497 - DNA, 620 bp, Zea mays
  misc_feature: Ceres CLONE 1524082
  misc_feature: Encodes the peptide sequence at SEQ ID NO. 61498
  misc_feature (471)..(471): n is a, c, t, g, unknown, or other
  misc_feature (477)..(477): n is a, c, t, g, unknown, or other
  misc_feature (504)..(504): n is a, c, t, g, unknown, or other
  misc_feature (532)..(532): n is a, c, t, g, unknown, or other
  misc_feature (620)..(620): n is a, c, t, g, unknown, or other
aaagctggagctccccgcggtggcggccgctctagaactagtggatcccccgggctgcaggaattcgtctcacccctagaaaaagccgcaccctcccgcccaccgccgtcgccgcccagccgcagtaaggaggaaggagcaggaagatgccggcggggcacgggctgcggtcgcggagccgcgacctgttcgcgcggcccttccgcaagaaggggtacatcccgctcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccattggcgtcgagatcaacaagcaggttaacggtcgcatcatcaggaagcggatccatgtccgcgtggagcatgtgcagccctcccgttgcacagaggagttccgcctgaggnaagccnagaatgaccagctcaaggcggatgccnagggcccgcggtgaggtgatcagcaccnagaggcagcctggtgggacccaaacctggcttcatggtcgagggtgctacactcgagacagtcactcctattccttatgatggggccn

SEQ ID NO: 61498 - protein, 123 aa, Zea mays
  misc_feature: Ceres CLONE 1524082
  misc_feature (2)..(100): Pfam Name: Ribosomal_L21e Pfam Description: Ribosomal protein L21e
  misc_feature (109)..(109): Xaa is any aa, unknown, or other
  misc_feature (111)..(111): Xaa is any aa, unknown, or other
  misc_feature (120)..(120): Xaa is any aa, unknown, or other
MPAGHGLRSRSRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRXAXNDQLKADAXGPR

SEQ ID NO: 61499 - DNA, 651 bp, Zea mays
  misc_feature: Ceres CLONE 1524085
  misc_feature: Encodes the peptide sequence at SEQ ID NO. 61500
aaagctggagctccccgcggtggcggccgctctagaactagtggatcccccgggctgcaggaattcgtctcacccctagaaaaaactgacgagctcgccatggcctccctctcctctgccgccgtcaccgccccttccttcgccgcaccagcgccagcccgcgccgtggtcagaaggaggtccttcaccgtgcgcgcctctctccgcaagggcaccggcaccgccctcgtgggaatggctgccaacgccttgcttgacggcggtgccatggcctaggaggtgctgctggagtcaagatactgctggatcgtcatacagcccagtcagttcaccttcaaggtcggcgacttcttcacatacgagaacatcgccagcttcctccacaacatcatcttcaacgagcacgacgtgcccagcgtcatcgacaccaccaacatctcgcaggaggagtacctcagcgcgccaggcgagacctactccttcaccctcaccgtgcgggtaacctacggcttctactgctaaccgcatcagggactccgaatgttcggcaagatcaccgtcaactaataacctagctatcgatcgatatgcatacatgtatgacctcgtgcttcctgcttttgactctgccaatctgaccatctctaacta

SEQ ID NO: 61500 - protein, 58 aa, Zea mays
  misc_feature: Ceres CLONE 1524085
MASLSSAAVTAPSFAAPAPARAVVRRRSFTVRASLRKGTGTALVGMAANALLDGGAMA

SEQ ID NO: 61501 - DNA, 872 bp, Zea mays
  misc_feature: Ceres CLONE 1524090-R
  misc_feature (397)..(397): n is a, c, t, g, unknown, or other
cgagcgtctcgtttttttttttttttttaaaagcaggagttccgtgttttgaaaatcaatatttattatggtggaaaatttcaatgcagaaggtgggagcgacaacttgtatatatggatcggatcttggtttgtatgaagcaagagaaggggattagaagtataaattagaagccccccaagaaacagacatgtaattaacagacatcgactgctagctacgcgctgcttctggttaattaacggccacctcggcacccgtagatggccaggcagccgcgggtatacgcctgcccacgagcggcgcacgagccgtagcagacggccttgttcgcggtgagcgccccgtagctgatggacccgcccccgtacagcgccctcctcggcgggtacgccncctcctccacgaagctgcttgcgtcgtcgtcctccacgcgccgcagcggcagcgcgtgcagggaaccagcagccgccgacaagtccgcgggcgcggagcttgcgaagagagccccgatgcgaaaacaagcaggacgattcgagtctgccgctccattattctggggtttttctaagggggagaacgattcctggcgcccgggggatcaatagtttaagaggggcccccccggggggggaactcagcttttttttcctttagggagggaaattgggcgttggggaaaaaaggggaaaagtggtttcttgggggaaatatgtatcccttccaatttccaaaaaataggagccggaaaataaaagggtaaacccggggggccctcgggggggggccactccttaatagggggggcgcccagggccggtttttaatggggggaaaattttgggcacgttattataaaaaatgggcgaag

SEQ ID NO: 61502 - DNA, 703 bp, Zea mays
  misc_feature: Ceres CLONE 1524093
  misc_feature: Translation starting site: 179
  misc_feature (404)..(404): n is a, c, t, g, unknown, or other
  misc_feature (405)..(405): n is a, c, t, g, unknown, or other
  misc_feature (411)..(411): n is a, c, t, g, unknown, or other
aaagctggagctccccgcggtggcggccgctctagaactagtggatcccccgggctgcaggaattcgtctcaccccctagaaaaaaagaacagctgtcgatccaattgtcacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcactagcagccccctccgcgaggacggaggcgtcgccgccggnnccttcncactctacgagaagcacgaggcacagaaggacccgggagcacgcccacccgccccaaaatccaggaggaggtccctggcggccggcggccgccggctcccggcggctttccccttcccagagcacccccaaaaagaaaaaaagacccccacgaactccccaggaggccccgtcccccaaaaaaaaaccccccacttcctccggctgaaatggacccctccccctatcgtgccctcacccccccccgtgggcttaaacctttgccgtgtttcaacaattgataatctcccccg

SEQ ID NO: 61503 - DNA, 524 bp, Zea mays
  misc_feature: Ceres CLONE 1524095
  misc_feature: Translation starting site: 270
aaagctggagctccccgcggtggcggccgctctagaactagtggatcccccgggctgcaggaattcgtctcacccctagaaaaagcccctctctcccaccccgcagccgccctagcacccgcgacgagcaggatctgcccagttgctcttgcggtagttcccccaactgtcaccatgcagaacgaggagggtaagactgtggacctctatgtccccaggaaagtgcctccggccaccaaacagggatcctttacctggccaaaggacccatggcctcttgtccgataacattggcccttgatgccaatggcctgtatatggcccctccaacgtttgtccccctgggtttcccggcccagggacccaacactccttggaaagtttgggaaaaaaaaagggtattccaccctgatattttcctcttttttccaaaatttgcaccccccccccgcctttttttgaaaacccggccccaattggagaagggggtgagattttccgcgggggcgccccctaaaaaagag

SEQ ID NO: 61504 - DNA, 638 bp, Zea mays
  misc_feature: Ceres CLONE 1524100
  misc_feature: Encodes the peptide sequence at SEQ ID NO. 61505
aaagctggagctccccgcggtggcggccgctctagaactagtggatcccccgggctgcaggaattcgtctcacccctagaaaaaaaaaggcctgcttcttcacctcgcgctccaggttcatgttttgagcgtgtacagtgcatgtggtttcagaaatggggacgctggcgtgcccatggagatctggccacctctttgctttcatcaccttcgccgtgctgttcttctcgacttcatttgccgggagacagtacagtttcttgatggatcaagatgccctacgtcaacaagaaggagagggagcacgaactgagcagaaggaagcgctagtgccactggtgcaagctcggcggctcagcgtcaagacgaacgattacagcagctatgacccttccccgtccatggacaagccacactccaagctcataccgaactgatcaatcatgtacccgtccaggttgcagcagtcgagttgccgatgagaaatttaacagcttaaatgtgtgcctgatttatatatacagaagcattatattactaggcttgcttaaactgttctcatgacatctaatatcatattattatagatgtgacatatagatgtttacttaaaaaaaaaaaaaaaataaaaaaaaaaa

SEQ ID NO: 61505 - protein, 93 aa, Zea mays
  misc_feature: Ceres CLONE 1524100
MGTLACPWRSGHLFAFITFAVLFFSTSFAGRQYSFLMDQDALRQQEGEGARTEQKEALVPLVQARRLSVKTNDYSSYDPSPSMDKPHSKLIPN

SEQ ID NO: 61506 - DNA, 656 bp, Zea mays
  misc_feature: Ceres CLONE 1524102
  misc_feature: Encodes the peptide sequence at SEQ ID NO. 61507
aagctggagctccccgcggtggcggccgctctagaactagtggatcccccgggctgcaggaattcgtctcacccctagaaaaaatcttgcagtgctctctcctcttgctctcgatctctcgatcccgacttaccattaatcaatggcgtgccaatggggcatgcgcgctcgcgtgtcccccgccgggtgacttcggctgcgccgtgacctgggccccggaagccagcccgctggtgctcatctccttccttgccctctggtgcgctccctgccgcgccatcgccccactgctcgtctaccccgacaagaaggtcaatcgcgccatcgtcctcaaggtccacgctggtcgaccccaaggaagcctccccgatcttcgagggcgaggcgatgccgatcttcccttcgtgcaggtcgacgagacctcgcatcatcgtgaggcccccaaggaccagctcctggacctgatcaagaagatgccgcccttgtgcctgcgactgcgactgtcttgatgagatcacatcaggcgtcgtgcctgatgatggccaccacgtatggctgcaaatgcaagactccctcccatctgggctctcgctctttgccggccgactaggggactaaccctccagccccgatgacagccccatccccgagacaaa

SEQ ID NO: 61507 - protein, 168 aa, Zea mays
  misc_feature: Ceres CLONE 1524102
AGAPRGGGRSRTSGSPGLQEFVSPLEKILQCSLLLLSISRSRLTINQWRANGACALACPPPGDFGCAVTWAPEASPLVLISFLALWCAPCRAIAPLLVYPDKKVNRAIVLKVHAGRPQGSLPDLRGRGDADLPFVQVDETSHHREAPKDQLLDLIKKMPPLCLRLRLS

SEQ ID NO: 61508 - DNA, 644 bp, Zea mays
  misc_feature: Ceres CLONE 1524103
  misc_feature: Encodes the peptide sequence at SEQ ID NO. 61509
aaagctggagctccccgcggtggcggccgctctagaactagtggatcccccgggctgcaggaattcgtctcacccctagaaaaatcacaattcactccactcatcttttctcgtttacaacctctaaaatttcccccactctccagtcgcagcagcacctgtaagcactcatggacgccaacgagagccggtagcaaggggaaaaagggggcggtccggcacaaggcaggcggacccagcaagaagtcggtgacgtcggtccgtacaaggccgggctgcacttccccgtcggccggatcaggcgctacctcaagaacggccggtacgctcaccgcgtgggcactggcgcccccgtctacctcgtcgccgccctgcagtacctcaccgccaatattctggagttggcagggaacgcggcgaaagacaacaagaatacgcgcatcatcccgcgccacgtgctcctggcgatccgcaacgacgaggatccctggaagctgctggccggcgtcaccatcgcgcacggcggcgtcctccccaacatccactccatgatcctgtccaagaaagctgctgataaagcggccacctggcagcagcaacgagcccaagtccgcccaagaagggcccccagtccccccaggaag

SEQ ID NO: 61509 - protein, 32 aa, Zea mays
  misc_feature: Ceres CLONE 1524103
MILSKKAADKAATWQQQRAQVRPRRAPSPPRK

SEQ ID NO: 61510 - DNA, 720 bp, Zea mays
  misc_feature: Ceres CLONE 1524112
  misc_feature: Translation starting site: 153
  misc_feature: SWISSPROT Homolog: EC 6.3.2.19 Ubiquitin--protein ligase
aaagctggagctccccgcggtggcggccgctctagaactagtggatcccccgggctgcaggaattcgtctcacccctagaaaaaaaaactagaggcagaagtcaacgaaacagtacctcttctgttaggtaggacggcacaggaggaggaagatggcatccaagaggatccagaaggagctcatggatcttcagaaggaccctcccacctcgtgcagtgcaggtgctgttggtgaagatatatatccactcggaggacacaataatgggtccatgtgatagcccctatttctggtggagttgtcctagttacaatctatttgcctcccgattatcctttcagcccaccctggggtgggatttcttgaccgaggtgttccagtccaaacggcggccgtgaccgggaccctcctgcccctggcatctcttggagcactagggggaattcccgggcccaggcgtctttcaaggggggctcgttgtgcgacgggcctccctttggccgcctaagtctcgaagcctcaaaggactccccgtgggtcccccgcggatggggccgatattcagagcgggagcgggcgcaggtgatttaacttgggcccctccccctctggcgggtacttttatctgtggagagtggcccttccgtgggtgcgaggggggacttccctaatcctgggcgcgccgttgggtcgggacccgccgcgggaaatttccccga

SEQ ID NO: 61511 - DNA, 647 bp, Zea mays
  misc_feature: Ceres CLONE 1524116
  misc_feature: Encodes the peptide sequence at SEQ ID NO. 61512
  misc_feature (561)..(561): n is a, c, t, g, unknown, or other
ctggagctccccgcggtggcggccgctctagaactagtggatcccccgggctgcaggaattcgtctcacccctagaaaaaaaaccaatcatatacagagagcatactcgatcatgaaggatggcaagaaggaagtggccggggcggtggtggccatactgctggttctgcagctcatggcagctccaccgacggccatggccgcccgctcgccgagcggagccatgccggatggctccctcgccacgacgcccgaggtgaccatgctgtcggccacgctgtgctacacggtggagacatgcgaatacactccctgcttcactcctgcttgctcctgcagctttagtgatcgcctctgctacgtcatatttactcctgttgcttgagttgaggccattccgcgaagccacaactcttacatgcatgcgccggccgactactactacgctgcctctcgtgagcttctgttcaagtgatgcatgtttcaaggcatccctggatgctttacctatatgcgtattaattaaccgtgtcatggaacagcagataagagggttggtgnttttatttacctccctctggtgatgaaataaatggagatatattgttttggatgtgtgcaatgcgtaacattttactgctcgctct

SEQ ID NO: 61512 - protein, 90 aa, Zea mays
  misc_feature: Ceres CLONE 1524116
MKDGKKEVAGAVVAILLVLQLMAAPPTAMAARSPSGAMPDGSLATTPEVTMLSATLCYTVETCEYTPCFTPACSCSFSDRLCYVIFTPVA

SEQ ID NO: 61513 - DNA, 650 bp, Zea mays
  misc_feature: Ceres CLONE 1524117
  misc_feature: Encodes the peptide sequence at SEQ ID NO. 61514
  misc_feature (556)..(556): n is a, c, t, g, unknown, or other
tccccgcggtggcggccgctctagaactagtggatcccccgggctgcaggaattcgtctcacccctagaaaaactccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaaggaccgcaaggcgctcctggaccgcaagccccggggctgcgccgccgacaaggctaaggncaagtttactgtcgacgacgtcgctgccgccgccgctgggtggcgccgcccacggggccttctctcaggagatcgactaggctcttcacgggca

SEQ ID NO: 61514 - protein, 163 aa, Zea mays
  misc_feature: Ceres CLONE 1524117
  misc_feature (51)..(82): Pfam Name: KOW Pfam Description: KOW motif
  misc_feature (132)..(132): Xaa is any aa, unknown, or other
MKRNPRVTSSRRKCRKAHFTAPSSVRRVLMSAGLSTELRHKYNVRSIPIRKDDEVQVVRGTYKGREGKVVQVYRRRWVIHVERITREKVNGSTVNVGIHPSKVIVTKLKLDKDRKALLDRKPRGCAADKAKXKFTVDDVAAAAAGWRRPRGLLSGDRLGSSRA

SEQ ID NO: 61515 - DNA, 641 bp, Zea mays
  misc_feature: Ceres CLONE 1524118
  misc_feature: Encodes the peptide sequence at SEQ ID NO. 61516
  misc_feature (353)..(353): n is a, c, t, g, unknown, or other
ccccgcggtggcggccgctctagaatagtggatcccccgggctgcaggaattcgtctcacccctagaaaaaaacagcaaccagtaagccatcgctcacacagtcagaccgacgcactcactaacacacaacttctccatacacgccttagccatggcttccgctgcgcagaagaagatgacaattgtttgcttgatgctgctggccgtcgtcggccaaatcgtcgctgatgatgatgttaccgtaaaacatcccagccgcatctgcaccgaaacggtgattgatcctcgtgttcccaacaacgtgtgcatctgctccaagaactgcgcctgtgccggcaagtgtatccttgantcggctgatgctgtccagacctgctttgtcgactgcgtcctcaagaacgactgcatctgcagcaacaagatcatccccggcgctgacgaacccaaggctaatgccaagtgaagtagtactgctatcaggctatcatcatccccaataatggcgtacgtacctaaataacgacgtcccatgcatgcacaacggggagaagtagtggtgtataattacgggcggtatgtctgtacgacggcccgtcttggttgtaacaataaacccctggtttgaacttgaaaaaataac

SEQ ID NO: 61516 - protein, 103 aa, Zea mays
  misc_feature: Ceres CLONE 1524118
  misc_feature (67)..(67): Xaa is any aa, unknown, or other
MASAAQKKMTIVCLMLLAVVGQIVADDDVTVKHPSRICTETVIDPRVPNNVCICSKNCACAGKCILXSADAVQTCFVDCVLKNDCICSNKIIPGADEPKANAK

SEQ ID NO: 61517 - DNA, 666 bp, Zea mays
  misc_feature: Ceres CLONE 1524119
  misc_feature: Encodes the peptide sequence at SEQ ID NO. 61518
ctcaccgcggtggcggccgctctagtactagtggatcccccgggctgcaggaattcgtctcacccctagaaaaacttgccgccagccagcccattaaccctcgttcctgtcgcgcagccacgacctccacttcacatctcccccggcggcggcgcggtcagttgaacaatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggacccaaacaccatctttgtcttcaagttccggagggggttcggaggaggaaagtccactggtttcggcctcatctacgacaacctcgaggctgccaagaagttcgagccgaaataccgcctcatcaggaatggtcttgctactaaggttgagaagtcccgcaaggcaatgaaaaagcggaagaacagggccaagaaaatccgcggggtcaagaagaccaaggctggtgacgccaagaagaaataaacgttcgttttacattttgaataaccgttccggggctctgggggggcctaacttgcaagggcaaaaattaagggcccgggtaag

SEQ ID NO: 61518 - protein, 137 aa, Zea mays
  misc_feature: Ceres CLONE 1524119
  misc_feature (28)..(111): Pfam Name: Ribosomal_S24e Pfam Description: Ribosomal protein S24e
MADSKATSAVTLRTRKFMTNRLLARKQFVLEVIHPGRANVSKAELKERLAKAYEVKDPNTIFVFKFRRGFGGGKSTGFGLIYDNLEAAKKFEPKYRLIRNGLATKVEKSRKAMKKRKNRAKKIRGVKKTKAGDAKKK

SEQ ID NO: 61519 - DNA, 676 bp, Zea mays
  misc_feature: Ceres CLONE 1524121
  misc_feature: Encodes the peptide sequence at SEQ ID NO. 61520
  misc_feature (484)..(484): n is a, c, t, g, unknown, or other
  misc_feature (496)..(496): n is a, c, t, g, unknown, or other
  misc_feature (557)..(557): n is a, c, t, g, unknown, or other
ctccccgcggtggcggccgctctagaactagtggatcccccgggctgcaggaattcgtctcacccctagaaaaatcaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccngatgactactancaaatagacgttgtgactgtgcaaaaaatcaaaatataaataaatagttttggtgataacnacttccatgttaaaaaaaaaccgagacgctcgaggtaccccattcgcccaaaagggagtcgtattacgcgcgctcactggccgtcgtttttacaacgcgggatgggaaaaacctggcgt

SEQ ID NO: 61520 - protein, 63 aa, Zea mays; identical to SEQ ID NO: 8705
  misc_feature: Ceres CLONE 1524121

SEQ ID NO: 61521 - DNA, 567 bp, Zea mays
  misc_feature: Ceres CLONE 1524123
  misc_feature: Encodes the peptide sequence at SEQ ID NO. 61522
  misc_feature (129)..(129): n is a, c, t, g, unknown, or other
  misc_feature (341)..(341): n is a, c, t, g, unknown, or other
  misc_feature (358)..(358): n is a, c, t, g, unknown, or other
gcggtggcggccgctctagaactagtggatcccccgggctgcaggaattcgtctcacccctagaaaaaattatccacaacactcatcgatctacacacatacatagttttcttctactacacgacgacnaacatggggaagcctgcgaagaatcggagagtgggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtancagattgatctgtgcangttcgacgagagcttgacggaaatctcggggacacggggccagcctacaacattgacaatctgggtccagtctcttcaaatcgtccaccaacaacgcgctttacggacggttacgcaagggacccagggcccccccgttccggggtccagggggaataaaaaaggggccaaggtcgcttgggtttttttttgggcccgcttctgggaaa

SEQ ID NO: 61522 - protein, 188 aa, Zea mays
  misc_feature: Ceres CLONE 1524123
  misc_feature (43)..(43): Xaa is any aa, unknown, or other
  misc_feature (113)..(113): Xaa is any aa, unknown, or other
  misc_feature (119)..(119): Xaa is any aa, unknown, or other
GGGRSRTSGSPGLQEFVSPLEKIIHNTHRSTHIHSFLLLHDDXHGEACEESESGGGYAGDRRDLRATPDRLIEVKVTADNSSCIRSISFIYIGADGKPYEEGPWGFGHAGTEXQIDLCXFDESLTEISGTRGQPTTLTIWVQSLQIVHQQRALRTVTQGTQGPPVPGSRGNKKGAKVAWVFFWARFWE

SEQ ID NO: 61523 - DNA, 663 bp, Zea mays
  misc_feature: Ceres CLONE 1524126
  misc_feature: Encodes the peptide sequence at SEQ ID NO. 61524
gcggtggcggccgctctagaactagtggatcccccgggctgcaggaattcgtctcacccctagaaaaatcctattctcgcgcccggtctctcccttctccaacctccgtttctaatccgcgctgctcatcacaatcccagtcccagctcgacgcgctgagatggacggtagcatcctcaaatccgcgcacctcctgcaagctgatgcgccagcacctggcctccgatgcccgccaggacgtcacctacaaggtcggcctcgtctaccagctcaacatcaccccgaagatcggcgttgatgatgagatcttcgtggtccacctcaagaagggcgaggtcagcagagggccgtaccatcgaaagccggatgccactttctccttcgcggaccacgatttccttggaatcgccgccggccagatgattccgcagattgcattcttccgaggggcaataatgatcatggggagcatcagggtcgcacgaaaagtttactgctgacatcttcgactcgcctgcccagctgtacaacgttacatggtgttagcttgtgcgacgtgcataataatgttcgataacgtcagctaccatgtactaaagtcactgcctgaaacgtgtggctgttcgttctctgaggacattccgatatgcgatggacttacac

SEQ ID NO: 61524 - protein, 98 aa, Zea mays
  misc_feature: Ceres CLONE 1524126
  misc_feature: SWISSPROT Homolog: EC 2.3.1.176 Propanoyl-CoA C-acyltransferase
MRQHLASDARQDVTYKVGLVYQLNITPKIGVDDEIFVVHLKKGEVSRGPYHRKPDATFSFADHDFLGIAAGQMIPQIAFFRGAIMIMGSIRVARKVYC

SEQ ID NO: 61525 - DNA, 662 bp, Zea mays
  misc_feature: Ceres CLONE 1524134
  misc_feature: Encodes the peptide sequence at SEQ ID NO. 61526
  misc_feature (461)..(461): n is a, c, t, g, unknown, or other
  misc_feature (530)..(530): n is a, c, t, g, unknown, or other
  misc_feature (603)..(603): n is a, c, t, g, unknown, or other
ctccccgcggtggcggccgctctagaactagtggatcccccgggctgcaggaattcgtctcacccctagaaaaaggcgtatccctaatcccacctccagtctctgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttggctttgtaaggtatgctacgaccgaagaggcagccaagggaatagagggaaaggatggaaagttccttgatggatggggttatttttgcggaatacgctnaacccagaccaccacccggagaaacagggatgaattcgcagccccagcagtcatggggagctccatcanggttcctggggtgcacagtaaatgaagtggatattgtgagaagcccctccctgtcccagccctagggtcgtancggatcgggagggaagatttttttgggggggggggcccaagggggaaaacgcctttgtt

SEQ ID NO: 61526 - protein, 142 aa, Zea mays
  misc_feature: Ceres CLONE 1524134
  misc_feature (37)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (112)..(112): Xaa is any aa, unknown, or other
  misc_feature (135)..(135): Xaa is any aa, unknown, or other
MAAAVARSGFRRMFSVSAFAPPKAPAARPKADPSPNLFVSGLSKRTTSEGLREAFAEFGEVLHARVVTDRVSGFSKGFGFVRYATTEEAAKGIEGKDGKFLDGWGYFCGIRXTQTTTRRNRDEFAAPAVMGSSIXVPGVHSK

SEQ ID NO: 61527 - DNA, 648 bp, Zea mays
  misc_feature: Ceres CLONE 1524135
  misc_feature: Encodes the peptide sequence at SEQ ID NO. 61528
  misc_feature (575)..(575): n is a, c, t, g, unknown, or other
  misc_feature (576)..(576): n is a, c, t, g, unknown, or other
  misc_feature (621)..(621): n is a, c, t, g, unknown, or other
tacccgcggtggcggccgctctagaactagtggatcccccgggctgcaggaattcgtctcacccctaaaaaaaaccgcctcatctgctctcttcccccgtcttcttcccaagctgccacgttgcctccctccgctccagcggcccatggcctccatggcgttcgccctggcgggggccttcaagggcctctccctggcgcccaccaccaccacctcctccttcccgcgctgcgaccgcgcctcgctctccgtcggcggcgcagcgggcgtgccggtgccggtgccggcgcggcggctcaccatccagatggcgcacaagaagggggccgggagcaccaagaacggccgcgactccaagggccagcgcctcggggtcaagatatacggcgaccagctcgccaagcccggggccatcatcatccgccagcgcggcaccagggtctatcctggaaataacgttggaatgggcaaggatcacacactcttttctttgatagatggactcgtcaagtttgagaagtatgggccggacaagaaaaaaggttagtgttacccatatgagaaggagcctgaannaccaaacagttacagagcaggaaggagagagtacttccgcatgcngcgtgaacggaagaaagcgaagagcga

SEQ ID NO: 61528 - protein, 133 aa, Zea mays
  misc_feature: Ceres CLONE 1524135
  misc_feature (56)..(132): Pfam Name: Ribosomal_L27 Pfam Description: Ribosomal L27 protein
MASMAFALAGAFKGLSLAPTTTTSSFPRCDRASLSVGGAAGVPVPVPARRLTIQMAHKKGAGSTKNGRDSKGQRLGVKIYGDQLAKPGAIIIRQRGTRVYPGNNVGMGKDHTLFSLIDGLVKFEKYGPDKKKG

SEQ ID NO: 61529 - DNA, 652 bp, Zea mays
  misc_feature: Ceres CLONE 1524137
  misc_feature: Encodes the peptide sequence at SEQ ID NO. 61530
  misc_feature (597)..(597): n is a, c, t, g, unknown, or other
ccccgcggtggcggccgctctagaactagtggatcccccgggctgcaggaattcgtctcacccctagaaaaatgtcgaggtcaccgagtgcaacccttgtatgtgatgtcttctccgatgtggcattcgctgagaaggaagtcgtcgaattttccacttcctcgtcagcgactgcaaagaacatagcggagggtttcacagctatccctgaggaccgagtactaactgagtacctacaagctgctgcgaaagcgcaagccgaagaggacacgttggcctcagagcgagctagatagagaaggcgaagcggctgccagtaaatctgaagacgacacgaacaggagaccttcagaggaggaagctgctactcctagcgcggagaacggagctcacgcctctctagagaaccgcttgagtagagccaaagtgatcaatgcggagttctcgtgcgataagttcagcacacagtttgccgacgagacgactcctctaacgtcatgactagagaaagaactcgcaagggacagatagtcactgtgcgaggccagcaaagagcgaatcagctggcaccgcgggatgctgttgtgagaccatcancgcagaacgcgaagcctccggatccaagactacaagtgatagcactgcttcgctg

SEQ ID NO: 61530 - protein, 74 aa, Zea mays
  misc_feature: Ceres CLONE 1524137
MSRSPSATLVCDVFSDVAFAEKEVVEFSTSSSATAKNIAEGFTAIPEDRVLTEYLQAAAKAQAEEDTLASERAR

SEQ ID NO: 61531 - DNA, 646 bp, Zea mays
  misc_feature: Ceres CLONE 1524142
  misc_feature: Encodes the peptide sequence at SEQ ID NO. 61532
  misc_feature (518)..(518): n is a, c, t, g, unknown, or other
  misc_feature (600)..(600): n is a, c, t, g, unknown, or other
  misc_feature (615)..(615): n is a, c, t, g, unknown, or other
tggcggccgctctagaactagtggatcccccgggctgcaggaattcgtctcacccctagaaaaaatcgatcctgtcctgtccagcaaagggagacctgaacaaggggaggactggaggagaggaggaggacctacccaacccggcctgcagctctctcgtctcttcctcctcctcgaagctccgatccgatcccccaatgtctgacagcagtcccgctcccggcgcctactactccggccctcccgccgcgccgccgcccgagtctaagcccgttgacggcggccaggtcaacgccgatgttcctggctactactcctccgcccctgctgcgaaatctggcgccggcggccagcagggcagctccgctgctcccaaggaatcgggcttcttcgccagctgttgtgggtgcttctctggcggcgaaaccgcgagatagatagattcagtgttggaccgaggaccatgcatggatggatggacatgcatgcccagtgattgtttgcgccgatgaaagttncatttgtccggatttattttctctgaaatagtatatgttttttttctccatcggtgagccggtgatctttgtcatttgtacnataatcattatatgncaccaactgtgctttaatttgctctgatatc

SEQ ID NO: 61532 - protein, 79 aa, Zea mays; identical to SEQ ID NO: 43366
  misc_feature: Ceres CLONE 1524142

SEQ ID NO: 61533 - DNA, 650 bp, Zea mays
  misc_feature: Ceres CLONE 1524146
  misc_feature: Encodes the peptide sequence at SEQ ID NO. 61534
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (458)..(458): n is a, c, t, g, unknown, or other
  misc_feature (518)..(518): n is a, c, t, g, unknown, or other
tccccgcggtggcggccgctctagaactagtggatcccccgggctgcaggaattcgtctcacccctagaaaaaatggcgtctctggccctccgccccgtcatcccggccaccaccgcttcatccaggaccctcacgatcgtcgttggctcccgctcccgccacgctgccacactccaccgtggctttcgctcgcggcgcctcatcacctgcaaggcggagccgagcggcggcaacagcaccctcgagctgggcgcaggggccgcagggctggcatcgagcgcggtcgtggcgtggtccctctacacgctgaacacgacggggtgcggctgcccnnnnnncccccccgcgggggggcgccctggggcgccggcgaaaggggggtcaggcttacctcggtcggtggcggggtctaagtcggggtggtcggtcaccaccaagggtgcgcactggctcgggncctcccggctgggcccctacgggctcctcggcgcccgctgaagggcgttgcctacctcancatcgcgggcattgccgtcgtcttcggcctgcagttcttccagcaggggtccatcccgggtcgctgccatcggaaccagtgttttggctgactgggataaccattccggttggatgcctggtgccaattggg

SEQ ID NO: 61534 - protein, 141 aa, Zea mays
  misc_feature: Ceres CLONE 1524146
  misc_feature (88)..(88): Xaa is any aa, unknown, or other
  misc_feature (89)..(89): Xaa is any aa, unknown, or other
  misc_feature (129)..(129): Xaa is any aa, unknown, or other
MASLALRPVIPATTASSRTLTIVVGSRSRHAATLHRGFRSRRLITCKAEPSGGNSTLELGAGAAGLASSAVVAWSLYTLNTTGCGCPXXPPAGGRPGAPAKGGSGLPRSVAGSKSGWSVTTKGAHWLGXSRLGPYGLLGAR

SEQ ID NO: 61535 - DNA, 654 bp, Zea mays
  misc_feature: Ceres CLONE 1524147
  misc_feature: Encodes the peptide sequence at SEQ ID NO. 61536
  misc_feature (561)..(561): n is a, c, t, g, unknown, or other
ccccgcggtggcggccgctctagaactagtggatcccccgggctgcaggaattcgtctcacccctagaaaaagcgctgtctaagaagtgggcggtgtcttactttcccttctcttcctcttcaccttgatgaggatcccctccgctcgcctctccgtcggcctccacagcgcccagctgccgcgctggtgattagggttacgttttggcgcggctcacctgccgcgcgtgtaacaggtgactcatcatcgcttcggcaactcacgcgtggtccacgagtaggagaacaacatcattctgtccagcgagatggacgacggcttggacgtgcctcacgactgcacggacgacgtgatcctgaactgcatggagcgcatggactgcaagaagctggacagcagcaacatcatgctcaatgaggacgtcgtcgcgcggggtagtggatgcaatacgctgcgtaccgtgctgccactggacgatgcgcgtactgccggagaaggagctgctcaagatctagctcgctacggcggacgactggactccggtgcgatgacacgatgcnttggtcgtcgggggcggaaatgatgcatgcccacgtgactggaacctccctggttgtcctaggggaactgggtgaacaagattgttcgtcgcc

SEQ ID NO: 61536 - protein, 91 aa, Zea mays
  misc_feature: Ceres CLONE 1524147
  misc_feature (85)..(85): Xaa is any aa, unknown, or other
MDDGLDVPHDCTDDVILNCMERMDCKKLDSSNIMLNEDVVARGSGCNTLRTVLPLDDARTAGEGAAQDLARYGGRLDSGAMTRCXGRRGRK

SEQ ID NO: 61537 - DNA, 641 bp, Zea mays
  misc_feature: Ceres CLONE 1524148
  misc_feature: Encodes the peptide sequence at SEQ ID NO. 61538
  misc_feature (476)..(476): n is a, c, t, g, unknown, or other
cgcggtggcggccgctctagaactagtggatcccccgggctgcaggaattcgtctcacccctagaaaaactctagccaaaaccctagcagccgcccggtgctccctctctgcagatctcccttcgcagccgccgaggaaccccttcacagcgcggaagatggctgaacaggaggccccagtcgcggttgaggcaccaaccccagttcttggggagcctatggacttgatgactgctctgcagctcgtgatgaagaagtcaagtgctcatgacggtcttgtgaagggtctccgtgaggctgccaaggccatcgagaagcacgccgctcagctttgcgtgcttgctgaggactgtgaccagccagattacgtcaagttggtgaaggcactctgcgctgagcacaatgttcacctggtcactgttcctgccgctaagactcttggcgagtgggccgggctttgcaagattgactctganggcaggctaagttggttgtaagctgctcctgcgtcgtcgtctaggactacggtgaagcatctgagggtcttacatagtgcaggagaatgtccggcgcactagatgtgtgacatgtttccctgaactcctgatttggaccggggcctaaattagcgtttgcatctg

SEQ ID NO: 61538 - protein, 112 aa, Zea mays
  misc_feature: Ceres CLONE 1524148
  misc_feature (25)..(113): Pfam Name: Ribosomal_L7Ae Pfam Description: Ribosomal protein L7Ae/L30e/S12e/Gadd45 family
  misc_feature (106)..(106): Xaa is any aa, unknown, or other
MAEQEAPVAVEAPTPVLGEPMDLMTALQLVMKKSSAHDGLVKGLREAAKAIEKHAAQLCVLAEDCDQPDYVKLVKALCAEHNVHLVTVPAAKTLGEWAGLCKIDSXGRLSWL

SEQ ID NO: 61539 - DNA, 644 bp, Zea mays
  misc_feature: Ceres CLONE 1524152
  misc_feature: Encodes the peptide sequence at SEQ ID NO. 61540
ctccccgcggtggcggccgctctagaactagtggatcccccgggctgcaggaattcgtctcacccctagaaaaagtttcttgctgcccgcagaagtgaaccaggaacagcttaactgtgaccaggttacgtcgctggggtcaactctggcgatcaagctggtgagcagagtccacgtggccgacgcgaggttcggcgtctacagccaccgcctggacgacgtgtggctcgtcggcggggcgtccaacaccgggggagccgtgctccggcagctcttcacggacgaccagctcgcggcgctgagcgagcacatcgacccggccgtcccttcccctctcgactactaccccctgccgaagaaaggcgagaggttcccggtctccgacccagacatgatgccaaggctgcagccacgccctgggagcgacgcggagtacctgcacggcatactgggaatcgatcgcgcgaatcgaggccaaggggtacagcctgctgaaggactcggcgcgaggcgtgaagggtttttttctaccccggggggggggagagcggcaaaaacacgggtgcacggccatccgggaaaagggtgctcggcgtgccgggtccggaaggcccaacaagactggagcggcttattggagctgc

SEQ ID NO: 61540 - protein, 84 aa, Zea mays
  misc_feature: Ceres CLONE 1524152
MMPRLQPRPGSDAEYLHGILGIDRANRGQGVQPAEGLGARREGFFSTPGGGRAAKTRVHGHPGKGCSACRVRKAQQDWSGLLEL

SEQ ID NO: 61541 - DNA, 662 bp, Zea mays
  misc_feature: Ceres CLONE 1524157
  misc_feature (535)..(535): n is a, c, t, g, unknown, or other
  misc_feature (536)..(536): n is a, c, t, g, unknown, or other
  misc_feature (561)..(561): n is a, c, t, g, unknown, or other
  misc_feature (562)..(562): n is a, c, t, g, unknown, or other
  misc_feature (567)..(567): n is a, c, t, g, unknown, or other
ggagctccccgcggtggcggccgctctagaactagtggatcccccgggctgcaggaattcgtctcacccctagaaaaaattccccaacgcagccagcagcgcaaggtccagaagcccagaaccagacgagcacggacggatctcccccaacgcgcgtgcgtccgcaactagcgtctgccgccggccgccttcttccgcaccccccgacgcggcaaggagccccccgccatgagggtccacccggccccgcggaagcgcaccatcgccgtgcaacgctgcgcctcccgcggcggcgggcgcgctcggcgggaagaagctgcgccgcctgccgcacatattcgacaaggtgctggagctcccgttcgcggccgacgcggacgtgtcctcgaggaaggaaaccggccggcgcttgccggttcgtcgccgccgccgacagttttccccttcggggggcgcccgcgcgcacggccgtcgaatccaacccagggtcaccccaaggggtcgttcgtccggggggctctcctcctcctccctnngggggggcgatggcgacacgacgannaaaangggggggccccccccccccccccccttccaagttctaaacgggtggggggggtttccggcccttccgggccttggaaggggccccccgcccatgg

SEQ ID NO: 61542 - DNA, 603 bp, Zea mays
  misc_feature: Ceres CLONE 1524158
  misc_feature: Encodes the peptide sequence at SEQ ID NO. 61543
  misc_feature (289)..(289): n is a, c, t, g, unknown, or other
  misc_feature (302)..(302): n is a, c, t, g, unknown, or other
gctctagaactagtggatcccccgggctgcaggaattcgtctcacccctagaaaaactcacggagaaaaagaaagaggagctcggacaaggcagcgccatcgttcggtttccttgctgaattcccgatcgctcgcccgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaggggcggccggcgnccgggccaaaggnaggagaagggcctcggcgagaccatcttcggcttcatctttcagaagggacagctgggtggagacggacccgctccgtcacaagggtcgcgccggcgcgggcgccgcctcccgcggcaagaacaacgcccggcaaaagggtttgcggcggcgaatacagcggcagcgggcgggggggtcaacctcggcggcctcggcgggttcttcgccagaaaagcagctgaaccggggcgtggtttaatgaattgtcgaactcaaagctggatttggctttggagggggaaaatggttgcgcatttttt

SEQ ID NO: 61543 - protein, 145 aa, Zea mays
  misc_feature: Ceres CLONE 1524158
  misc_feature (46)..(46): Xaa is any aa, unknown, or other
MASLAFGSTVAAAVAATSGRTRPARRSVLVVPPAASRGGRRPGQRXEKGLGETIFGFIFQKGQLGGDGPAPSQGSRRRGRRLPRQEQRPAKGFAAANTAAAGGGVNLGGLGGFFARKAAEPGRGLMNCRTQSWIWLWRGKMVAHF

SEQ ID NO: 61544 - DNA, 657 bp, Zea mays
  misc_feature: Ceres CLONE 1524291
  misc_feature: Encodes the peptide sequence at SEQ ID NO. 61545
catagctggagctccccgcggtggcggccgctctagaactagtggatcccccgggctgcaggaattcgtctcacccctagaaaaagctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccaggcaggtcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacgcgccaggcgagacctactccgtcacccttaccgggccggggacccacagcttctactgggagccgacccaaggacaggaatgggcggcaagatcccacccacctaagctagctagccttccctgcatctcgatcttgag

SEQ ID NO: 61545 - protein, 166 aa, Zea mays
  misc_feature: Ceres CLONE 1524291
  misc_feature (59)..(147): Pfam Name: Copper-bind Pfam Description: Copper binding proteins, plastocyanin/azurin family
MASLSSAAITAPSFTAAPARAVVSRRSFTVRASLRKATATAAVAVAASVLLAGGGAMAQEVLLGAGDGGLVFEPRQVTVKAGDTITFKNNAGFPHNVVFDEDEVPSGVDASKISQEEYLNAPGETYSVTLTGPGTHSFYWEPTQGQEWAARSHPPKLASLPCISIL

SEQ ID NO: 61546 - DNA, 661 bp, Zea mays
  misc_feature: Ceres CLONE 1524295
  misc_feature: Translation starting site: 150
ggagctccccgcggtggcggccgctctagaactagtggatcccccgggctgcaggaattcgtctcacccctagaaaaaatccaattcacaggctcaccacaccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaaaccggcgatccggaggctggcgcgacgaggcggcgtgaagcgcatctcggggctcatctacgaggagacccagcggcgtgctcaagatcttcctggagaacgtcatccgcgacgccgtcacctacaccgagcacgcgcgccgtaagaccgtcacggccatggacgtcgtctacgcccttaagagccagggccgcaccctctatggcttctgcggctaagtctgacgcggccgcgcctcgactcggcgttggtgcggttctggtgttgctgcacttcgcaagttgtttgtggagggtgaaaaaatgctagctactgtagaactgcaatggcgtactcatcacatggtgtgtttgtctgaaaaattgttgtcaatgctggattgctctggactcgaaaaaacaataagaaacgacacgc

SEQ ID NO: 61547 - DNA, 781 bp, Zea mays
  misc_feature: Ceres CLONE 1524306
  misc_feature: Encodes the peptide sequence at SEQ ID NO. 61548
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (19)..(19): n is a, c, t, g, unknown, or other
  misc_feature (21)..(21): n is a, c, t, g, unknown, or other
  misc_feature (37)..(37): n is a, c, t, g, unknown, or other
  misc_feature (52)..(52): n is a, c, t, g, unknown, or other
gggggggggtggnngnggnanaaaaacaaaaaaagcngccgggtttatttgntcatactggagctccaccgcggtggcggccgctctagaactagtggatcccccgggctgcaggaattcgtctcacccctagaaaaaatctcagcagtgacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagggctggtgcggcgagtgcaccagatggtcgggcgtgtggacctgtgacgacctcctcaccaagtgcgccgccacctgcaagaactgcgtccccgtgtccacggacaagggggccatcaagtacaggtgccgcgacttcctcccctataactgcggctgcaagatccactagagactcatccaattccaccgtggccgcgcgccccagcggcaccgccgatggatccttccatgttcctccgccccgtccaccttgccagaagcaggcgtgtcccccctaaaaggctaggctcttggtggtggtgaatgtaagggggcgaagtgggctgacccccttccccccttcccacaagggatatcagacctttaaattcatcccaggccgctccacaaattataacataaataatagataacaagtacaaacgctttccctaacgattacacccactattttcccccc

SEQ ID NO: 61548 - protein, 89 aa, Zea mays
  misc_feature: Ceres CLONE 1524306
MKSSTLLAILVLQALLVSAAVAKGPAGPTTKKQGWCGECTRWSGVWTCDDLLTKCAATCKNCVPVSTDKGAIKYRCRDFLPYNCGCKIH

SEQ ID NO: 61549 - DNA, 649 bp, Zea mays
  misc_feature: Ceres CLONE 1524321
  misc_feature: Encodes the peptide sequence at SEQ ID NO. 61550
ggagctccccgcggtggcggccgctctagaactagtggatcccccgggctgcaggaattcgtctcacccctagaaaaacccgaattccccagggtccacttcgctcgcaaccttccccagccatggcgaccgcgacgcggaggctgctccccgcgctcctcaagaccctagctccagccggcgcgcgcggcctctccaccgagaaggctgttggtgcagccgccgtcggcggcagccgcaccgactaagtggatgcgggacacgagcaagcaagtcgccaatggaactgatcaacgaggtacctccgatcaaggttgatggtcgcattgccgtcagtgaaggggcttctgaaggtgttggacttggccacccaattgagtacatctgccttgatctggaggcacctaatgggtgcaagtactgtggtctccgttatgttcaagttcaacgtctctaaattgggaagatactgccgtctaccggtgcagaagctgagttgacgagtttatgtgcacacgcatttgttccgcaatgttcagtagggtactctgtactatgcttgcgggcaaaatgttacctttgatgatcatcctcttctcggacgatcgtttattacaaataaaaaaaagatcagacgctctaggtaccc

SEQ ID NO: 61550 - protein, 58 aa, Zea mays
  misc_feature: Ceres CLONE 1524321
MELINEVPPIKVDGRIAVSEGASEGVGLGHPIEYICLDLEAPNGCKYCGLRYVQVQRL

SEQ ID NO: 61551 - DNA, 639 bp, Zea mays
  misc_feature: Ceres CLONE 1524334
  misc_feature: Encodes the peptide sequence at SEQ ID NO. 61552
tggagctccccgcggtggcggccgctctagaactagtggatcccccgggctgcaggaattcgtctcacccctagaaaaaatcctcacttcaggtctgcagcccccaactacccccagcctcggaaggaaccttccagaagcgcaagactctaaaggccgtcgccttcccattcttcctcgccgcgggggtcgcctgagttgtttgcagatcacctaaccaatgctgaaggctgttgctgcgcttggtaacaccgatggtgtcgagggcaccatctttttcgcgctagagggagatggccctaccgctgtcaccggaagtgtctctggcctcaagcctggcctccatgggttccatgtacatgcacttggtgacaccagcaatggatgcatgtcaactggaccacactacaatcctgcgagcaaggagcatggggcaccacaagatgacaaccgccatgctggtgatcttggaaacgtgacagctggagcagatggtgttgctaatatcaatgtcaccgacagccagatcccactgactgggccagactcaatgattggcagagctgttgttgttcacgctgatcctgatgatcttggatagggtgggcacgagctcagcgagagcactggatacgccgg

SEQ ID NO: 61552 - protein, 126 aa, Zea mays
  misc_feature: Ceres CLONE 1524334
  misc_feature (2)..(126): Pfam Name: Sod_Cu Pfam Description: Copper/zinc superoxide dismutase (SODC)
  misc_feature: SWISSPROT Homolog: EC 1.15.1.1 Superoxide dismutase
MLKAVAALGNTDGVEGTIFFALEGDGPTAVTGSVSGLKPGLHGFHVHALGDTSNGCMSTGPHYNPASKEHGAPQDDNRHAGDLGNVTAGADGVANINVTDSQIPLTGPDSMIGRAVVVHADPDDLG

SEQ ID NO: 61553 - DNA, 634 bp, Zea mays
  misc_feature: Ceres CLONE 1524337
  misc_feature: Encodes the peptide sequence at SEQ ID NO. 61554
tggagctccccgcggtggcggccgctctagaactagtggatcccccgggctgcaggaattcgtctcacccctagaaaaagtgctttctcagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcaaaccgcggcggcggctacggcaacaacgacgggaactggaggaactgagcggtggggtccgctgaggcctagttatcttgttcgcttctgctaccgtgttcaccctagtctagagggggtttatcttcgtctgtggtcgtctcgtgtccgtatgtttcgtttcgtgttcgttgttgttgttgcccatctgtgtttttgaccgcaagctcgcctaaaaaaaaaaaaaaaacgagacgctcgaggtacccaattcgccctatagtgagtcgt

SEQ ID NO: 61554 - protein, 89 aa, Zea mays
  misc_feature: Ceres CLONE 1524337
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLNNAFSTYGEVLESKIILDRETQRSRGFGFVTFSTEDAMRSAIEGKPRRRLRQQRRELEELSGGVR

SEQ ID NO: 61555 - DNA, 684 bp, Zea mays
  misc_feature: Ceres CLONE 1524339
  misc_feature: Encodes the peptide sequence at SEQ ID NO. 61556
  misc_feature (382)..(382): n is a, c, t, g, unknown, or other
  misc_feature (433)..(433): n is a, c, t, g, unknown, or other
  misc_feature (453)..(453): n is a, c, t, g, unknown, or other
  misc_feature (480)..(480): n is a, c, t, g, unknown, or other
ctggagctccccgcggtggcggccgctctagaactagtggatcccccgggctgcaggaattcgtctcacccctagaaaaaaaatataaccttcatgctcattcagatgcttgatctccaatcagttaaaccgaggtcattgttcggagcagttttcctaaagcttctttcagaaaacgatcaagcttttgacattctctactgcataaccttcaagctgatggatcagcaatggcttgacatgcatgctacttacatggacttcaacacggtcatgaagtctacacggcgtcagctagaaagggagctgttaattgaagatattcagaggattgaggacatgccatcatacaggcttctggcccggtagctagaagaactgnaaccttacatggctacatattgcaaggcggcttgagatgctaatggatcgncacttatgtggacggcgacnatcttgaaatgaaatgacatgtatccntgtgtggtagggacttgtggtctctgggaaactggtcccctgagaattacaagtaagggtttttttcccggggaaaaaaacgccccctagggaaacctgaagtgcctgaaccccttccaaggcccaaaaaaaaatttggaggggggggtatatacaaaacggggcggttggccccccaacccccaaaaggaaattttcccaagg

SEQ ID NO: 61556 - protein, 91 aa, Zea mays
  misc_feature: Ceres CLONE 1524339
MLIQMLDLQSVKPRSLFGAVFLKLLSENDQAFDILYCITFKLMDQQWLDMHATYMDFNTVMKSTRRQLERELLIEDIQRIEDMPSYRLLAR

SEQ ID NO: 61557 - DNA, 653 bp, Zea mays
  misc_feature: Ceres CLONE 1524357
  misc_feature: Encodes the peptide sequence at SEQ ID NO. 61558
  misc_feature (653)..(653): n is a, c, t, g, unknown, or other
aaagctggagctccccgcggtggcggccgctctagaactagtggatcccccgggctgcaggaattcgtctcacccctagaaaaagtggagctccctgctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggccatctgctgctgctgctagttctgcttggagggcatgggcgtccatcatcgtggagatgtggccatgcgggacacccaccgccgaataaaatgctgtacttatatgcacgcacgttagaaatgcattagtgtctgtttgatgtgatcttgtgtgtgtgtgaaatgcattagtgtctgtttgatgtgatcttgtgtgtgtgcgcgcgcatcttcatttgcaccggaaaaatgctttgtgaaggtctgtaaatctgttgtatgtatcttggtcagatgaactctattattgtgccatatatctcgcttgcattggacaaatcctn

SEQ ID NO: 61558 - protein, 54 aa, Zea mays; identical to SEQ ID NO: 48310
  misc_feature: Ceres CLONE 1524357

SEQ ID NO: 61559 - DNA, 556 bp, Zea mays
  misc_feature: Ceres CLONE 1524369
  misc_feature: Translation starting site: 189
tagctggagctccccgcggtggcggccgctctagaactagtggatcccccgggctgcaggaattcgtctcacccctagaaaaaattcccaatctcgtcttgtgtcgttcggagcgggcagcagcacacagccccatcccaatcctagtcgatcttcttcccctcctcaaggaagaaaagaagctgaccatggggaagagaaagtcagctgctaagccacctcctaagaagcggatggacaagcttgacactgtcttttcctgcccattctgcaccacgggagtagtgttgagtgccgaattgacatgaagaatctgattggcgagcatcttgtagaatctgtcaggaaaaactcagcacaactgttaatgcactcactgagcctattgattttatagtgaatgggattgatgagtgtgagcctgccaaccctgttgaaggcaccatgatgcttgaacgtgagcttgccccatgcgataaactgttaccttacaatcgaaaagggaaggggcggggattccccaaaggccataacccttagtccggcccggggttgg

SEQ ID NO: 61560 - DNA, 651 bp, Zea mays
  misc_feature: Ceres CLONE 1524370
  misc_feature: Encodes the peptide sequence at SEQ ID NO. 61561
  misc_feature (514)..(514): n is a, c, t, g, unknown, or other
ggagctccccgcggtggcggccgctctagaactagtggatcccccgggctgcaggaattcgtctcacccctagaaaaaatccatacgcggattcccgtccccacaacgtgtggtgcgcggcccgcccaaaatccaccaccccggcgctccaccacatcgcagctccccttcgatgtcgcacgcccgcgcctccccgctgtggcgctgtcccctccctggcacccaccctcacaaagcatcagcctctccaatcagacgcgagccacccaccgcgcgacctcagggtgcctgtgcctgctcccgctgttccttcctcatggccaccgcctgccacctcgccgcgccgctcggcctcgccccgttgccccgcggctgcgcctctgctggcgtcgtggccgtcgtccggtgcgctcggtcgtcaggctccaagattccgagaggcgttgctgtcagggcgacgtccggcggcgagggcgccacggaggaggtgccggagattgtgaaggctgcgcangacgcgtgggacaaagttgaggacaagtacgccgtggccaccatcggtgtcgctgccatcgtcgcgctctggacggtagtaggtgccatcaaggccatcgacaagcttcctcttctgcctgttgtccttgagattgt

SEQ ID NO: 61561 - protein, 111 aa, Zea mays
  misc_feature: Ceres CLONE 1524370
  misc_feature (66)..(66): Xaa is any aa, unknown, or other
MATACHLAAPLGLAPLPRGCASAGVVAVVRCARSSGSKIPRGVAVRATSGGEGATEEVPEIVKAAXDAWDKVEDKYAVATIGVAAIVALWTVVGAIKAIDKLPLLPVVLEI

SEQ ID NO: 61562 - DNA, 775 bp, Zea mays
  misc_feature: Ceres CLONE 1524374
  misc_feature (12)..(12): n is a, c, t, g, unknown, or other
  misc_feature (15)..(15): n is a, c, t, g, unknown, or other
  misc_feature (20)..(20): n is a, c, t, g, unknown, or other
  misc_feature (38)..(38): n is a, c, t, g, unknown, or other
tttttttttttncgnccctncttcctttcgttctttcnttttgttcccatgtcttgggctggtgctccccgcggtggcggccgctctagaactagtggatcccccgggctgcaggaattcgtctcacccctagaaaaagtcttgctttatccttccctcgtatcgccgtacaataacgcgctgcctcccgaccgggcgccgcttaagcctcctacaccaccacacccgccggccagactcgtatttctaagaagacgatggcacgggcaagcgcttaagctctttacgacctgggcaagggatggcgtcggactactgcggggtcactcgtcccggcgctggtggaccctgtggccaagtatctggacgaccgccctgcatgcgttgatggcatgatggcctccactggcctcgatgctctcaacgatgtcaaatatctcggggtgcgcaagaccgcccaatactccatcgaccaaggtcctggtctcgttaattcccgcgggccacgaaaccgagcggagggacgttcacccccccaaatgaatgcgccctgccgacatgttttaagaaccccggaactccatgatacgggcttcctcgctctttttggggtccccccttgggggatacttggctccctgccctggtttggctgggccagcgcattctaaaaccaattcctcagataaaagcttgccctttggggcctttgtgccaactcgtttctttgtatggtaagagccgtctgggagtccctttttgtttccccccccct

SEQ ID NO: 61563 - DNA, 633 bp, Zea mays
  misc_feature: Ceres CLONE 1524375
  misc_feature: SWISSPROT Homolog: EC 1.2.1.13 Glyceraldehyde-3-phosphate dehydrogenase (NADP(+)) (phosphorylating)
atagctggagctccccgcggtggcggccgctctagaactagtggatcccccgggctgcaggaattcgtctcacccctagaaaaaatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgccgcgctcaacatcgtgcccacgtccaccggcgccgccaaggccgtctcgctggtgctccccaacctcaagggcaagctcaacgggatcgcgctccgggtgcccaccccgaacgtctccgtcgtcgacctcgtcgtgcaggtctccaagaagaccctcgccgaggaggtgaaccaggcgttccgcgacgccgcggccaacgagctcacgggcatcctcgaggtctgcgacgtgccgctcgtgtccgtcgacttcaggtgctccgacgtctcctccaccatcgacgcctccctcaccatggtcatgggcgacgacatggtcaaggtcatctcctggtacgg

SEQ ID NO: 61564 - DNA, 586 bp, Zea mays
  misc_feature: Ceres CLONE 1524381
  misc_feature: Encodes the peptide sequence at SEQ ID NO. 61565
  misc_feature (72)..(72): n is a, c, t, g, unknown, or other
  misc_feature (586)..(586): n is a, c, t, g, unknown, or other
acccgcggtggcggccgctctagaactagtggatcccccgggctgcaggaattcgtctcacccctagaaaanacagcccagcggctcagccctatccccgttccgtccgtccgtcctgacctcggctccccgggcagcggcgcccggcgcaccacacaggctttctccaactatccgccctcgccatggccatgaccgtggcatccgcctggcttccgtcgaccgcctctcgccggagaatcttatcctctccgctcccttcgttcgcggctcctatctccatccacatgccacggcgggcgccgcctcccagtcccttccctccaaagccgcgcctcttcgtcgcctccgcgcagctcgatttctccagagctgttcaaacagcatggaaggtcggcaacgatgctgtggaggcaggaagtaatcttgtcccaggttcagttccacgaccaattgcccaggataggtgttgccctttgcttgctgtgtccagttgcctttttcccttggccaaatcccattggggccccctgcattttatttgtttctgggcaaaggaaggggcccccatatatatctcaacctn

SEQ ID NO: 61565 - protein, 61 aa, Zea mays
  misc_feature: Ceres CLONE 1524381
MLWRQEVILSQVQFHDQLPRIGVALCLLCPVAFFPWPNPIGAPCILFVSGQRKGPPYISQP

SEQ ID NO: 61566 - DNA, 649 bp, Zea mays
  misc_feature: Ceres CLONE 1524404
  misc_feature: Translation starting site: 97
ggtggcggccgctctagaactagtggatcccccgggctgcaggaattcgtctcacccctagaaaaaatccgcgcccgtccagaccatgcctccaccatggcgacggacagactactgagctcctccttcgccatgcccgccgccgcccgtagggcctcctccccttcctccgcctcattgagcttcgccaagtcgcagctcgccggcctctccctctccgccggcgttgcaactccaaccgacgtctgcctcctcccccaaaggaaacatctccggccaatcggcgcccaccgtgtatggccattcagccatgacaacacaaaccgggggagagaagcgtccgtctatagggaccaaaagaggaaccaacgtgactagaatgaggcgggagacccactgggacgacgaggaccggcaacgtcgtcaccgtctatcacgatcctaaaacgccctacccagcggcggtgaggaccaactacgcgaactaccccggagatgtctacatccacctacgccttggacgagatcctccaattgaaaatgcaagaggccatggctgggaataacccatgcattcgcgtgatctggggcgaatcagcaaggctgctgcctacctgccacctgcccaacctcacccctccaaatcact

SEQ ID NO: 61567 - DNA, 654 bp, Zea mays
  misc_feature: Ceres CLONE 1524406
  misc_feature: Encodes the peptide sequence at SEQ ID NO. 61568
tggagctccccgcggtggcggccgctctagaactagtggatcccccgggctgcaggaattcgtctcacccctagaaaaaaaaccctatctaaaccgcggcggactcttcgtccagcaaggtttcccatccagatccggccacgccacttgctcctcttctccgccacaccgatggtgtacgtggattcctgggacgagttcgtggagcggtccgtgcagctcttccgcggcgaccccaacgccacccgctacgtgatgaagtaccggcactgcgaggggaagctcgtgctcaaggtcaccgacgaccgctagtgcttgaagttcaagacagatcaagctcaagacgcaaagaagatggagaagctcaacaacgtcttttttgctctcatgacacgtgggcctgatgccgatatcagcgaagtttcacggaaggaacacgctgagcaacagcaagcgaataaaggtcggggaaggacgcaataatgcggtccgatccttattcgttacagaaaattcacaactggaatgatggattaacatttcatcgactttttgtactccgaagaacgtttttccagtacagaaccgagaaccaactaaacgcactctatcacgaacgaccgcacgatcgagaaacgccccaaaacaaaaaaa

SEQ ID NO: 61568 - protein, 46 aa, Zea mays
  misc_feature: Ceres CLONE 1524406
  misc_feature (2)..(47): Pfam Name: SRP9 Pfam Description: Signal recognition particle 9 kDa protein (SRP9)
MVYVDSWDEFVERSVQLFRGDPNATRYVMKYRHCEGKLVLKVTDDR

SEQ ID NO: 61569 - DNA, 642 bp, Zea mays
  misc_feature: Ceres CLONE 1524407
  misc_feature (156)..(156): n is a, c, t, g, unknown, or other
tggcggccgctctagaactagtggatcccccgggctgcaggaattcgtctcacccctagatattcccggccgccgccaccacttgctcgcctttgccccttccccttctgtcacccttcgtccgtagcagaccaggaacgcccaaggcgctagcgntctccaaggattggttggctttgcaaaacgaccattgaacttttactccaatccaaccgtgaagaagctttgggaaaagttttaaaggcaacaagaaatgaaatcgggcttagttccaaattccccccaattccctttccttccacgggaaaagccaaagttgccagagggcttgtttttcaaaatttaatcccccattgggggtatttaaaaccaaactcttccataaatttgtgtgttggtttggtgtggtggtccctctccgaggttttttctccaaaaacccttggtttcttttttggaaaaaaaacaaatacccccgtgtgggggggaaaaaaaggatctaccgaagctttcttcccctcctggggtggtggaggaggcgtctcaccttctacaaccacccacaattaatatgtgaggggcattaatttaagtcgtgcgtgccgtctgggcgttcctttttatcgttctgtcttaatttaa

SEQ ID NO: 61570 - DNA, 771 bp, Zea mays
  misc_feature: Ceres CLONE 1524415
  misc_feature: Encodes the peptide sequence at SEQ ID NO. 61571
  misc_feature (1)..(1): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (37)..(37): n is a, c, t, g, unknown, or other
  misc_feature (39)..(39): n is a, c, t, g, unknown, or other
  misc_feature (705)..(705): n is a, c, t, g, unknown, or other
naaaaaaaaaantaaannttttttctctctccgtcgntnttttcttcccaccaaagctggggctccccgcggtggcggccgctctagaactagtggatcccccgggctgcaggaattcgtctcacccctagaaaaagcgaacgatccagaagcagaagccaccgatcggcgtgccgcgtgcgtgaggcgatcggagcatcccgtcccgaggaggaagacaaccggcgacgcggggggaacatggggaagacgccggtgcggatgaaggcggtcgtgtacgcgctgtcgcccttccagcagaaggtaatgccggggctgtggaaggacatcaccaccaagatccaccacaaggtcaccgagaactggatctccgccacgctcctcctcacccccgtcgtcggcacctaccaatacgccatgtggtacaaggagcaggagaagctttcccacagatattaaatgcgctgcccttgacagacagcactcggagtttttcatgatgggtttcataatcctcccatgatgatttaccgtttgtttggatcaattttcagtcaacgcccttttcctccgttccatatgcatatatgggaatccgtggtctggcaaaaccttttttttgagggttgggtcaataatgttccctttttgccctcctggagatttggttaaaatagaaggcaagattaacctttccccaaaagnaaggctagcctgccgcccctgtgccaccggggtcttgatcgttggtggtccacgctagctatccac

SEQ ID NO: 61571 - protein, 72 aa, Zea mays; identical to SEQ ID NO: 46899
  misc_feature: Ceres CLONE 1524415

SEQ ID NO: 61572 - DNA, 661 bp, Zea mays
  misc_feature: Ceres CLONE 1524420
  misc_feature: Encodes the peptide sequence at SEQ ID NO. 61573
catagctggagctccccgcggtggcggccgctctagaactagtggatcccccgggctgcaggaattcgtctcacccctagaaaaaatacgccgccatattcgcaagccaccgcaaccgaagcgcgccttcgccgccgcccccgcccccgccgcctctgcgatccccgcaaggtcgcaaacatgtctaccgtgctccagcgcccgacccccggcacggtccagtgcttcggccacaagaagacggctgtggccgtcgcctacaccaagccggggcgcgggctgatcaaggtgaacggcgtccccattgagctcatcaagccggagatgctccgcctcaaggccttcgagcccatcctgctggcggggcgctccaagttcaaggacatcgacatgatgatccgcgtccgaggcggcgggaagacctcgcagatctacgccatccgccaggccgtcaccaaggagatcgtcacctactaccagaagtacgtcaacgaggccgccaagaaggaggtcaaggacatcttcacccggtacaaccgcacccttctcgtcgacgaccccaagcgctgcgagccctacaagttcggtggacgtggcgcccgctccaggttccagaagtcctaccgttgagcgctcagctgcccgctcttgccggacacta

SEQ ID NO: 61573 - protein, 149 aa, Zea mays
  misc_feature: Ceres CLONE 1524420
  misc_feature (17)..(149): Pfam Name: Ribosomal_S9 Pfam Description: Ribosomal protein S9/S16
MSTVLQRPTPGTVQCFGHKKTAVAVAYTKPGRGLIKVNGVPIELIKPEMLRLKAFEPILLAGRSKFKDIDMMIRVRGGGKTSQIYAIRQAVTKEIVTYYQKYVNEAAKKEVKDIFTRYNRTLLVDDPKRCEPYKFGGRGARSRFQKSYR

SEQ ID NO: 61574 - DNA, 658 bp, Zea mays
  misc_feature: Ceres CLONE 1524421
  misc_feature: Encodes the peptide sequence at SEQ ID NO. 61575
  misc_feature (356)..(356): n is a, c, t, g, unknown, or other
  misc_feature (540)..(540): n is a, c, t, g, unknown, or other
  misc_feature (653)..(653): n is a, c, t, g, unknown, or other
aagctggagctccccgcggtggcggccgctctagaactagtggatcccccgggctgcaggaattcgtctcacccctagaaaaaacgccgccagtcacgaccacgccgcgcctccgcctggaaccctttagccgagcggagcaagggaagaaatggggaagggtacgggcagcttcggcaagcgccggaacaagacgcacacgctctgcatccgctgcggccgccgcagcttccacctccagaagagcacttgctcctcctgcggctaccccgccgcccgcatccgcaagtataactggagtgtgaaagccatcaggcgtaagacaactggtaccggaaggatgaggtacatgcgancacgttcctcgccgtttcaagagcaacttcagagaagggactgaggctgccccaaaagaagggtgtgtgctgctgccaactaaagtgtgggcttgctgcccatcaagaagtgctagaacttgagactttttgattgaattggaccttctgaactctttagccccataaaaccatgcttgaattnaattcaaacgccctggagagggatggatatgtattccttttttggtgagaaaaaaaaaaaaaaacgagaccctcgaggtacccattcgccccatagtgaggccgattacgcgnctccc

SEQ ID NO: 61575 - protein, 82 aa, Zea mays
  misc_feature: Ceres CLONE 1524421
  misc_feature (2)..(55): Pfam Name: Ribosomal_L37e Pfam Description: Ribosomal protein L37e
  misc_feature (69)..(69): Xaa is any aa, unknown, or other
MGKGTGSFGKRRNKTHTLCIRCGRRSFHLQKSTCSSCGYPAARIRKYNWSVKAIRRKTTGTGRMRYMRXRSSPFQEQLQRRD

SEQ ID NO: 61576 - DNA, 676 bp, Zea mays
  misc_feature: Ceres CLONE 1524426
  misc_feature: Encodes the peptide sequence at SEQ ID NO. 61577
tccccgcggtggcggccgctctagaactagtggatcccccgggctgcaggaattcgtctcacccctagaaaaagacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagacagggcaagggcaaaggcgtgtaccagttcgtcgacaagtacggcgcgaacgtcgacggatacagcccaatctacaacgaggatgactggtctcccaccggcgacgtcttacgtcggtggaaacccctgggcttctgatctgggccgtcaccctcgctgggaatcctccggcggcggggcccctccttcgtcttcaaaaaccagcgcccctctcccggtttaaggaattccccaatgcctggcccgcttccttgccaatatcccccaggtaaaaaaaccaggggggggccgtggctaaaaaatccacaccctccccggggaagggcccccaaccccttct

SEQ ID NO: 61577 - protein, 103 aa, Zea mays
  misc_feature: Ceres CLONE 1524426
  misc_feature (32)..(103): Pfam Name: PsbR Pfam Description: Photosystem II 10 kDa polypeptide PsbR
MAASMISSSALAVAPQGLPPLGRRASSFAVVCSKKKIKTDKPYGIGGGLTVDVDANGRQGKGKGVYQFVDKYGANVDGYSPIYNEDDWSPTGDVLRRWKPLGF

SEQ ID NO: 61578 - DNA, 665 bp, Zea mays
  misc_feature: Ceres CLONE 1524428
  misc_feature: Encodes the peptide sequence at SEQ ID NO. 61579
ggagctccccgcggtggcggccgctctagaactagtggatcccccgggctgcaggaattcgtctcacccctagaaaaaatgaaggggcataatgctggtgcttcccatttgcctgcgaactcaaagctagctgatgatgcctgcatgcagatagagaaacagtttctctctgaagttgaatatgctgaagaactagccagcattgtgggacagatagctgatggtacagagatgccagatgcaattgaaatgatatttcagtcggctttactcatacgaaggcgaggcggtgttgatgaaatgtttgggaaagccgcggatgccatgactgggtatatgagggcggtatccatgctgcgggttctcctgggcgagggacgatcactcgccctcaacccccctttgactctaacgagatccgatcggaatcgactgcgcacataccttgacgctctcacccccaggctctgtcagatgcagagcccgaggcattgactgctgccatgcccccctccaattttgtccaggttgaggggcggggggacttcgcccaatattctgttcttctggaaaaataaattttggttggccccaaacctaggggcataagtaaaaactgcccccaacctggggggaacctaggggccaaagcacccgaaaaattt

SEQ ID NO: 61579 - protein, 164 aa, Zea mays
  misc_feature: Ceres CLONE 1524428
GAPRGGGRSRTSGSPGLQEFVSPLEKMKGHNAGASHLPANSKLADDACMQIEKQFLSEVEYAEELASIVGQIADGTEMPDAIEMIFQSALLIRRRGGVDEMFGKAADAMTGYMRAVSMLRVLLGEGRSLALNPPLTLTRSDRNRLRTYLDALTPRLCQMQSPRH

SEQ ID NO: 61580 - DNA, 756 bp, Zea mays
  misc_feature: Ceres CLONE 1524429
ggagctccccgcggtggcggccgctctagaactagtggatcccccgggctgcaggaattcgtctcacccctagaaaaaattctgggtttgactctctgccttcatgcctgcttccctccctccgtcagatccccgctcggtttgccatggcggaccagctcaccgacaaacagatctccgagatctaggaggccttcatgctcttcgagcatgacggcgacgggtgcctcagccgcaggaacttgccattgtgatgctctgattggggaagaaccctaacaccgactgacctctacgacatggtcggtggggtgactgctgatgtcaatggcaacctcagatatgctgaggtttctcggcgtgaatgggtcgcatgaagaattacacccgactcctgaggacgggatcccaaaggacgcccttccggtgatgttggaaagaggatccccaaacggggtacattctaccggctgggggaaacctccgggggtgctcttgaaccagggcctcgggcccaccataggctgacggatacctacggaggggggaactacccattcatccctgttaaaaaccctccgacgggcccgtctgcatgggccaaggataaatcctcatggaccagtctccttttaatggcgcttatcaatgggccaaaaaagaaaatgtggcccctactcgtttttttaactcataatttcccgggcccctgccatggcccattacccttagtgtccagcgtttatagcggagcgg

SEQ ID NO: 61581 - DNA, 883 bp, Zea mays
  misc_feature: Ceres CLONE 1524429-R
  misc_feature (883)..(883): n is a, c, t, g, unknown, or other
ctcgagcgtctcgtttttttttttttttttgtccttcataacacaactgtcattccaacagctccccatccttgactcctttcagccatcttgtcatccgttgctgacaaagccacctttatgtctgatgccggagagctccgggtgaggagaggccaattgagacccggcttcagaacttcctactgactgacatacggtcaggtggtcatttggcaatcccggccgtctctgccttgcccgtggtcatgttgatcaactcgggggcgctgatgtcggtgtcagactcgacgacggctctgcagggtcatgctgtgcgtgtcctcgtccgtcagcttctcgactaggtttgctattatatcccgaacctgacctgcgaacatgaagccgttctggtgcttgtctgaattgacggaagggctccttgagtctctcctcagagtccgtgtccttcatcttggcctccattgtgttgagaaactccggaaagtcgatggttccgttgacatcagcgtcaacccctttgatcctgtggtgaagcttagcctcattaggatttttccccaatgaggcgcattaccagtgccaagtttcttggtgggtgatgcaaaccgtctccctttcttttttcaaaaaggcttaaggccccctttgaaccccgggaattctttttcgtccccttagcttggtccgcccctgtcaaatccggagccgggtattttgactgaaagggaggagaaacctgtcttggaaagccctataggtgtaaaccccggaatatttttttcttggtggtggaaaaccaaagtccctgcgttttcccgtgggggactttatttattttttttacatggattttccccccctccctctctcgttgtgn

SEQ ID NO: 61582 - DNA, 632 bp, Zea mays
  misc_feature: Ceres CLONE 1524432
  misc_feature: Encodes the peptide sequence at SEQ ID NO. 61583
atagctggagctccccgcggtggcggccgctctagaactagtggatcccccgggctgcaggaattcgtctcacccctagaaaaaaccatcacattggaatccacacaagcacttcgacgtcacacgggcgctgcgcacagacacaccaagcgtcggcaccaatggcttactaccaggaggtggactactgctcggaggaggtgaggtcggtggcccccgccggcttcggccgccacgggggccgagtccagcaggacgtcgtcaaggagaacttcgaggaggtcgacaccgtctcacgcgccggcgcctaccaccaccaccaccatggtcaccacggcggccacggcttcatggtgcgcgagaccagtgtcgaaaacgacatcaactcctgcaccggcgagttccactagcccagggagagcttcctcgccacggctaactgagccgcccggccgccggcatccacgcccgttcatgcttgcctgcgcgccttatgtatgtctgtaattaacaggctgtacaaggtcatcgtacttggctatcgtaagtgcacgcactcttctcctgtacgaattacaaccataagctcgtgacctgaataaaacttcgtcgtaatactaaaaacaaaaaaa

SEQ ID NO: 61583 - protein, 82 aa, Zea mays
  misc_feature: Ceres CLONE 1524432
MAYYQEVDYCSEEVRSVAPAGFGRHGGRVQQDVVKENFEEVDTVSRAGAYHHHHHGHHGGHGFMVRETSVENDINSCTGEFH

SEQ ID NO: 61584 - DNA, 649 bp, Zea mays
  misc_feature: Ceres CLONE 1524446
  misc_feature: Encodes the peptide sequence at SEQ ID NO. 61585
tccccgcggtggcggccgctctagaactagtggatcccccgggctgcaggaattcgtctcacccctagaaaaaagtgacggccagcatatctcctcgcattttccttgcaaccgattgcctatccccctcccaacccagaaccgatggcgcccaaggccgagaagaatcccgcggcgaataaaccagcggaggaggagcccgcgacagagaagacgaccgccgggaagaatccccagggggataagcgggtcccctcgggcaagtcggccggcaaggagggcggcgagggcaagcgtggctcgagcaaaggcccgaagagcgtggagacgtacaagatctatctcttcaaggtgcttgaagcatgtgcacgccggacatcgtggtctcgtccaaggccatgtccatcgtgaactccttcatcaacgacatctttcagaagctggacggcgaggccgccaagctcgagcgctacgacaagaatcccaccgtcacgtcccgcgagatccagagctccgtgcgcctcgtgctctccggggagctcgccaagtacgccgtctctgaaggcaccaatgccgtctccaagttcacctcctcctaggcttgcacgctcgccctttgtaggtatctcttgtgttgatgttccccttg

SEQ ID NO: 61585 - protein, 78 aa, Zea mays
  misc_feature: Ceres CLONE 1524446
MCTPDIVVSSKAMSIVNSFINDIFQKLDGEAAKLERYDKNPTVTSREIQSSVRLVLSGELAKYAVSEGTNAVSKFTSS

SEQ ID NO: 61586 - DNA, 594 bp, Zea mays
  misc_feature: Ceres CLONE 1524447
  misc_feature: Encodes the peptide sequence at SEQ ID NO. 61587
aaagctggagctccccgcggtggcggccgctctacaactagtggatcccccgggctgcaggaattcgtctcacccctagaaaaaaccgacccacccggctgccagccatggctgagaatctggcgcccgagaagcgccactccttcgtgcacaacgggcagaaggtgttcgagtgggaccagacgctggaggaggtcaacatgtacatcgagctcccgaagggtgtgccaaccaagctatttcactgcaacatccaggctagccacgtcgaggtcggcatccgcggcaacccgccatacctcaaccatgacctgacacacccagtgaagactgactcgtcgttctggacaatagaagacggtgagatgcatataacactgcaaaaaagagagaaaggggaaaacatggtcatctcccatacaagggcaagggattttggatccataatgctgcaaatccaaaacaaaagccgcttttgctccaaaaggtttcaagaaaagaaaccctgggggtccaactttttccaagggctcaatttcatgggaaaccgggccctgaacccaagaaaccttttcttggagaaggaaaacgccc

SEQ ID NO: 61587 - protein, 162 aa, Zea mays
  misc_feature: Ceres CLONE 1524447
  misc_feature (19)..(93): Pfam Name: CS Pfam Description: CS domain
MAENLAPEKRHSFVHNGQKVFEWDQTLEEVNMYIELPKGVPTKLFHCNIQASHVEVGIRGNPPYLNHDLTHPVKTDSSFWTIEDGEMHITLQKREKGENMVISHTRARDFGSIMLQIQNKSRFCSKRFQEKKPWGSNFFQGLNFMGNRALNPRNLFLEKENA

SEQ ID NO: 61588 - DNA, 681 bp, Zea mays
  misc_feature: Ceres CLONE 1524448
  misc_feature: Encodes the peptide sequence at SEQ ID NO. 61589
tctgaactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacggcggcccccgatctttcggcgggaagcacggggcgggcttgctcccgcaaggcgccagggtggaggaagttctaccgtcatccacgtggaaacgtcccccccaaaggagcaagggggttcccaaaatgcccaaccgggcgggcgcccccccatcattgccgggaaggggcccccacacctccttgaaaacctgggccccgcaagggaacaaatggccccgggcaaggcggcccccacagttttgcgcctcccaagtacaaaaatccacctaccccattttccccccccggcccttccccccaacaggtgaaggagccagaaacccctcccccccaaaagagaagggtgtctg

SEQ ID NO: 61589 - protein, 129 aa, Zea mays
  misc_feature: Ceres CLONE 1524448
MAMATQASAATRHLLAAAWAPAAKPRQLSSQLALPSSSSRGPAPLRASTEEAVEAPKGFVAPQLDPSTAAPDLSAGSTGRACSRKAPGWRKFYRHPRGNVPPKGARGFPKCPTGRAPPHHCREGAPTPP

SEQ ID NO: 61590 - DNA, 492 bp, Zea mays
  misc_feature: Ceres CLONE 1524450
  misc_feature: Encodes the peptide sequence at SEQ ID NO. 61591
  misc_feature (388)..(388): n is a, c, t, g, unknown, or other
atagctggactccccgcggtggcggccgctctagaactagtggatcccccgggctgcaggaattcgtctcacccctgagaaaaagcaaaccagacatctgatgttgcgttagtggactagagagctccgtccggttcacatccggtgcggtacatcggaggccaagcagctctttgcgcggtgttcacccaccgccgcctcgtgtctcccaattccgtctcgttctgcagtgattccacaccgcaagtgggcagccatgtatggcgtgcgccctcgccgtcgcctggcctgagcgtctctcgcgcctccggaagaggaacctctccgcggcgccccatggtgcgtctccagacttcagcagcagagggcgtcactgctgctgccccgncagcgctcgcagaagacagcagtcgtggtgggtggtagccgcgaggcttttgcaccgcctcgctgaagcgatcgccgagaatgcgatgccaccgagtacaagtt

SEQ ID NO: 61591 - protein, 77 aa, Zea mays
  misc_feature: Ceres CLONE 1524450
  misc_feature (43)..(43): Xaa is any aa, unknown, or other
MACALAVAWPERLSRLRKRNLSAAPHGASPDFSSRGRHCCCPXSARRRQQSWWVVAARLLHRLAEAIAENAMPPSTS

SEQ ID NO: 61592 - DNA, 658 bp, Zea mays
  misc_feature: Ceres CLONE 1524458
  misc_feature: Encodes the peptide sequence at SEQ ID NO. 61593
catagctggagctccccgcggtggcggccgctctagaactagtggatcccccgggctgcaggaattcgtctcacccctagaaaaaaaatgaaacttgcgctccgctgtcccgtctcctctgcggtcgccacctatggatcatcccctcgtatcgtatgggcttgtttgttggcgtcttctcgctgtagggaactccgttctccggccccggctgtgcgtggcgtcagtgcgccacgccaacgacggaggtgagagctgctgaccctgacgcctgactatgaacccaacgcttgtgtccagattggactggtggctgaaccgcgtagagatcctgcgcttcgccggagctgtggccctgcagctgaccacagggtaaaagcgtgctctcacaaagtgatattgaacgctcctgagacgactctagaactggcactcacccgcgtgcctctggacgtcactgactgcctcatctttcagtacggtactcgatactgatgtctgaattgtcaaacttcccaatacactggcataagtctgtcacacgcctgtacttggcatgtctatgctgctggaggttacttgccttcacaggatgctgatgaatatcactatgcgaagcagctcattatgattattatgcacgcatttgtgtctactg

SEQ ID NO: 61593 - protein, 42 aa, Zea mays
  misc_feature: Ceres CLONE 1524458
MDHPLVSYGLVCWRLLAVGNSVLRPRLCVASVRHANDGGESC

SEQ ID NO: 61594 - DNA, 657 bp, Zea mays
  misc_feature: Ceres CLONE 1524460
  misc_feature: Encodes the peptide sequence at SEQ ID NO. 61595
  misc_feature (302)..(302): n is a, c, t, g, unknown, or other
  misc_feature (324)..(324): n is a, c, t, g, unknown, or other
  misc_feature (644)..(644): n is a, c, t, g, unknown, or other
ggagctccccgcggtggcggccgctctagaactagtggatcccccgggctgcaggaattcgtctcacccctagaaaaaatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcancactacgctgacctttccgacnagcctttcttccccgggttggtggagtacatcatttcccgccccccggggggggaggggggggggagggaaagacatcttgttgactggccccaggatcattgggggccaccaggccttgggagggagcccccggtaccatttctggggaactacccccgggaaatccgcaaggattgcctcccctggaaaacaattcccgggaaaaacgggaaaaaagaaaaccctcctctgggtcccccggaaggggggggcaaaggggaaaaaaaacccttttttccctggattttaaaagggttttgacacttttaactttggtgngcctttgcctggc

SEQ ID NO: 61595 - protein, 154 aa, Zea mays
  misc_feature: Ceres CLONE 1524460
  misc_feature (2)..(115): Pfam Name: NDK Pfam Description: Nucleoside diphosphate kinase
  misc_feature: SWISSPROT Homolog: EC 2.7.4.6 Nucleoside-diphosphate kinase
  misc_feature (47)..(47): Xaa is any aa, unknown, or other
  misc_feature (55)..(55): Xaa is any aa, unknown, or other
MEQTFIMIKPDGVQRGLIGDIISRFEKKGFYLKGMKFMNVERSFAQXHYADLSDXPFFPGLVEYIISRPPGGEGGGRERHLVDWPQDHWGPPGLGREPPVPFLGNYPREIRKDCLPWKTIPGKNGKKENPPLGPPEGGGKGEKKPFFPWILKGF

SEQ ID NO: 61596 - DNA, 670 bp, Zea mays
  misc_feature: Ceres CLONE 1524462
  misc_feature: Encodes the peptide sequence at SEQ ID NO. 61597
  misc_feature (301)..(301): n is a, c, t, g, unknown, or other
  misc_feature (379)..(379): n is a, c, t, g, unknown, or other
  misc_feature (394)..(394): n is a, c, t, g, unknown, or other
cgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaangctgcgctgtccgtgtccgcgtcgtccacgctggcgggcgccttccctcgcgcgctggcgtcgtcgcccgacgctgcnctgggcgacgtggcngcggcggaagccggcggcgacagcccgcggcagctgctgctcgtcgtggggggcccgccatcggtgggtgctgtaacacatcctgcaaccggggctgaaacaactgaaacgcatgtcccacaacccaagccctgggcccccggcctggggcctcgggccccccccccgccccccgggaaggggggccccccccccaaaacccccccccccccggggggggagaaacccccggggaaaaacccccccccccccgccccccccacaaaaaaaaaccgc

SEQ ID NO: 61597 - protein, 164 aa, Zea mays
  misc_feature: Ceres CLONE 1524462
  misc_feature (41)..(41): Xaa is any aa, unknown, or other
MATIATMALLKPAAKAAARSAPSTSSGSVSLRVRTGQAAKXAALSVSASSTLAGAFPRALASSPDAALGDVAAAEAGGDSPRQLLLVVGGPPSVGAVTHPATGAETTETHVPQPKPWAPGLGPRAPPPPPGKGGPPPKTPPPPGGEKPPGKNPPPPAPPTKKNR

SEQ ID NO: 61598 - DNA, 660 bp, Zea mays
  misc_feature: Ceres CLONE 1524463
  misc_feature: Encodes the peptide sequence at SEQ ID NO. 61599
  misc_feature (276)..(276): n is a, c, t, g, unknown, or other
  misc_feature (277)..(277): n is a, c, t, g, unknown, or other
  misc_feature (279)..(279): n is a, c, t, g, unknown, or other
  misc_feature (282)..(282): n is a, c, t, g, unknown, or other
  misc_feature (334)..(334): n is a, c, t, g, unknown, or other
  misc_feature (359)..(359): n is a, c, t, g, unknown, or other
tccccgcggtggcggccgctctagaactagtggatcccccgggctgcaggaattcgtctcacccctaaaaaaagactctgactctcatctgaagcgcgcgagagaaacgcgtatacccaggcggcggttgaggaagatgaggagaagaagaagaagatgggttcctccgcatacgcctcatggtccaagcggtggatccgtcccgaggtgtacccgctgttcgtgccgatggccgtggccttgggcatctgctcgtaccagcttgtgggcaacatnncnggnaaccccgaggggcgggtgaccaaggagaagagggcggccgagggcctggacnaccccgaaaagggcgagaggtacgntatggaggggctcaggaagttcggccgcgggaggaagccggagatcatgggctccatcaactccttcttcgccgaccctcccaaggacgattatcttagattggggcacggatggatggatgaaaggattcccaattcccgatcgcccatagtatgttttaccattcgtttagttggtggcgggggcgccttggtttcgaacccggccgggggtacatttgacagaagaaaaaaaaaaatttcaattttcccccatgaaaaatgggaaacgtccgggccttttctgtgtcttaaaaaaaaa

SEQ ID NO: 61599 - protein, 168 aa, Zea mays
  misc_feature: Ceres CLONE 1524463
  misc_feature (10)..(96): Pfam Name: B12D Pfam Description: B12D protein
  misc_feature (40)..(40): Xaa is any aa, unknown, or other
  misc_feature (41)..(41): Xaa is any aa, unknown, or other
  misc_feature (60)..(60): Xaa is any aa, unknown, or other
  misc_feature (68)..(68): Xaa is any aa, unknown, or other
MGSSAYASWSKRWIRPEVYPLFVPMAVALGICSYQLVGNXXGNPEGRVTKEKRAAEGLDXPEKGERYXMEGLRKFGRGRKPEIMGSINSFFADPPKDDYLRLGHGWMDERIPNSRSPIVCFTIRLVGGGGALVSNPAGGTFDRRKKKISIFPHEKWETSGPFLCLKKK

SEQ ID NO: 61600 - DNA, 649 bp, Zea mays
  misc_feature: Ceres CLONE 1524465
  misc_feature: SWISSPROT Homolog: EC 1.5.3.11 Polyamine oxidase
  misc_feature (624)..(624): n is a, c, t, g, unknown, or other
ggagctccccgcggtggcggccgctctagaactagtggatcccccgggctgcaggaattcgtctcacccctagaaaaaatttgagaaggtactggaaacacttaggaaaatcttttcacccaagggcattgaagttccaaatccgttgcaagcaatatgtactcgatggggcacagacaggtttacttatggatcatactcatatgtggctattggggcttctggtgatgactacgacattttggccgaaagtgtgcatgatagagttttctttgctggggaggcaacaaataggcggtacccagctacaatgcatggagccctgcttagtgggtatagggaggctgctaacatcttaagggcagctagaaggagagcaaaaaatgtgtactcacctgagaaaatggatattaatgttgatgtaaaagtgggtgttaatggtgaagtaaaagacactgttagagatagctgcattgatttggatgacctattccgttctcctgatgctgcttttggcgggttctcagttctccatgacccatctacctctgaaccagactcagttttctttgctgcgtgtttggaattgggtgctagaaagttaggtgctggttcacttttccntctatgggataataatgagaaagca

SEQ ID NO: 61601 - DNA, 639 bp, Zea mays
  misc_feature: Ceres CLONE 1524470
  misc_feature: Encodes the peptide sequence at SEQ ID NO. 61602
  misc_feature (314)..(314): n is a, c, t, g, unknown, or other
  misc_feature (321)..(321): n is a, c, t, g, unknown, or other
  misc_feature (474)..(474): n is a, c, t, g, unknown, or other
tccccgcggtggcggccgctctagaactagtggatcccccgggctgcaggaattcgtctcacccctagaaaaaaccgacggcatttgcatctgagttcctgattgttgtattccagtttcttctgtgagttttgtgggatcgcgaggaagaactagaaggatgtcgtgctgcggaggcaactgcgggtgcggcgccggctgcaagtgcggcagcggctgcggagggtgcaagatgtacccggacatggctgagcaggtgaccaccactacccagactctcatcatgggtgttgcaccgtccaaaggcgggttcnaagcggnccgccggagctgagaacggcggggtgcaagtgcgggggcccactgcacctgcgacccctggcactgcaagtgaaacgacggcgatgacgctgcagggcgtcatgggatccgaaggacctcttttacctaagctctagtataaaatcccaacantgccgttggggttttggtccaatccatcaaaacttcaccccctgggccgggggcatgggaaaaaaaggccttgccccccctttattggccccacgccctttttcccggggggggccgggggggggaacaaaaaattttccccaaatttggggcccccgtgttttg

SEQ ID NO: 61602 - protein, 57 aa, Zea mays
  misc_feature: Ceres CLONE 1524470
  misc_feature (1)..(53): Pfam Name: Metallothio_2 Pfam Description: Metallothionein
  misc_feature (52)..(52): Xaa is any aa, unknown, or other
  misc_feature (54)..(54): Xaa is any aa, unknown, or other
MSCCGGNCGCGAGCKCGSGCGGCKMYPDMAEQVTTTTQTLIMGVAPSKGGFXAXRRS

SEQ ID NO: 61603 - DNA, 629 bp, Zea mays
  misc_feature: Ceres CLONE 1524473
  misc_feature: Encodes the peptide sequence at SEQ ID NO. 61604
  misc_feature (437)..(437): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (575)..(575): n is a, c, t, g, unknown, or other
  misc_feature (576)..(576): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (585)..(585): n is a, c, t, g, unknown, or other
  misc_feature (587)..(587): n is a, c, t, g, unknown, or other
  misc_feature (588)..(588): n is a, c, t, g, unknown, or other
  misc_feature (591)..(591): n is a, c, t, g, unknown, or other
  misc_feature (592)..(592): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (611)..(611): n is a, c, t, g, unknown, or other
  misc_feature (614)..(614): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
acccgcggtggcggccgctctagaactagtggatcccccgggctgcaggaattcgtctcacccctagaaaaagtcttctcccctgcgtcaaagacgacgcaagcccttgcctctccctactccaaaccctcgccgactcagatccagcttcctcgcaccgccgtcgccatgccgttcactccaggcccctactctggcgtcagcaccctcgcccttgtggcgagggcgtcggcctttggtgtcggtgtcgtctacgggagcatcaagctctcaatcctcaaggtcacaaaacctaaaaaggaggaagtgcatgatcatcactaaggatgacagggctgctacatgttaattcccatatatgcaaggatgttataaaattggcagtgcaccccttatccatacgtgcaatttcgtttatgatttgtggacctgtctgntacatacctgctggttttttttgtgggtgaataaattcctataccatgactgaatgacctgaaatcaggaagtggaaaaggcaatagtattannnnnnnnnnnnnnnnnnnnnnnnnnnnnnnnnnnnggaaaaaaannaaaannnanannccnnannnnnnnnnnnnnnnnanaanagaaaaaaaaannnc

SEQ ID NO: 61604 - protein, 51 aa, Zea mays; identical to SEQ ID NO: 8218
  misc_feature: Ceres CLONE 1524473

SEQ ID NO: 61605 - DNA, 704 bp, Zea mays
  misc_feature: Ceres CLONE 1524477
  misc_feature: Encodes the peptide sequence at SEQ ID NO. 61606
  misc_feature (421)..(421): n is a, c, t, g, unknown, or other
cccctcccccccgattagtggagctcaccgcggtggcgggcggtctagaaatagtggatcccccggggtggaggaatttgtctcacccctagaaaaaaaaaaaggagggggaacagaacactacccattcccgggaacttcctggcaagctaggtggtctggtcacacgtcacgtctaagcaaacacaagcaagtttgaaatggcggcgagagctagggcagcggcgccgttctggctcctggccgcggccgcggtcacgctgctggtggcggcggcctccgcgcagtccggcggcagcagcagcgacgactgcacgtcggcgctggtgaacctgtccccgtgcatgggctacatcaccggcaacggcacgtctgccccccccccctcgtggtggggcggagctcaagggccgtggtgcantcccaaaccgcattgcctctgcgccccccctcgggaagcgaccccctcctccctcccttcggcgggggtcacccatcaaccggggcgcgcggcggctccggcctccccccgggcttggcaaattaaaaaccccccccccctcagccatgggcaacaaacgggtgcgtccggggcggggggaatcaaaagggaaaccccctcccctgcccatctggggggggggacccccccgggggggcccgccccgcctcttttgggccccgggcctcccccccgagttttc

SEQ ID NO: 61606 - protein, 45 aa, Zea mays
  misc_feature: Ceres CLONE 1524477
MGNKRVRPGRGESKGKPPPLPIWGGGPPRGGPPRLFWAPGLPPEF

SEQ ID NO: 61607 - DNA, 634 bp, Zea mays
  misc_feature: Ceres CLONE 1524481
  misc_feature: Encodes the peptide sequence at SEQ ID NO. 61608
  misc_feature (383)..(383): n is a, c, t, g, unknown, or other
  misc_feature (440)..(440): n is a, c, t, g, unknown, or other
  misc_feature (463)..(463): n is a, c, t, g, unknown, or other
ggtggcggccgctctagaactagtggatcccccgggctgcaggaattcgtctcacccctagaaaaacttccactgcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggaagacgaagagccgncgcagcagggcgaaggcgtgacggtcacggccgtggggcccagcctcgccgaacggnttccgagcaggttccggccgtcncgctacgggcggcgcgggggcggggactgccgcgtgtgcctggtgccgttcgagacggagtccgtggtgcaacgggtccccctgggggcacctctttccacgggcctggcttgaaaacctggaatggaatacgacccagccaccctgcccgttgtgggcccccaccccccc

SEQ ID NO: 61608 - protein, 113 aa, Zea mays
  misc_feature: Ceres CLONE 1524481
  misc_feature (50)..(50): Xaa is any aa, unknown, or other
  misc_feature (69)..(69): Xaa is any aa, unknown, or other
MGISSMPAPEDSLLGFVLYNTAASVAILAGLVRAALLFLGLAAAEDEEPXQQGEGVTVTAVGPSLAERXPSRFRPSRYGRRGGGDCRVCLVPFETESVVQRVPLGAPLSTGLA

SEQ ID NO: 61609 - DNA, 579 bp, Zea mays
  misc_feature: Ceres CLONE 1524483
  misc_feature: Encodes the peptide sequence at SEQ ID NO. 61610
  misc_feature (178)..(178): n is a, c, t, g, unknown, or other
  misc_feature (196)..(196): n is a, c, t, g, unknown, or other
  misc_feature (220)..(220): n is a, c, t, g, unknown, or other
tggcggccgctctagaactagtggatcccccgggctgcaggaattcgtctcacccctagaaaaatccgccggtctcttgctctgatagcttgctccaggacgtacgtacgtacgtagatcgatccatcgatcgctagctagctgacgaccatggcgtccctctcctctgggcgcatcnacgcccttccttcacggncgcgcccgctcgcgcagtgttcancaggaggtcctttcacgtgcgtggctctcttccgcagggcactggcaccgcccccttggcgtttgccccaaggttctgtttggccgggggggggccctgggccaagaagggctgcttggggccaggaaagggggggtcttcttcttaccccacccgttttccctttagggctggggaacccttcctttagaaaaaaacccgggttcccccaaaaatctggttttacaaaaaaaaaaggggggagggggggccacacccccccaaatttcccggggggagtcccccctgcccgccgggggggaacaaattcggcccccccctccccgggggggggggctaaggggtttttttgtgggggc

SEQ ID NO: 61610 - protein, 143 aa, Zea mays
  misc_feature: Ceres CLONE 1524483
  misc_feature (10)..(10): Xaa is any aa, unknown, or other
  misc_feature (16)..(16): Xaa is any aa, unknown, or other
  misc_feature (24)..(24): Xaa is any aa, unknown, or other
MASLSSGRIXALPSRXRPLAQCSXGGPFTCVALFRRALAPPPWRLPQGSVWPGGGPGPRRAAWGQERGGLLLTPPVFPLGLGNPSFRKKPGFPQKSGFTKKKGGRGGHTPPNFPGGVPPARRGGTNSAPPSPGGGAKGFFCGG

SEQ ID NO: 61611 - DNA, 639 bp, Zea mays
  misc_feature: Ceres CLONE 1524484
  misc_feature: Encodes the peptide sequence at SEQ ID NO. 61612
  misc_feature (479)..(479): n is a, c, t, g, unknown, or other
  misc_feature (535)..(535): n is a, c, t, g, unknown, or other
  misc_feature (592)..(592): n is a, c, t, g, unknown, or other
  misc_feature (608)..(608): n is a, c, t, g, unknown, or other
cgcggtggcggccgctctagaactagtggatcccccgggctgcaggaattcgtctcacccctagaaaaacccatatcactcaacgaaaccctaaaaccgctgccgcaaccacgtataaaaacaccgcacgccacgccgccgccgtcctattcctcggagagggagaagccgccgccgcagcaatcacagcagcccggagaaagcccaggtccgacaagatgcacatcttcgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgcttcacctcgtgcttaggctccgcggtggcatcattgagccctcgctgcaggcgctcgctcgncagtacaaccaggacaagatgatctgccgcaaatgctatgcacgactgcaccctanggctgtcaactgccgcaagaagaagtgtggtcacagcaaccagctgagggcaagaangaagatcagaactgangtgctgctcctagtcagtttcatggacaagg

SEQ ID NO: 61612 - protein, 140 aa, Zea mays
  misc_feature: Ceres CLONE 1524484
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature (106)..(106): Xaa is any aa, unknown, or other
  misc_feature (125)..(125): Xaa is any aa, unknown, or other
  misc_feature (130)..(130): Xaa is any aa, unknown, or other
MHIFVKTLTGKTITLEVESSDTIDNVKAKIQDKEGIPPDQQRLIFAGKQLEDGRTLADYNIQKESTLHLVLRLRGGIIEPSLQALARQYNQDKMICRKCYARLHPXAVNCRKKKCGHSNQLRARXKIRTXVLLLVSFMDK

SEQ ID NO: 61613 - DNA, 657 bp, Zea mays
  misc_feature: Ceres CLONE 1524485
  misc_feature: Encodes the peptide sequence at SEQ ID NO. 61614
  misc_feature (373)..(373): n is a, c, t, g, unknown, or other
aaagctggagctcaccgcggtggcggccgctctagaactagtggatccccccgggctgcaggaattcgtctcacccctagaaaaaattaaatagcaacatttttagtgaaatggttaggaccattttcatgactaattttcttttcaggcaaccctgctgatgagctcgtggcactgatcaacagcaaccgcactgctggcaaggcatcttctgtttcggacaaccaaggtttgggatgcatcgctctgcagtacatcaaagcatacgaaggccattgtgaccaggtggacgacaagaagccgatggagtcaagcttcaccgacacgttcgccccgacctgtggcgtccaggccacaaccctctccaagatcnaccggaaggctgggtggcttgccagtcccagtacttggctccagctgaagcctttggcgtcttgttggtgacgaccccaagggccccagatactgcgcaccagaaccaccccgaagtccgggccgccgttaaccgcaccaatggggggtggaccgaattttggggggccctgtttatggaccggaaaccaaattcctctttaagggggggaagggaaaagccccaaaacccccccccccccccgggtatgtctcgtgggaaaacaataaaaaatgcttggcccc

SEQ ID NO: 61614 - protein, 46 aa, Zea mays
  misc_feature: Ceres CLONE 1524485
  misc_feature (24)..(24): Xaa is any aa, unknown, or other
MESSFTDTFAPTCGVQATTLSKIXRKAGWLASPSTWLQLKPLASCW

SEQ ID NO: 61615 - DNA, 856 bp, Zea mays
  misc_feature: Ceres CLONE 1524487
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
ttgtagggaggatttctcgggggcggggagagccaggggggnnnnngtgggnnnnntcaaactggggctccccgcggtggcggccgctctattactagtggatcccccgggctgcaggaattcgtctcacccctagaaaaaggccgttttccgcatccacggagccaggcgaccgccgccgcttccctactcacccttggccggcgacgacgagcgctaccgcggcagggtgacgacgctgaggaacctcaaaatccaaacctccaactgctagaaggatgggggatgcagccgccctcggacgaaaagggagggcgacgacggacggcccgagaatgaatggttgaaaaggaagcggggagaaggcgaccgcttacccaactggcgggggggtaggggcgggaggaacggcggtgggggggatgtaacaaggggggatccctgccgcggaattggggtatagagggggcggggggaggcgggtgccgggcgtgcaagtgttcttcgaggtgggggggggaacgcgtgggccgatacctttaacagcgctggggtcgggggtgggtgggctcaaaccgagcgcgagggtgggatggaggttctcacaccccaccattcgtcttccagcgaacgcaacaacaaaaacggtggaatcgacagcgcgggacgccgcaggcggtgtgaaatatggtggtccacaaatatgtgtagcgtgtgggggtcaggtcgagaccatggggggtggggacccaacgagggggtgggagtggggctagagttactgtttgggtatactatactgtgcgtgaggcagtgcaaaccaggctagattctgtccttttcgaggagttatggg

SEQ ID NO: 61616 - DNA, 623 bp, Zea mays
  misc_feature: Ceres CLONE 1524488
  misc_feature: Encodes the peptide sequence at SEQ ID NO. 61617
gctctagaactagtggatcccccgggctgcaggaattcgtctcacccctagaaaaaatctcagcagtgacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaagcaggcagccacaccaataagctagctcttgttgttgttttgtatgtttgaatgggtgtcccttcccagtcgagatggaataaataaatcatcaggcgcaataaagcagatttttgtgttgttttg

SEQ ID NO: 61617 - protein, 89 aa, Zea mays; identical to SEQ ID NO: 58327
  misc_feature: Ceres CLONE 1524488

SEQ ID NO: 61618 - DNA, 640 bp, Zea mays
  misc_feature: Ceres CLONE 1524489
  misc_feature: Encodes the peptide sequence at SEQ ID NO. 61619
  misc_feature (318)..(318): n is a, c, t, g, unknown, or other
  misc_feature (463)..(463): n is a, c, t, g, unknown, or other
ggagctccccgcggtggcggccgctctagaactagtggatcccccgggctgcaggaattcgtctcacccctagaaaaagaaaccctagaagcctccaccctcctgcgcctccaccctcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttncgctaagctccctggagaaagcgcagtgtttgaggatctaatcctctccgtttggatcttggtggtggcgcctgcttcagtttgcttgctgcccgcccccaactgggaggtggtttggaattttgttggttgccccccggttggngaaggaaaaaaaaggggaaaaaccccccggggggggagttctttagaaaaaaaaaattgggggcgttcttccccccccggttttttaaaaaaaagagaggaagagggggcccccccctcttctttttcccccccccccccccccctttttttaataaaaaaaaattcccccccccct

SEQ ID NO: 61619 - protein, 47 aa, Zea mays
  misc_feature: Ceres CLONE 1524489
  misc_feature (46)..(46): Xaa is any aa, unknown, or other
MASGELACTYAALILSDDGIAITAEKIATIVKAANIKVESYWPALXR

SEQ ID NO: 61620 - DNA, 658 bp, Zea mays
  misc_feature: Ceres CLONE 1524491
  misc_feature: Encodes the peptide sequence at SEQ ID NO. 61621
ggagctccccgcggtggcggccgctctagaactagtggatcccccgggctgcaggaattcgtctcacccctagaaaaactccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagacctgtcagtgttggatgtctggatcttgcatttttggagaaataccaatttacctcgttcaaggatgcaagtatatttcttgtttaactgcacattactttatatttatgcctgtttcatacctttcctctacaaaaaaaaaaaaaaaaaaaaaaacgagacgctcgaggtacccaattcgccctatagtgagt

SEQ ID NO: 61621 - protein, 69 aa, Zea mays; identical to SEQ ID NO: 8575
  misc_feature: Ceres CLONE 1524491
  misc_feature (2)..(69): Pfam Name: Ribosomal_L38e Pfam Description: Ribosomal L38e protein family

SEQ ID NO: 61622 - DNA, 656 bp, Zea mays
  misc_feature: Ceres CLONE 1524492
  misc_feature: Translation starting site: 162
  misc_feature (552)..(552): n is a, c, t, g, unknown, or other
gcggtggcggccgctctagaactagtggatcccccgggctgcaggaattcgtctcacccctagaaaaactcaggccacttacctgcagtcaccactcccaagccagtacccacagtcctacgagcagtcgcacgcatgtgtcaagagacgaaacggtcgacatggctcgcacgctatctgccgtatcggtcgccgtggtggccgcagtgctgctgctggtagcggcggcgacgacctcggaggccgccatcacctgcgggcaggtgagctccgccatcgcgccgtgcctctcctacgcccgcggaacggggtccggcgccctccgcgtcctgctgtagcggcgtcaggaacctcatggagcgccgactgcaccgccgccgacaggtgcgccgcctgcaactgtctcaagaacgccgccaggggcgtcagcggcctcaacgccggcaacgccgccagcatcccctcctagtgcggagtcagcatcatctacaccatcagcacctcctccgattgctccatggtgaactagaacctataccacgcgcgacgagngtcgctctgatcgatcgaccagccattccgccgtcgccgccggccggatcatcgtgcgtcgtcatgatgatatctatctatctacgcgtgatgatcgatggctt

SEQ ID NO: 61623 - DNA, 643 bp, Zea mays
  misc_feature: Ceres CLONE 1524494
  misc_feature (530)..(530): n is a, c, t, g, unknown, or other
gctctagaactagtggatcccccgggctgcaggaattcgtctcacccctagaaaaaatttccttttgcgacttgtgctcctactcagattcatcactccaccctcgtctcgccgtcgtagtcgatgttctttgcctcgtccccgagccagccacgctgaccggtggtctgcaaaccgtcacctacagacccacattcttggagatccatccaccagcttgaccctgtcttttcctcgcgctttctccagccctacctattgaggatgacatttctacattgacatatgtatctgcatctggtcaaccatcactccaacatctgttgtggcatgttctgcacaactcgtctagtagcactctgctgagcactattgatgtatatcgacccatggattgctcagctgctagcgatgattgcactgttgatcggcaagatgcatgctcctcagtgaactagctgcatggtccgtccctgtgaccagcgatcataatgccatgtgcagagttacgccgatgctatattccatcntagaacctggactcgactgctgtgattgctgacgttaaatacttgaacttcctaatcgtgcactgactgagctgaaatctgttagtgcatatcaatgcggacgactgtacatt

SEQ ID NO: 61624 - DNA, 877 bp, Zea mays
  misc_feature: Ceres CLONE 1524501
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (41)..(41): n is a, c, t, g, unknown, or other
  misc_feature (42)..(42): n is a, c, t, g, unknown, or other
  misc_feature (431)..(431): n is a, c, t, g, unknown, or other
  misc_feature (510)..(510): n is a, c, t, g, unknown, or other
  misc_feature (779)..(779): n is a, c, t, g, unknown, or other
nnnnnnnnnnnnnnnnnnnnnnnnnnnnnnnnncccccccnntttttttttggctccgagcagctccccgcggtggcggccgctctattaactagtggatcccccgggctgcaggaattcgtctcacccctaaaaaaaatactccactccagtccccgcgctgcatccttccgcttcctctcgctccctctgctctctcgacggcgcattctctcagatcccgatcgcgcaaggaggccgccgtagagggtgatcaaccatggagagcagaacgcgaaaaaagaaaaagggggtcctgctcatgaaactaccccctcctgcccccaacaacattcaactcctttccttaaattctactctttatttataattgatcttcgtagcatgactgaataattaaaagatcgatccaagggatatgagttgttccntcccccaatttggggggggcggcgtgccaccacattaattgaaattatagggtgacatccccccttccgtgagacccanccacacaacagccatgcatttacacaacaaacgatacgaaaatccaaaacattaaatttagtggtacctatcatgataacaatattatataatatcggccgagaagaacataaacacagcatgtccctcaccataaatacctaaaacacagccaaacaaccaataagaataaagagtaaacacagcaaatcaaaagaagaacaacctataaaatcataagctcaattcagcttacttacaaaacaaacccgggatcacctcatgaaganagaatataaatgagagaacagcaataaatatacattataattgccctcccatacataaaacatactagccaatcttctataactctaccgcgtgttgt

SEQ ID NO: 61625 - DNA, 642 bp, Zea mays
  misc_feature: Ceres CLONE 1524502
  misc_feature: Encodes the peptide sequence at SEQ ID NO. 61626
cgcggtggcggccgctctagaactagtggatcccccgggctgcaggaattcgtctcacccctagaaaaacaccaaaggtaccttgcaatcacaacgaacagaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaaacggcagacggtcgcgaccatcgtgggtgccaggaaggacgagctcctggcccagatcgagaagcatgccgcgcctgcgcctgcgtctgcgtctgcctaaagagatcagtcgtcgccggcaataggggccagcacgtatggctgtaaaatgtgtcgttatcagttctggctttgtgcgttggggggcgattgggaacttatagtatgttggttcctatccgagccggggggaa

SEQ ID NO: 61626 - protein, 122 aa, Zea mays
  misc_feature: Ceres CLONE 1524502
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDAHMTKAQEAGKLVVIDFTAAWCGPCRAIAPLFVEHAKKFTQVVFLKVDVDEVKEVTAAYEVEAMPTFHFVKKRQTVATIVGARKDELLAQIEKHAAPAPASASA

SEQ ID NO: 61627 - DNA, 655 bp, Zea mays
  misc_feature: Ceres CLONE 1524505
  misc_feature: Encodes the peptide sequence at SEQ ID NO. 61628
  misc_feature (506)..(506): n is a, c, t, g, unknown, or other
agtggatcccccgggctgcaggaattcgtctcacccctagaaaaaagccgacatcgtttcgcgtctgcctcagcccgccgcaaggagaggtaagttcaggagacatcttccagaagctgaaatggctcctaaagctgctcctgccaagaagggtgatgccaagacccaggccttgaaggttgccaaggctgtgaagtctggagcagcccagaagaagaccaagaagatccgcacgtctgtgacatttcaccgccccacgaccctgaagaaggctagggaccccaagtacccacgaatcaccactaccggaaggaacaagcttgatcagtaccaaattctcaaggacccccttaccacagaatcagcgatgaagaagattgaagataacaacactctggtcttcattgatgacctcaaggctcacaagaagaagatcaaggcttgccgccaagaagatgtatgacatccaggcttagaaagtcaacaccattgatcaggccctgatngggaagaagcaaaggcttacgttgaagcctgactccccaactatgatggctctttaatgtttgcccaacaaaactccggcgattcttcctaaagagactgcaattaaggccattccaaaatacacttcttttaaagtgcccacgaaatt

SEQ ID NO: 61628 - protein, 113 aa, Zea mays
  misc_feature: Ceres CLONE 1524505
  misc_feature (11)..(64): Pfam Name: Ribosomal_L23eN Pfam Description: Ribosomal protein L23, N-terminal domain
MAPKAAPAKKGDAKTQALKVAKAVKSGAAQKKTKKIRTSVTFHRPTTLKKARDPKYPRITTTGRNKLDQYQILKDPLTTESAMKKIEDNNTLVFIDDLKAHKKKIKACRQEDV

SEQ ID NO: 61629 - DNA, 651 bp, Zea mays
  misc_feature: Ceres CLONE 1524506
  misc_feature: Encodes the peptide sequence at SEQ ID NO. 61630
  misc_feature (651)..(651): n is a, c, t, g, unknown, or other
tccccgcggtggcggccgctctagaactagtggatcccccgggctgcaggaattcgtctcacccctagaaaaaatcctcctccacgagccacggccaactggttagttattccgtgccgtcccaactcacccgcggctccgtaccatccgtcgccgccggcgcaccgcgatggccgcctccgccccggccgtgaggcctctcgcccgggccgcaatccctatcccgctctctgcgcgtccgcggaccgccagggtctccttgctccccctggctcctcctgctccggcccagcgcctcgctctcgggcggaccgggcaagcgcggctgccagcgcgcagccggtcggtgcggtgcctggcggcgctgagcccggagatgcgggagacgctggacaaggtcgtggggtccagcaaggtgttgctattcatgaagggcaccaaggactttccgcagtgcggcttctcccacaccgtcgtgcagatcctgcgctcgctcgacgtgcccttcgagacgctcgacgtgctcgctaacgaggcgctccggcaggggctaaaggagtactccagctggcccaccttcccgcagctctacatcgacggcgagttcttcggcggatgtgacatcaccgtcgaggcatacaagagtggagn

SEQ ID NO: 61630 - protein, 160 aa, Zea mays
  misc_feature: Ceres CLONE 1524506
  misc_feature (83)..(147): Pfam Name: Glutaredoxin Pfam Description: Glutaredoxin
MAASAPAVRPLARAAIPIPLSARPRTARVSLLPLAPPAPAQRLALGRTGQARLPARSRSVRCLAALSPEMRETLDKVVGSSKVLLFMKGTKDFPQCGFSHTVVQILRSLDVPFETLDVLANEALRQGLKEYSSWPTFPQLYIDGEFFGGCDITVEAYKSG

SEQ ID NO: 61631 - DNA, 652 bp, Zea mays
  misc_feature: Ceres CLONE 1524507
  misc_feature: Encodes the peptide sequence at SEQ ID NO. 61632
ctccccgcggtggcggccgctctagatctcctggatcccccgggctgcaggaattcttctcacccctagaaaaacgtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggatgaggcgatgccgaacgcgatcgagggggtgaacggcaaggagctggacggcccccacatccccgtcaacgagggccaatcccgcggctgccgtggacgccgccgccgttgggtcggtggtggcctttgtaggcggctgcttcacctgtggcgggcgccctcatggccgctgccgcaacgccggttgcaccggccgcttctatgtttacctccggttacctgatgctggtggcagcggctgacttcctgggcaatcctgggtggggcttctcctaaccccctctcgggatttgtaaacaatc

SEQ ID NO: 61632 - protein, 132 aa, Zea mays
  misc_feature: Ceres CLONE 1524507
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTDEAMPNAIEGVNGKELDGPHIPVNEGQSRGCRGRRRRWVGGGLCRRLLHLWRAPSWPLPQRRLHRPLLCLPPVT

SEQ ID NO: 61633 - DNA, 653 bp, Zea mays
  misc_feature: Ceres CLONE 1524509
  misc_feature: Encodes the peptide sequence at SEQ ID NO. 61634
  misc_feature (616)..(616): n is a, c, t, g, unknown, or other
  misc_feature (653)..(653): n is a, c, t, g, unknown, or other
ggagctccccgcggtggcggccgctctagattcttcgcatcccccgggctgcaggaattcctctcacccctagaaaaagttgcttgctcccaagatcaagcgcctcccgcctccagcactctaactcaggggacacgatcgccatggccgcctcatcgaccgccgccgccgtgctgtccccgccgtccgtggccgggctccgcctggcgccgtctcccggccgggcgcgcgtgtcgttccgcgcggcgccggcgccggcgcggcggtccgtggcggcgcgcgcggagctgatctcggcgctggcgatcaacctgagcacgggcgtgtcgctcttcctgggccccttcgtcttcttccaccccccccgggagaaggggggggagcaagtgcccccgcagaacccccataagcttttcgatgccggggaccagcgcgccaggggagttcgcgcccctgttcaaatccaactaccccttggggcttcaaccctctcgaagacctcgcctggggggtcccccgggccacatcttcgccctattacatacccacccccctgcctctcgggatccaacccccacttctttctgaaagcggactctaaagaagatttcacccntcacaccctagaacctgccctaatttctttgatatcn

SEQ ID NO: 61634 - protein, 170 aa, Zea mays
  misc_feature: Ceres CLONE 1524509
  misc_feature (158)..(158): Xaa is any aa, unknown, or other
MAASSTAAAVLSPPSVAGLRLAPSPGRARVSFRAAPAPARRSVAARAELISALAINLSTGVSLFLGPFVFFHPPREKGGEQVPPQNPHKLFDAGDQRARGVRAPVQIQLPLGASTLSKTSPGGSPGPHLRPITYPPPCLSGSNPHFFLKADSKEDFTXHTLEPALISLIS

SEQ ID NO: 61635 - DNA, 622 bp, Zea mays
  misc_feature: Ceres CLONE 1524517
  misc_feature: SWISSPROT Homolog: EC 6.3.2.19 Ubiquitin--protein ligase
  misc_feature (195)..(195): n is a, c, t, g, unknown, or other
  misc_feature (196)..(196): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (248)..(248): n is a, c, t, g, unknown, or other
  misc_feature (258)..(258): n is a, c, t, g, unknown, or other
  misc_feature (259)..(259): n is a, c, t, g, unknown, or other
  misc_feature (268)..(268): n is a, c, t, g, unknown, or other
  misc_feature (270)..(270): n is a, c, t, g, unknown, or other
  misc_feature (272)..(272): n is a, c, t, g, unknown, or other
  misc_feature (298)..(298): n is a, c, t, g, unknown, or other
  misc_feature (299)..(299): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (308)..(308): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (460)..(460): n is a, c, t, g, unknown, or other
  misc_feature (461)..(461): n is a, c, t, g, unknown, or other
  misc_feature (484)..(484): n is a, c, t, g, unknown, or other
  misc_feature (536)..(536): n is a, c, t, g, unknown, or other
  misc_feature (546)..(546): n is a, c, t, g, unknown, or other
  misc_feature (561)..(561): n is a, c, t, g, unknown, or other
  misc_feature (614)..(614): n is a, c, t, g, unknown, or other
  misc_feature (615)..(615): n is a, c, t, g, unknown, or other
  misc_feature (621)..(621): n is a, c, t, g, unknown, or other
aaagctggagctcaccgcggtggcggccgctctagaactagtggatcccccgggctgcaggaattcgtctcacccctagaaaaattaccttgcagtttacagaagattacccaaacaagccaccaactgttcggttcgtctctaggatgtttcatccaaacatatatgctgatggaagcatctgcttggatatcnnctacagaaaccagtggagagtcctactattatttgnnnnnnnnnnnnnnngngggggggggnnggggggggngngngggggggggggggggggggggggggnngggnnnngngnnngggggggggggggggggggggggggggggggggggggggggggggggggggggggggggggggggggggggggggggggggggggggggggggggggggggggggggggggggggggggggggggggggggggggggggggggggggnngttgggggggggggggggggggngggggggggggggggggggggggggggggggggggggggggggggggggggngggggggggnggggggggggggggnggggggggggggggggggggggggggggggggggggggggggggggggggggnngggggng

SEQ ID NO: 61636 - DNA, 746 bp, Zea mays
  misc_feature: Ceres CLONE 1524518
  misc_feature: Encodes the peptide sequence at SEQ ID NO. 61637
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (46)..(46): n is a, c, t, g, unknown, or other
  misc_feature (746)..(746): n is a, c, t, g, unknown, or other
ttttnnnnnnnnnnnnnnnnnnnnnnnnnnnnngggggggtttttntttttcaaactgggactccaccgcggtggcggccgctctacaactagtgtgatcccccgggctgcaggaattcgtctcacccctagaaaaagtctcgtgtgcttcctaggtcattacggtcattccacttccaccagtctgtctcccaatctttcttgctgctccgattcgctctctttactcggtcagcggaaggggagaggagggcaagatgactgtggagaaggtggacgcggggctttcagacttctacgcccacttctatagcctcttcgcttccccggacgccgcctccaacgggaagatgaagctgctgctcttcctggccgaccgcaagcctggctcctccctctcctggtgccccgactgcaacgtgacggagccggtgatctacgatcggcatggagcactggaaggcaaggacacgtggctcctgcgcgcctacataaagggacaaggccacttggccacgaccctgcgcacccgaggagggaggaccccacgtatcgggctcaagggcgtgccatagctgatcccttaggaggatggcgcctccgccttcctgcctcgaggaacgaccaagaagcacctctaggtaaaggtttgacacccactcctctgcgctgggaggcaaacctgaatactgaaaagatcccggtttaacccgttccgggtttcccttcaagcgggaacagagggn

SEQ ID NO: 61637 - protein, 105 aa, Zea mays
  misc_feature: Ceres CLONE 1524518
MTVEKVDAGLSDFYAHFYSLFASPDAASNGKMKLLLFLADRKPGSSLSWCPDCNVTEPVIYDRHGALEGKDTWLLRAYIKGQGHLATTLRTRGGRTPRIGLKGVP

SEQ ID NO: 61638 - DNA, 646 bp, Zea mays
  misc_feature: Ceres CLONE 1524519
  misc_feature: Encodes the peptide sequence at SEQ ID NO. 61639
  misc_feature (646)..(646): n is a, c, t, g, unknown, or other
tggcggccgctctagaactagtggatcccccgggctgcaggaattcgtctcacccctagaaaaaccatccaccagaccagaagaggagcctgctgctggcgacggcctccgagacgaggggagtcgcgccggtgaggtccagcgggatcgagacgagcacggtgggtctgggatgtgaggccgtcaccgggcaggtcacggaggtcaacaaggacaccttctggcccatcgtcgaggccgccggcgacaaggtcgtcgtcctcgacatgtacaccgaatggtgcgggccttgcaaagtgatggctccgaaattccaggagatgtctgagaagaacctggatgttgtgttcctgaagctcgactgcaaccaggacaacaagccgcttgcgaaggagctgggcataaaggttgtgcccacgttcaagatcctcaagggtgggaaggtcgtgaaggaggtgaccggcgccaagatcgacgagctagcgcaagccatcgacacagtcaagtcagactgacaaagaaagcaagtgatgcaactacgtagtgtagacgatgaatgaatgagtccctggccgggcaagctgctagatacgtacgtacgtacgtactccatcacaattaatgatggatgatggccatgccaaan

SEQ ID NO: 61639 - protein, 82 aa, Zea mays
  misc_feature: Ceres CLONE 1524519
  misc_feature (1)..(79): Pfam Name: Thioredoxin Pfam Description: Thioredoxin
  misc_feature: SWISSPROT Homolog: EC 5.3.4.1 Protein disulfide-isomerase
MYTEWCGPCKVMAPKFQEMSEKNLDVVFLKLDCNQDNKPLAKELGIKVVPTFKILKGGKVVKEVTGAKIDELAQAIDTVKSD

SEQ ID NO: 61640 - DNA, 672 bp, Zea mays
  misc_feature: Ceres CLONE 1524521
  misc_feature: Encodes the peptide sequence at SEQ ID NO. 61641
ggagctccccgcggtggcggccgctctagaactagtggatcccccgggctgcaggaattcgtctcacccctagaaaaagagtgccgccccgcccgcccgcgctatccactcgtctctccgtccccatggccacttatctcaacgcaccgccggcagccaccacgacgactgcaagctgccgccatgccttctccggtggcagcctccgtctactccggccgagccgaccgacgctgcacgtgacgtgccaagccgccgcctcctcccagcagccgtcgtccccgtccaggaggtcagcctgcctcctcggcatcgcgtgcgccgtcctgctccgcccacgtgccgcctccgccgccgaaaccgacgacgagccggccaacaacggctggtggctgaccgagttccccttgcccgtgcccaagatcgtcaacaaggagatcaacaacgcggagacgggcacgcgctccttcctcaagaacggcatctacatggcggacatcgggcccagcttcgcggcgcacgcgtaccggttgcgcagcacggccttccaactgctggcctcggaggacctgctgggcaaagaccccttccaaatacttaaaaaataacctccgccctcaagtccaccttttggtaataagaaatttcaaaaagttaattttccgccgccaa

SEQ ID NO: 61641 - protein, 160 aa, Zea mays
  misc_feature: Ceres CLONE 1524521
  misc_feature (23)..(160): Pfam Name: PsbQ Pfam Description: Oxygen evolving enhancer protein 3 (PsbQ)
MATYLNAPPAATTTTASCRHAFSGGSLRLLRPSRPTLHVTCQAAASSQQPSSPSRRSACLLGIACAVLLRPRAASAAETDDEPANNGWWLTEFPLPVPKIVNKEINNAETGTRSFLKNGIYMADIGPSFAAHAYRLRSTAFQLLASEDLLGKDPFQILKK

SEQ ID NO: 61642 - DNA, 641 bp, Zea mays
  misc_feature: Ceres CLONE 1524522
  misc_feature: Encodes the peptide sequence at SEQ ID NO. 61643
tggcggccgctctagaactagtggatcccccgggctgcaggaattcgtctcacccctagaaaagacggcaaaggcaagcatcccccggccgccgccattccaaccatccgagcatcctgctcagctcagggcgaaacaaaaccctcctccctcactgccccctcgcagacgagacgcgtggtagctagggttttggcctcgccgcgcacgcctcctgaagcttctagacgttcgaggaggaggaggggaggctcccgccgccgccgccgcagccatggcgtccaccaaggtgcagcgtatcatgacccagcccatcaacctcatcttccgtttcctccagagcaaagcgcgcatccagatctggctcttcgagcagaaggacctccggattgagggtcgcatcatcggattcgatgagtacatgaacttggtcctcgaagatgctgaggaaatcaacgtcaagaaaacactaggaagacactgggccggatactcctcaaagggtgacacataactttgatgatgaacagtggcaagtgaaagttctatggcaggaacgatgttgggtgctcgcgttgagtattctggcacgttgtactccatcattcagactacatgtacctgctggtaatgacctgagt

SEQ ID NO: 61643 - protein, 79 aa, Zea mays
  misc_feature: Ceres CLONE 1524522
  misc_feature (19)..(68): Pfam Name: LSM Pfam Description: LSM domain
MASTKVQRIMTQPINLIFRFLQSKARIQIWLFEQKDLRIEGRIIGFDEYMNLVLEDAEEINVKKTLGRHWAGYSSKGDT

SEQ ID NO: 61644 - DNA, 643 bp, Zea mays
  misc_feature: Ceres CLONE 1524524
tggcggccgctctagaactagtggatcccccgggctgcaggaattcgtctcacccctagaaaaaaagcaagaacagctgtcgatccaattgtcacttgctctccctccaacaagctaattaaggccggtcgtcatccctcttctagctcgttttattatccatgggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttcacgagcacacgagaagaaaaagaccacaggacgccgaggaggcccggcgcgagaaaaaacacacttcttcggctgattgatccctcccgtatcgtcgtccctccccgtgtgctacccgtgcgtgtgtgaaagtgtatcc

SEQ ID NO: 61645 - DNA, 621 bp, Zea mays
  misc_feature: Ceres CLONE 1524525
  misc_feature: Translation starting site: 202
  misc_feature (390)..(390): n is a, c, t, g, unknown, or other
  misc_feature (609)..(609): n is a, c, t, g, unknown, or other
aacatctggagctccccgcggtggcggccgctctagaactagtggatcccccgggctgcaggaattcgtctcacccctagaaaaagccatcaccaatcagtcagtcacagctcacagcaaacaccgcgaagccgcccccgctcccaaacccgaccgagcaaagcgcaaagccccccaaccgcggatcaatccgcagcatcgatggcgcccaaggcggagaaaaagccggcggcgaagaagcccgcggaggaggagcccgcgaccgagaaggcggagaaggctccggcagggaagaagccgaaggcggagaaacgcctccccgcgggcaagtccggcgccggcgagggcaagaagggcaagacccccccaagaagagcgtggagacctacnagatctacatcttcaaggtgctcaagcaggtgcaccccgacttcggcatcctcgtccaaaggcatgtccatcatgaattccttcctcaacgacatcttcgaaaaagctcgccgcggaggccgccaagctccgccgcttcaaccaagagccccccatcacctccccgggagacgcaaacctccgtccgacctcgtcctaacagaagagtctccccaagcnagccacatctag

SEQ ID NO: 61646 - DNA, 623 bp, Zea mays
  misc_feature: Ceres CLONE 1524529
  misc_feature: Encodes the peptide sequence at SEQ ID NO. 61647
cgcggtggcggccgctctagaactagtggatcccccgggctgcaggaattcgtctcacccctagaaaaagtctccatccaattcacaggctcaccacaccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccacgacgccgtcacctacaccgagcacgcgcgccgtaagaccgtcaccgccatggacgtcgtctacgcccttaagcgccagggccgcaccctctatggcttcggcggctaggtctgccgcggccgcgcctcgcctcgccgttggtgcggttctggtgttgctgcagttcgcaagttgtttgtggtgggtgaaaaaatgctagctactgtagaactgcagtgccgtacgcagcacatggtgtgtctgtctgaagattgttgtcaatgctggcttgct

SEQ ID NO: 61647 - protein, 103 aa, Zea mays
  misc_feature: Ceres CLONE 1524529
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIHDAVTYTEHARRKTVTAMDVVYALKRQGRTLYGFGG

SEQ ID NO: 61648 - DNA, 790 bp, Zea mays
  misc_feature: Ceres CLONE 1524535
  misc_feature: Encodes the peptide sequence at SEQ ID NO. 61649
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (716)..(716): n is a, c, t, g, unknown, or other
nnnnnnnnnnnnnnnnnnnaaaacccccnttgttnnnnnnnnnnntnnnnnnttaaactgggactccccgcggtggcggccgctctagaactagtggatcccccgggctgcaggaattcgtctcacccctagaaaagccggtctcttgctctgatagcttgctccaggacgtacgtgcgtacgtagatcgatccatcgatcgctagctagctgacgaccatggcgtccctctcctctgccgccatcaccgcgccttccttcacgggcgggcccgctcgtgcagtgatcagcaggatgtccttcaccgggcgtgcctctctccgcaaggccctgacaccgccacccggggggggggccgacggcgaccctgcttgtagggggggggaacaaggcccccggaggtgcttttggtttttttttccccccccccgtagggggggggggggcggcccttttccccccttaaatccccccacaaccttgttactttataaaaaagaagtcttggttttgccgcgcgagaggatagaagcctaaacaaaaaatcgacgtggggggggtgatggggtatagtacgtatacaacagattacgtgagagggaagatagtttaaaaagaagggcggtgtgaattctttacactgacgatagaaaatcttcgcagggtcttttgtggttattagagatgcgataataaaggggagggggcggcggggncgttgtggaaagcaatggtttcccataaatatatcgcgagcaggtttgttattgatcaatcaacagatgagtag

SEQ ID NO: 61649 - protein, 105 aa, Zea mays
  misc_feature: Ceres CLONE 1524535
MASLSSAAITAPSFTGGPARAVISRMSFTGRASLRKALTPPPGGGADGDPACRGGEQGPRRCFWFFFPPPRRGGGGGPFPPLNPPTTLLLYKKEVLVLPRERIEA

SEQ ID NO: 61650 - DNA, 522 bp, Zea mays
  misc_feature: Ceres CLONE 1524539
  misc_feature: Encodes the peptide sequence at SEQ ID NO. 61651
aaactggagtccccgcggtggcggccgctctgaactagtggatcccccgggctgcaggaattcgtctccccctagaaaaactcgagcctgacccttacgccttcgctcgcgccgccgccgccgccgccgctacgccccgcacctcgcttcatttcgtgtcgccagatgacgaagcgcactaagaaggcaggaattgttggcaaatatggaaccaggtatggtgctagcttgcgtaagcaaatcaagaagatggaggtatctcagcattccagtacttttgcgagtctgtgggagtttgctgtgagaggaagcagttgaatttggggtgcaggactgtgggaaggtgaagctggggtgcttacaccatgaacactgctagtgcggtcacgtcaggacacgatccgcccctgaggggcaaactgaacatgaatagctctttaaatattggggttcccggaattgcccctgcccaggatgttttggggggcctttccagggggaaagggggaaaacctggtactg

SEQ ID NO: 61651 - protein, 50 aa, Zea mays
  misc_feature: Ceres CLONE 1524539
  misc_feature (2)..(51): Pfam Name: Ribosomal_L37ae Pfam Description: Ribosomal L37ae protein family
MTKRTKKAGIVGKYGTRYGASLRKQIKKMEVSQHSSTFASLWEFAVRGSS

SEQ ID NO: 61652 - DNA, 637 bp, Zea mays
  misc_feature: Ceres CLONE 1524545
  misc_feature: Encodes the peptide sequence at SEQ ID NO. 61653
aaagctggagctccccgcggtggcggccgctctagaactagtggatcccccgggctgcaggaattcgtctcacccctagaaaaaacaaggcaggcagccacagcacctgacccccacaacccatcgagcttcccatctggaccggaccccatcaggagcagaggcagagccgagagtctctcagcgaagccaccgtcggacgccatgtgctaccaggtgaggtgcggcacctgcggcaagaccacgtgggccgggtgcggccgccacgtcgcgtcggtgcacgcgcagatctcggagggccagcactgcgcctgccgcgactggcccggcgtcgaccccgcccccgccaccgccccggctggcccgcacaaggccgcgggggggcgctgacgacgctgggaaggcctccggcaccgccgcctccactcccgcgcagggcggcgctgcgcagtgagattcgcgccgcccaccgcgggggtgttctgttccctgaggatcggaacccgccgtggccaaacgaacgtggtggtcatccatcgtttgccccgtttgagcatatcaatcccccgtgggggcgtgttttttccgggtccgaatgggattttttggcttttggattaacattttttttcggaag

SEQ ID NO: 61653 - protein, 61 aa, Zea mays
  misc_feature: Ceres CLONE 1524545
MCYQVRCGTCGKTTWAGCGRHVASVHAQISEGQHCACRDWPGVDPAPATAPAGPHKAAGGR

SEQ ID NO: 61654 - DNA, 856 bp, Zea mays
  misc_feature: Ceres CLONE 1524548
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (856)..(856): n is a, c, t, g, unknown, or other
nnnnnnnnnnnnnnnnnnnnnnnnnnnnnnnnnnnnnnnnggggnnggcgagcgannnnnaagatgagggagatacccgcggtggcggccgctctagaactagtggatcccccgggctgcaggaattcgtctcacccctagaaaaagagctccctgctttgttcagacttcagagcccttcctcttgtgtccgcgcaaattggtgatacttgaacaaggatctcctccatattactgagcgggatgtataatcctcgcagtgggcgggacatgtcctactcccatcatgtgcccacccgccctggaggagaatggctgtctatatgcgtggcctggttagctgcgtgcctgctgcctccgactggggccaggacctgtgatttgctcactctatgactatctagatgctggtagcaagcgccttgctggccattttttgtgccccccccaccaagggggggggggggggggctcatctacgtggactaccctcacgggcggcgcaaaccaacgcccgtacctcctatatggggcggccccgtgtcgccccactggccgctgggccggcgttacttaaaatagagaagccgatcttctctcaggagggggcgcacagaacgccttctcggagcctagcaccagccaacaatttagcgtcccgccgcccccgagagaataaaaaaaagaaacagaagagacgagaaacccagctgggctgggtcgtgtatggggaagcgctcgcccaccgcctcatcggacactcgacagttatccgtgcccgcatatacgcgccaggcgccggaggcatgctggcccgcccgggggcaggccagataaagagagtcgcttcgggcgn

SEQ ID NO: 61655 - DNA, 675 bp, Zea mays
  misc_feature: Ceres CLONE 1524549
  misc_feature: Encodes the peptide sequence at SEQ ID NO. 61656
  misc_feature (307)..(307): n is a, c, t, g, unknown, or other
  misc_feature (322)..(322): n is a, c, t, g, unknown, or other
  misc_feature (339)..(339): n is a, c, t, g, unknown, or other
  misc_feature (358)..(358): n is a, c, t, g, unknown, or other
  misc_feature (642)..(642): n is a, c, t, g, unknown, or other
tggcggccgctctagaactagtggatcccccgggctgcaggaattcgtctcacccctagaaaaagtcttcacctagcaacaacctgtccaagaaccagcagccaaaggacaagacaagagacacaacgaaaggaaaggaaccaagagaaagatcgagaagagaggagccttcgcttttggacttgcaccgtcgtgatctgtcccgcgaccacatgaggatccacccagcatcccccaccgccggcggcaagaaggacctccggcgcctgccgcacgtgtacagcaaggtgctggagctgccgctccngggcggacacgacgntcaggtggttcgaaggnccagacgccttccacttcnttcccgcgccggccgccggggcccgtgccccccccaccgtgcggtggcccacgtcgggatacaccccggggtcccaagggtcggggtggaagccaaaccccccaaaggggccgcttaaaaaaaaccccccccgaaaaattggaaatcccaaagggggggggtcccggtgtcccaaacaaaacttttgggagaggggggggggggggaaataaaaagaccatttttccttcaaggggccaaaaggccccggggtgaaaaagaacggggggcggcggggggggggntttttttttggggggggggggggggaaaaaaaa

SEQ ID NO: 61656 - protein, 87 aa, Zea mays
  misc_feature: Ceres CLONE 1524549
  misc_feature (32)..(32): Xaa is any aa, unknown, or other
  misc_feature (37)..(37): Xaa is any aa, unknown, or other
  misc_feature (43)..(43): Xaa is any aa, unknown, or other
  misc_feature (49)..(49): Xaa is any aa, unknown, or other
MRIHPASPTAGGKKDLRRLPHVYSKVLELPLXGGHDXQVVRRXRRLPLXSRAGRRGPCPPHRAVAHVGIHPGVPRVGVEAKPPKGAA

SEQ ID NO: 61657 - DNA, 605 bp, Zea mays
  misc_feature: Ceres CLONE 1524550
  misc_feature: Encodes the peptide sequence at SEQ ID NO. 61658
aaagctggagctccccgcggtggcggccgctctagaactagtggatcccccgggctgcaggaattcgtctcacccctagaaaaaaaagaaaaaaaaaaaaaaaaaaaaacttagcagtccgtacattccgctcatattcctcaccggtgaccttcctcacctgcgtcagacagagaaagccgagattagcggcggcggcgatggcactcccggcgtcaagctccggcctcttccgcttcgtctccccccgcagtcgtccccagtccaccgacatcgtggccgctgcctcctggggagtcttcgccggcaccgccggcctctacctcgtccagccatttgactggattaagaagactttcttcgataaacctgaaccagaggcatgagtctccaggcagaaaatgctgcaaatctgcaactttggtacaccacttttgtccgggatgattcctgatgataactcagcaaataatatgagaccctctcgtctttccttgtttgattttattcagatgtaggcattcctcttgcatgtaatcttcacgaaggggagtgtgatcattttgactggtttttcataacacagaagaaactgttttggttca

SEQ ID NO: 61658 - protein, 61 aa, Zea mays; identical to SEQ ID NO: 49918
  misc_feature: Ceres CLONE 1524550

SEQ ID NO: 61659 - DNA, 633 bp, Zea mays
  misc_feature: Ceres CLONE 1524553
  misc_feature: Encodes the peptide sequence at SEQ ID NO. 61660
  misc_feature (464)..(464): n is a, c, t, g, unknown, or other
  misc_feature (511)..(511): n is a, c, t, g, unknown, or other
  misc_feature (514)..(514): n is a, c, t, g, unknown, or other
gctctagaactagtggatcccccgggctgcaggaattcgtctcacccctagaaaaaagcagtcagcagtgaccaactcgaagcttgcgttcttgtagtagaggtcggcagcaagcggtagagcgagaggtcgagaagatgaagagcagcactctgttggcgatcctagttctccaggcccttctggtctctacggccgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagactcatccacagcggcacagccgatggatccttccatgctcctccgtccgtccgccttgctancagcaggcagccacccatagctagctcttggttgtggttttgcatgnttnattggggtgtcccttcccagtcgagatggaatatgtcaggcgcacgtacagacgtgttattacgatatttctcccctacaataaaaactcgatctgtgggggtaacacttgtcccctaa

SEQ ID NO: 61660 - protein, 87 aa, Zea mays
  misc_feature: Ceres CLONE 1524553
MKSSTLLAILVLQALLVSTAVAKGPAGPKKQCWCGECTSWSGVWTCDDLLTKCAATCKNCVPVSTDKGATKYRCRDFLPENCGCKIH

SEQ ID NO: 61661 - DNA, 815 bp, Zea mays
  misc_feature: Ceres CLONE 1524556
  misc_feature: Encodes the peptide sequence at SEQ ID NO. 61662
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (813)..(813): n is a, c, t, g, unknown, or other
  misc_feature (815)..(815): n is a, c, t, g, unknown, or other
nccggggnnnnnnnnncccnnnnccccnnnnnggnnnggggtttttnnnnnnntaaatctggagctccccgcggtggcggccgctctagactagtggatcccccgggctgcaggaattcgtctcacccctagaaaaaggattccggattccctctgctctttccctaacgaaggtagccatggcggggagaggtaaggcgatcggctcaggcgccgccaagaaggccacgtccaggagctccaaggctggcctccagttccctgtgggaaggatcgccaggttcctcaaggccggcaagtatgccgagagagtcggcgccagcgcccctgtctacctcgctgccggggtcgagtatcttgctgctgaggttcttgaactggccggagatgcggcacgtgacaacaagaagacccgcattcggaaccgggccgcggggggggctcgccgtcccccaccaaagaagatcccccccccgctttgggtggggtacggcggacccctccgccagacggggggatgtaattgtcccccattattccattagacctggtcgtcttccccacaaagaaacgggtcagggcggctggtccgctgatccaaagctcctccttccgtgtatgcatccccctgcctcgcacggggtttgtgaggataggcacagggtgaggtgaccacaggaacagaataaggcttggagggaaacacaagaccccggggccccagaccacaaaaaactctattaacattcttttccttagtggaacccacgccctcatactcggggggactacccaaagaataagaagtatccngn

SEQ ID NO: 61662 - protein, 121 aa, Zea mays
  misc_feature: Ceres CLONE 1524556
  misc_feature (19)..(83): Pfam Name: Histone Pfam Description: Core histone H2A/H2B/H3/H4
MAGRGKAIGSGAAKKATSRSSKAGLQFPVGRIARFLKAGKYAERVGASAPVYLAAGVEYLAAEVLELAGDAARDNKKTRIRNRAAGGARRPPPKKIPPPLWVGYGGPLRQTGGCNCPPLFH

SEQ ID NO: 61663 - DNA, 765 bp, Zea mays
  misc_feature: Ceres CLONE 1524558
  misc_feature: Encodes the peptide sequence at SEQ ID NO. 61664
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
nnnnnnnnnnnnnnnnnnnnnnnnnntttttttnnttnnnttnnnntnnccaaaaatcatacaaactggaactccccgcggtggcggccgctctagaactagtggatcccccgggctgcaggaattcgtctcacccctagaaaaaatcgccagacacactatagaccacagccagtcagccacatcactagctatctgtgcagaggcaatggcgtccaaggttgagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcggcaaggagaagccttgagacggcggacgacgagaacaagggtggtgtcgtacagcgtggtggacggctagctggcggacttctaccagaacttccagatcacgctgaaagggactccggcccaaggcggagggcgaagggcggcccccatcatcaggctgggccatggaagttcaacaaggccaaacgaaccaggtggcctggacccggaacgtcatccaagggaggaccggccccccaaaaacggttccaacgaaccttcgaacaaactaacctcccttccaagaaaactaagaatgggaagccgaccaaacctgggaaaaaaggggtccacatttaaccaggtatacatgatt

SEQ ID NO: 61664 - protein, 72 aa, Zea mays
  misc_feature: Ceres CLONE 1524558
MASKVELVVEVKSPADKLWAALRDSTELFPKIFPEQYKSIETVEGDGKSAGTVRLLKYTEAVPMLTFGKEKP

SEQ ID NO: 61665 - DNA, 724 bp, Zea mays
  misc_feature: Ceres CLONE 1524566
  misc_feature: Encodes the peptide sequence at SEQ ID NO. 61666
  misc_feature (14)..(14): n is a, c, t, g, unknown, or other
  misc_feature (15)..(15): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
tttttttttttttnnttttttnnnttttnnnnnnnnnnnnnnncagaagggtttaaaactggagctccccgcggtggcggccgctctagaactagtggatcccccgggctgcaggaattcgtctcacccctagaaaaaaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacaatatgcatgcgccggccgacgacgacgcgcgctgcctctcgtgagcttctgttcaagtgatgcatgtttcaaggcatccatggatgctttacgtatatgcgtattaattagccgtgtcatggaaaccggaacaaaaagggggggttgttttaatttttaccctcttccgcggggatcaacataaagggggaaaaaatatggttgggattgtggggccaaaaaaaaaaaaacaaaatacgctaaaccgcttccgaggg

SEQ ID NO: 61666 - protein, 90 aa, Zea mays; identical to SEQ ID NO: 58696
  misc_feature: Ceres CLONE 1524566

SEQ ID NO: 61667 - DNA, 619 bp, Zea mays
  misc_feature: Ceres CLONE 1524570
  misc_feature: Encodes the peptide sequence at SEQ ID NO. 61668
gctctgtactagtggatcccccgggctgcaggaattcgtctcacccctagaaaaacccttccgcgccagtccaaccaagtcagcacccgcgcgcggcaaggagttcacgcccatggcgagcaccaacatggcgtcggccacctcgcggttcatgctggccgcgggcgtgcccactgccagtagcggcagcggccgcgtcagcttcgcctcggcgcccaaccggcttggcaggaggcttgtggtccgggccgatgaggagttcccggtagagacggcgcccacggcggaaggggagggcgccgtgtccaccaagcccaaggccgacaagacgccgccgatcgggcccaagaggggcgccaaggtgaagatcctgacgcgggagtcccactggtacaacgggatcggcgacgtcgtctccgtctatcaggatcctaacacccgttacccggcggtggtgcggttcaacaaggtgaactacaccgacgtgtctaccaacaactacgccttggacgaagatcctccaggtgaaatgagtgacgccagtctgctaaaaaccccaggctccagtgtgatttgcaaccgtgaaatgaggcgcctgcctagatgctagccgcccaac

SEQ ID NO: 61668 - protein, 165 aa, Zea mays
  misc_feature: Ceres CLONE 1524570
  misc_feature (78)..(139): Pfam Name: PSI_PsaE Pfam Description: Photosystem I reaction centre subunit IV / PsaE
MASTNMASATSRFMLAAGVPTASSGSGRVSFASAPNRLGRRLVVRADEEFPVETAPTAEGEGAVSTKPKADKTPPIGPKRGAKVKILTRESHWYNGIGDVVSVYQDPNTRYPAVVRFNKVNYTDVSTNNYALDEDPPGEMSDASLLKTPGSSVICNREMRRLPRC

SEQ ID NO: 61669 - DNA, 663 bp, Zea mays
  misc_feature: Ceres CLONE 1524571
  misc_feature: Encodes the peptide sequence at SEQ ID NO. 61670
  misc_feature (388)..(388): n is a, c, t, g, unknown, or other
gctctagaactagtggatcccccgggctgcaggaattcgtctcacccctagaaaaagtccgactcccagccgtcgtctgctgcggactccgcctccagtttggtctgtttcttgcaagttgatcttgtggtagttcccccaactgtcaccatgcagaacgaggagggtaagactgtggacctctatgtccccaggaagtgctcggccacaaacaggatcatcactgccaagggacatgcctctgtccagatcaacattggccacttggatgcgaatggcctgtatgatggtcacttctcaccgtttgctctctctgggtttgtccgtgctcttgtcccccccacagcgggggggggggggggtgtaaaaataaaaagcttaatttcgnggagtaaatttaaaacacagtttaaccagaattgggcgggggccttaactattttttcaattcctggccgtattatgcaaagggtgggagtttccgctgggacctaaaaaatctgaagagttgatgattgttgttgggggtcaaaaaaaaacaaaaatcccccttcgccccaaaatacccagggtccccccttgtgggggtgccgccctcccgtcgggaccaaggtggacggaccctttcctggccagggagagtgggaatttggacaaaggtgt

SEQ ID NO: 61670 - protein, 114 aa, Zea mays
  misc_feature: Ceres CLONE 1524571
  misc_feature (1)..(87): Pfam Name: Ribosomal_S21e Pfam Description: Ribosomal protein S21e
  misc_feature (80)..(80): Xaa is any aa, unknown, or other
MQNEEGKTVDLYVPRKCSATNRIITAKGHASVQINIGHLDANGLYDGHFSPFALSGFVRALVPPTAGGGGGVKIKSLISXSKFKTQFNQNWAGALTIFSIPGRIMQRVGVSAGT

SEQ ID NO: 61671 - DNA, 641 bp, Zea mays
  misc_feature: Ceres CLONE 1524573
  misc_feature: Encodes the peptide sequence at SEQ ID NO. 61672
tggagctccccgcggtggcggccgctctagaactagtggatcccccgggctgcaggaattcgtctcacccctagaaaaacttgctcgctgcgccggcgcctccgacgtcgtctcttcgtccccacgagcaaccgataagccgccggcgctgagatgttggttcatcaggatctcctatctggcgacgagctcctgtcggattcattcacctaatgggagctcgagaacggagtcctgtgggaggcccagggatagtggctcacccaagggcctgttgatgtggacattgagtgccaatccatccgcccagggtggtgaggacgaaagcgttgatgacacagctgtgaaggtggttgatattgttgacacattccatctactggagcaacctccttctgacaagaaatcatttgcgtcttacatcgaaaaatacgtcaagaatctcactgctgtgttgcagccagataaagcggatgagttcaaaaagggtgtcgagtgtgcaaccaagtttctccttagcgagctgaacgacctccaattttttgttggtgagtccatgaatgatgatgcgtctgtggtattcgcctattacaaggatggtgccactaatccgacattcctctatttctctcatgggctta

SEQ ID NO: 61672 - protein, 121 aa, Zea mays
  misc_feature: Ceres CLONE 1524573
  misc_feature (1)..(121): Pfam Name: TCTP Pfam Description: Translationally controlled tumour protein
MWTLSANPSAQGGEDESVDDTAVKVVDIVDTFHLLEQPPSDKKSFASYIEKYVKNLTAVLQPDKADEFKKGVECATKFLLSELNDLQFFVGESMNDDASVVFAYYKDGATNPTFLYFSHGL

SEQ ID NO: 61673 - DNA, 670 bp, Zea mays
  misc_feature: Ceres CLONE 1524583
  misc_feature: Encodes the peptide sequence at SEQ ID NO. 61674
  misc_feature (317)..(317): n is a, c, t, g, unknown, or other
  misc_feature (410)..(410): n is a, c, t, g, unknown, or other
  misc_feature (552)..(552): n is a, c, t, g, unknown, or other
  misc_feature (581)..(581): n is a, c, t, g, unknown, or other
  misc_feature (608)..(608): n is a, c, t, g, unknown, or other
  misc_feature (645)..(645): n is a, c, t, g, unknown, or other
actagctggagctcaccgcggtggcggccgctctagaactagtggatcccccgggctgcaggaattcgtctcacccctagaaaaactagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaaaggcatgccccacaanttctaccacggccgcaccgggagcgtctggaacgtcacccagcgctgcccccccccccagatagagggggggggttaatggccccctcttcangaaacggatccctgcccccgtggagcatggtgcgcccccccccgtggcacgaaggatttccccttgaggaaaaccccaaaatgcccggctccagggggaatcccaaggcccgccggtgaagttatccacccccaaaagggcngccccgggggaacccaaacctggggtttnagaggtgaaaggggcctatacccctcnaaaaaaagcccgcccctttttctttaagaatgggganaccaaattttccccagggggggttt

SEQ ID NO: 61674 - protein, 80 aa, Zea mays
  misc_feature: Ceres CLONE 1524583
  misc_feature (2)..(81): Pfam Name: Ribosomal_L21e Pfam Description: Ribosomal protein L21e
  misc_feature (55)..(55): Xaa is any aa, unknown, or other
MPAGHGLRSRTRDLFARPFRKKGYIPLTTYLRTYKIGDYVDVKVNGAVHKGMPHXFYHGRTGSVWNVTQRCPPPQIEGGG

SEQ ID NO: 61675 - DNA, 663 bp, Zea mays
  misc_feature: Ceres CLONE 1524585
  misc_feature: Encodes the peptide sequence at SEQ ID NO. 61676
cttaagctggagctcaccgcggtggcggccgctctagaactagtggatcccccgggctgcaggaattcgtctcacccctagaaaaaggttttattcgctcctcccgaccgccgccgtcgccgcctcctctccccagcacccggagctcgaccgaacgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccacctggccgcccatttggctctggccctcctggtgaccgcccaaggggcccaggccgttttgacggcgacaggccaagggtttggtgacaggaatgggtaaccgtggtgggtcctcgtgggggctccctggtgacctttggtggggaataaataatgggagcctcctggctggagtttccaggccaatcaatttcagggaggccctg

SEQ ID NO: 61676 - protein, 125 aa, Zea mays
  misc_feature: Ceres CLONE 1524585
  misc_feature (3)..(98): Pfam Name: S10_plectin Pfam Description: Plectin/S10 domain
MIIPKKNRNEICKYLFKEGVLYAKKDYNLAKHPQIDVPNLQVIKLMQSFKSKEYVRETFSWQYYYWYLTNDGIEHLRNYLNLPSEIVPATLKKSAKPPGRPFGSGPPGDRPRGPGRFDGDRPRVW

SEQ ID NO: 61677 - DNA, 609 bp, Zea mays
  misc_feature: Ceres CLONE 1524588
  misc_feature: Translation starting site: 469
  misc_feature (249)..(249): n is a, c, t, g, unknown, or other
  misc_feature (277)..(277): n is a, c, t, g, unknown, or other
  misc_feature (320)..(320): n is a, c, t, g, unknown, or other
aagctggagctccccgcggtggcggccgctctagaactagtggatcccccgggctgcaggaattcgtctcacccctagaaaaagccttgaaccctagctcccgcaactgccgccgccaccccacgcctgcagccatgccgcccaagctcgacccgtcgcaggtgggtggaggtgttcgtccgtgtgaccggcggcgaggtaggcgcggcgtcttcgctggccccccagatcggtccgctcggtctttcntcccagaagatcggagaggacatcgccnaggagacggccaaggactggaatgggcctccgcgtcaccgtcnagctcacttgtcagaaccgacaggccaaagttctcccgtcgttccctcttgcgcggcccctcgtcatcaaagcgctcaaggaagccgaaaaaggaccgccaggaaggtcaagaacatccaggcacagcggcaacatcagtctccgacgatgtcatccaagattgccaggaccatgatggcccaggtccatggccaagggaatgtcccggcagcgtccaagagattcctcggcactggcgtcagcgtcggctgcaccgtcgacggcatagacccctaggacctgcaacag

SEQ ID NO: 61678 - DNA, 684 bp, Zea mays
  misc_feature: Ceres CLONE 1524590
  misc_feature (510)..(510): n is a, c, t, g, unknown, or other
  misc_feature (531)..(531): n is a, c, t, g, unknown, or other
  misc_feature (538)..(538): n is a, c, t, g, unknown, or other
  misc_feature (540)..(540): n is a, c, t, g, unknown, or other
  misc_feature (561)..(561): n is a, c, t, g, unknown, or other
  misc_feature (574)..(574): n is a, c, t, g, unknown, or other
  misc_feature (667)..(667): n is a, c, t, g, unknown, or other
  misc_feature (668)..(668): n is a, c, t, g, unknown, or other
  misc_feature (674)..(674): n is a, c, t, g, unknown, or other
aaactggagctccccgcggtggcggccgctctagaactagtggatcccccgggctgcaggaattcgtctcacccctagaaaaaacgatcacacaccactccacagcagtagcaagagggatagagcaaggccacacacacacacacaccactagtaggtcgcccaccgccggctccgtccccgagcacgccaacaagccctgaacgccaacaagcgtggtagtagagtggtgctactgttactgtagtacgtcatcatcttcatgcatgcatggttcgtggtttcccctagctccatacgaacagtaggtgggccttgcacgtaccgtacgtctagctagctatatatatagcttgttgcccccccgcttatgagggggggggaacaagccttgcattggcacaatttgaaccccccctcactttggcaggagtattacttatactattaaagtcaaggatcctgttctggcggaaaacctggggggcttaaaatttacattaacccacnttgcaagacagaaaatataanccagccngngggccgccgcgggccaaccgnccctctgacccanagaaataaaaggaataaatgaaacagccaacccaccccccacaatacatccagcaggaagaaaaacaagtctgtttcggccccaccgccgccnnatgaanaaacgacccc

SEQ ID NO: 61679 - DNA, 645 bp, Zea mays
  misc_feature: Ceres CLONE 1524593
  misc_feature: Encodes the peptide sequence at SEQ ID NO. 61680
  misc_feature (179)..(179): n is a, c, t, g, unknown, or other
  misc_feature (291)..(291): n is a, c, t, g, unknown, or other
aagctggagctccccgcggtggcggccgctctagactagtggatcccccgggctgcaggaattcgtctcacccctagaaaaaatccactgcggcacgcgtcccgcctctggtttgcttgcctcccagatcttgccaactaattggaggcagccgagctgatctcccatcccgcaacgcnccgtctcgacggcggatcgttttcttctgcttctactgcgtgatctttgggcaagaagataagacacgtccaagcgtcgccacagtcaaggggcggcttggttgcagtcaangatggggaaggacagaaatctgcccaagctgaagggaggagaaggggtccaaggatgagatccatatgaaggtcaagagcaagggcgagccgtccggcgaggaagacggcaaggaggaggtcgaggtagagattgaggccaagtttgttgagaaggaagaggtcacaggctcgggtgacggtgcgggaggaaagggtaccaagaagaaggatacaaaggagaaagacaagaaaaagaaggaaggtggtgacgattcagggaaggcagaggaagacaataagggtaaagcgaaggattcggagggcaagggccaagtgaagaaggaaaagaaggatggtgctggggacgacggag

SEQ ID NO: 61680 - protein, 96 aa, Zea mays
  misc_feature: Ceres CLONE 1524593
MKVKSKGEPSGEEDGKEEVEVEIEAKFVEKEEVTGSGDGAGGKGTKKKDTKEKDKKKKEGGDDSGKAEEDNKGKAKDSEGKGQVKKEKKDGAGDDG

SEQ ID NO: 61681 - DNA, 771 bp, Zea mays
  misc_feature: Ceres CLONE 1524595
  misc_feature: Encodes the peptide sequence at SEQ ID NO. 61682
aacgagccacaggtaagcgtcgttgcttcacgccgcgttccaattctctgcactgcatgcattacagtcacagcgcgtccgtcctgactcctgacgctcgcgcgctgctttgcaactcctgattctcactgccggtcttgcccgtcgccaggcacaggcaggctctcgagctcagtccacccatcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgccgagatcttcaggatcgccgccaccatgaacggcctcgtgctcgtcggcgtcgccgtcgggttcgtgctgctccgggtggaggccgccgtcgaggagtccgagtagggtgcgtgggcctgccactgtcggctgtcgccccgggccgcagtctgcttcagaaaccgtgatatatataaccagatgtacgctttcgattcaatttactttggtatgtatccatgacaattggtgaatactgtggaaatatgtttttggagtcgaggcctgcaattgatcttcaggtgatcacatcaatggccgagtgagaggaatgcaaaaaaaaaaaaaaaa

SEQ ID NO: 61682 - protein, 117 aa, Zea mays; identical to SEQ ID NO: 57210
  misc_feature: Ceres CLONE 1524595
  misc_feature (79)..(115): Pfam Name: PetM Pfam Description: PetM family of cytochrome b6f complex subunit 7

SEQ ID NO: 61683 - DNA, 708 bp, Zea mays
  misc_feature: Ceres CLONE 1524596
  misc_feature: Encodes the peptide sequence at SEQ ID NO. 61684
  misc_feature (1)..(1): n is a, c, t, g, unknown, or other
  misc_feature (406)..(406): n is a, c, t, g, unknown, or other
  misc_feature (407)..(407): n is a, c, t, g, unknown, or other
  misc_feature (427)..(427): n is a, c, t, g, unknown, or other
ntttctggagctccccgcggtggcggccgctctagaatagtggatcccccgggctgcaggaattcgtctcacccctagaaaaaatctcgttgtccgttgtactctctctctctattcgttccccgcctcaccccgagccagccgtctcgctagggtttctccgccgccgccggcatgcctcgccgcagctcaagaaggtctgccccccgcccaggtccccctggtggctccgtgaagaaccccccactagcagaccgcctggcccctcctccaggcccctgttcgaaaccaaggtggcgacacgtcttcgaagaatctggctccccctttgacaccaggcatgggcccttgagccagagtttttttttttccccccccccccaaggagggaaagaaggggagttanntccacactacccctccctcntcggaggcgggcatcctcaaaaatacatgctcccgaccccctgctggaccccccgtaaagaactcactgcgcgagacgtaccaaccatgcgccgacgaacaaacgtactctcgattttccccaccaaaatggcagaaacctccagacccctgtggtttgcacggcccaccattaagcgcgtcgggcgaaacccaactcccacggactcctcctcttcgcagccaccgacacagaccgacccctgactttccgacgacatcgccgggaaacgagcaaatacg

SEQ ID NO: 61684 - protein, 38 aa, Zea mays
  misc_feature: Ceres CLONE 1524596
MAETSRPLWFARPTIKRVGRNPTPTDSSSSQPPTQTDP

SEQ ID NO: 61685 - DNA, 850 bp, Zea mays
  misc_feature: Ceres CLONE 1524607
  misc_feature: Encodes the peptide sequence at SEQ ID NO. 61686
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (62)..(62): n is a, c, t, g, unknown, or other
  misc_feature (64)..(64): n is a, c, t, g, unknown, or other
nnnnnnnnnnnnnnnnnnnnnnnnnnnnnnnnnnnnngggggggggggnnncgttttttttntncaaagctggagctccccgcggtggcggccgctctagaactagtggatcccccgggctgcaggaattcgtctcacccctagaaaaagctattcgtgtcctggcatccgcagagagcttgttccgtccaggcaaccaaaaagcaagttgccccgccgcgcagaggaagaagagagcagaggaggatggctcgtacgaagcagaccgcccgcaagtccacgggaggcaaggccccccgcaagcaactcaccaccaaggcggcgaggaagtcggcgccgacgaccgtgtgcgtgaagaagccccacaggttcaggctcgaaaccgtggcgctgctcttatattcttgggttacctgaagagcttggtagttggtttatctcgcaggctgccccttccaggcgcctgggagcgaaaatatacggaccaggaatttaaagaaaaaaactcttcggtattccaaaaagccaccccccatgcctggtcaacctccataagaaggacccgactcaagtaaccttacccttcgtttgtgtatcttatttttgaaggggaaaaaggtaagcctttcggagggcgctatcctcatcagctataaacgcgcgagcgcgcgcgttcctgtggccgcgaaagggaagcagcccaggggtgagggacgatgccagacaacaccaatagtcctaacctcccatccttatatctcactttatattttccgtgatggattttataataaaaatatttctttagtgccacacaagaaaaaagaaagaagaccgtagatagcgcccg

SEQ ID NO: 61686 - protein, 56 aa, Zea mays
  misc_feature: Ceres CLONE 1524607
MARTKQTARKSTGGKAPRKQLTTKAARKSAPTTVCVKKPHRFRLETVALLLYSWVT

SEQ ID NO: 61687 - DNA, 688 bp, Zea mays
  misc_feature: Ceres CLONE 1524609
  misc_feature: Encodes the peptide sequence at SEQ ID NO. 61688
tggagctccccgcggtggcggccgctctagaactagtggatcccccgggctgcaggaattcgtctcacccctagaaaaaatccaattcacaggctcaccacaccaaccaacaagcaaaaattccccaatcctctcgtctccgcggcgaatatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcgcttaagcgccagggccgcaccctctacggcttcggcggctaggcctgccgcgccgcgcttcgccgtcgctgcggttctggtgttgctgcagttcgcaagttgtttgtgtgggcggaaaaatgctatatactgtagaactgcattgcggcatgctgcacatgctgtgtttgtctgaagaaatgttgtcaatgctggcttgctctggactccaacatgctccattctgtgtccaacaaatacaaaaaaaacgagacgctcgatgtatcca

SEQ ID NO: 61688 - protein, 103 aa, Zea mays; identical to SEQ ID NO: 6459
  misc_feature: Ceres CLONE 1524609
  misc_feature (25)..(94): Pfam Name: Histone Pfam Description: Core histone H2A/H2B/H3/H4

SEQ ID NO: 61689 - DNA, 678 bp, Zea mays
  misc_feature: Ceres CLONE 1524620
  misc_feature: Encodes the peptide sequence at SEQ ID NO. 61690
agtgatcccccgggctgcaggaattcctctcacccctagaaaaacatagcacagcacaaggagaggccgagaagcgctttagccgtagccgtagcgataagagtgagctagctggtgcacaccggcatggcggccacggcgtactccgtggcgctcctcggcggcgcgtgccttcccgccgctccgcgctccgccctcctccctcggcgcagcgtctgacagattcgcttccaagatgcaacgaagctcaccctgctccgtgcgaaggccgcttcccaagatatatcggcctcctgagacaaaatgatcgtcgatctcaccctaaaatgggaagccggggaagaaaaacctacaataattctccccccccacgtggaaacgaacgaacccctttaatcgaccatcctcgtttgcggctgtctataaaatccttgccacccatgctttcgttctctctttcccttcttttctttcccctacccccttttcccttttaccccccgcccttccccctcaatatccatatacccttccgtcccctactcctttcctcccttacaccgtccagatctctcccttataatctccaatccccccgtttattttacaacctctacactatcctatccttgaccgccataataaccccatatacccgattatcttacacccactttt

SEQ ID NO: 61690 - protein, 30 aa, Zea mays
  misc_feature: Ceres CLONE 1524620
MAATAYSVALLGGACLPAAPRSALLPRRSV

SEQ ID NO: 61691 - DNA, 666 bp, Zea mays
  misc_feature: Ceres CLONE 1524621
  misc_feature: Encodes the peptide sequence at SEQ ID NO. 61692
  misc_feature (53)..(53): n is a, c, t, g, unknown, or other
  misc_feature (81)..(81): n is a, c, t, g, unknown, or other
  misc_feature (140)..(140): n is a, c, t, g, unknown, or other
  misc_feature (666)..(666): n is a, c, t, g, unknown, or other
atagctggagctccaccgcggtggcggccgctctagaactagtggatcccccngggctgcaggaattctgtctcacccctnagaaaaaaaaaaaaaaaaaaaaaagtaaacgatcacttcatgggccttcaatactattntgtgatgccactcaggaaagacaagatgctatgtatcagctggtgaaagagaaagttgaccttattcttgttgttggaggatggaattcaagtaacacctctcatctgcaagaaatcggagaactcagtggaattccatcatactggattgacagtgaacaaaggattggaccaggaaacaggatcagctacaagttaaatcatggtgaactggttgagaaaaataactggttacccgaggggcgtattaccattggtgttacttcaggtgcctcaactccagatagggttgttgaggatgctcttcagaaggtatttgagatctagcgtccgggaatttttgcagggtggcataaatttttaaccaaaaatttttgggaaaaacctaaaaaaatttttgggctttggcaaaaggggttttaaaaaaaattttttcccacgggaaaaattttttttttcccccacacccccacagggggtggtgccccccgtggtgggggggggcaaaaaaaataatctccccccn

SEQ ID NO: 61692 - protein, 154 aa, Zea mays
  misc_feature: Ceres CLONE 1524621
  misc_feature (3)..(154): Pfam Name: LYTB Pfam Description: LytB protein
  misc_feature: SWISSPROT Homolog: EC 1.17.1.2 4-hydroxy-3-methylbut-2-enyl diphosphate reductase
  misc_feature (27)..(27): Xaa is any aa, unknown, or other
  misc_feature (46)..(46): Xaa is any aa, unknown, or other
SWSSTAVAAALELVDPPGLQEFCLTPXKKKKKKKSKRSLHGPSILXCDATQERQDAMYQLVKEKVDLILVVGGWNSSNTSHLQEIGELSGIPSYWIDSEQRIGPGNRISYKLNHGELVEKNNWLPEGRITIGVTSGASTPDRVVEDALQKVFEI

SEQ ID NO: 61693 - DNA, 686 bp, Zea mays
  misc_feature: Ceres CLONE 1524622
  misc_feature: Encodes the peptide sequence at SEQ ID NO. 61694
aagctggagctccccgcggtggcggccgctctagaactagtggatcccccgggctgcaggaattcgtctcacccctagaaaaaaggccaccaccacaccacaccacaccacaccaccggcggcggcggcgacccagtcgagaacacgaaggcgatggcgacagcgctgaaccgcgggctccgtctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcacaacaagactgcctctggctgagatgatgcctctcgctgcctgcatatggagacttattttgagcgacatttttttgaagttaaaagcttggacttcatcctatcttggctgtggagattggggaaaactcagcgctgataccatttgctaaaaaaaaaaaaaaaaacgagacgctcgaggtacccaattcgccctatagtgagtcgtattacgcgcgctcactggccgtcgttttacaacgtcgtgactgggaaaaccctggcgttacccaactt

SEQ ID NO: 61694 - protein, 92 aa, Zea mays
  misc_feature: Ceres CLONE 1524622
MATALNRGLRLLAAGAEASKPASRGFHATGVKRMGGHGHDEPYYIHAKHMYNLHRMKHQGLKVTLSVLGAVGIGVGVPVYAVIFQHNKTASG

SEQ ID NO: 61695 - DNA, 648 bp, Zea mays
  misc_feature: Ceres CLONE 1524623
  misc_feature: Encodes the peptide sequence at SEQ ID NO. 61696
  misc_feature (544)..(544): n is a, c, t, g, unknown, or other
  misc_feature (545)..(545): n is a, c, t, g, unknown, or other
aagctggagctccccgcggtggcggccgctctagaactagtggatcccccgggctgcaggaattcgtctcacccctagaaaaagaagcccgtcgttctggaagtttccacgctccgcgcctccgccccctggtctgagtggtctccgctccaatggcgccctcactcctcgccgccatgtccacctcgcccttcctagccagcagcggcagcagccgcaggccgctaggcgctgcccacacccgacgggctggactgcgcgtggccgcgcttaagtacgaccctgcccaaggtgcgccgcagaacgacggggttctcgtccgtcttgagcaaatccctgaaaaacctgctggcggggtgttgctaccaaaaacggctttaagtttgaaaaatatctaaggggggaaattttcccaatcggggccaaaacccgaaatttaagcgcgggaaaaaggtttcttttctaaaaaaaaaggtttttaaaggggggactcttttccacaaaaaaaaaaaaacccctctctccccgggggaaaaaaaatttnnccggggggggaaaaaaaatttttccccgggaaaaaaattccccccccctcgcgggagttatcttttcccccccccaccctgtgggaggggccaaaacaaaaaa

SEQ ID NO: 61696 - protein, 73 aa, Zea mays
  misc_feature: Ceres CLONE 1524623
MSTSPFLASSGSSRRPLGAAHTRRAGLRVAALKYDPAQGAPQNDGVLVRLEQIPEKPAGGVLLPKTALSLKNI

SEQ ID NO: 61697 - DNA, 691 bp, Zea mays
  misc_feature: Ceres CLONE 1524625
aagctggagctccccgcggtggcggccgctctagaactagtggatcccccgggctgcaggaattcgtctcacccctagaaaaaaaggaaaggcttgcaggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgcagcgaaatggggagcagccctagacccgtgaaaaacggggctttgccgggaaaaaaacaaataaatacccccctttgggccctgcccaccgcgcaaaaaaacgttatatgagatatagagtttcggccccccccccccccccaaatttccgttcatcgttcccctccttttcctttccccagcgcggatacctcttttacgtgtatctttatctcctcgttttcccatgtcgttgcgtagggggtgtgccttcctgtccacgccccccccgttcggtccgtattaacgaggggggcggccattcttcttcccttctttcggggaagagagcaaaactcctattttactttcgtaccctttgtactcgtccgcctttt

SEQ ID NO: 61698 - DNA, 679 bp, Zea mays
  misc_feature: Ceres CLONE 1524627
  misc_feature: Encodes the peptide sequence at SEQ ID NO. 61699
  misc_feature (550)..(550): n is a, c, t, g, unknown, or other
aaagctggagctccccgcggtggcggccgctctagaactagtggatcccccgggctgcaggaattcgtctcacccctagaaaaagcccgcactaccacgcgaccacgcccccgctcctctcgtctctttcttcgcctcttccatcgcaggattcggcggccatgggcggcggcaacggccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaattagtaagcagcagaagcatatgatctgctcagctaaaagacaagtactacatatatatatatacgctgtgtgtcaattaatgggttgtaggctgctgttgatgcggctgcttcgttcgtgttgccccgtctgattatgtactgtaacccttggctgtncacgtactgtgctaaaaaccactggttctgtgtggattcatgctgcccaaaaaaaaaaaaaaaaaaaacaaaaaaaaaaaaaaacgagacgctcgaggtacccaattcgccctatagtgagtcgtatac

SEQ ID NO: 61699 - protein, 77 aa, Zea mays; identical to SEQ ID NO: 59663
  misc_feature: Ceres CLONE 1524627
  misc_feature (4)..(73): Pfam Name: DUF1909 Pfam Description: Domain of unknown function (DUF1909)

SEQ ID NO: 61700 - DNA, 657 bp, Zea mays
  misc_feature: Ceres CLONE 1524629
  misc_feature: Encodes the peptide sequence at SEQ ID NO. 61701
aaagctggagctccccgcggtggcggccgctctagaactagtggatcccccgggctgcaggaattcgtctcacccctagaaaaaaaaccacgcgcaggacaagccatcgccccgatggataccgccggctcatgccgcctcctctcgcaggcctcgtcctctgcgcccccctgtccgaagcagctactcaagcggcgaccgaccttcgcggcctcgcagcagcagtcgcccagctccagcgccaagttcaggctcctctgcctcctccatgacaagtccgcgtcgccaacgacgtcggtgcagatgcaaatctcacagtcacagttgcacaggctggctacggagttgcagtgcggagccgtctgggcagctgttgaggcgccggcggcgctggaggtgaccggcgagcgagacatcgagctgctacggatcctgccgccgctcgcggagttcgacttcttctacttcctcgtcactcctccggtgatcattgactggatgacgctgatgtggtacaaaccccaaatttcggggaaaacggaccttaccctttcttggttcccctaaacttttttacaccccccggccaaaaatgttttttgggggccccttttttcctcaaaatattggggggggggttcctcccgggggggggtc

SEQ ID NO: 61701 - protein, 150 aa, Zea mays
  misc_feature: Ceres CLONE 1524629
MDTAGSCRLLSQASSSAPPCPKQLLKRRPTFAASQQQSPSSSAKFRLLCLLHDKSASPTTSVQMQISQSQLHRLATELQCGAVWAAVEAPAALEVTGERDIELLRILPPLAEFDFFYFLVTPPVIIDWMTLMWYKPQISGKTDLTLSWFP

SEQ ID NO: 61702 - DNA, 687 bp, Zea mays
  misc_feature: Ceres CLONE 1524633
  misc_feature: Encodes the peptide sequence at SEQ ID NO. 61703
  misc_feature (412)..(412): n is a, c, t, g, unknown, or other
  misc_feature (463)..(463): n is a, c, t, g, unknown, or other
  misc_feature (494)..(494): n is a, c, t, g, unknown, or other
  misc_feature (540)..(540): n is a, c, t, g, unknown, or other
aagctggagctccccgcggtggcggccgctctagaactagtggatcccccgggctgcaggaattcgtctcacccctagaaaaaaagccagacagaagacaacccgtcagcccctctcgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaangagttcagctataacaagatccctcaggatctgaagaaggaattctgctgncatggtactgtagttcaggacccagagctangccaggtcattcagctccaaggtgaccagcgcaagaatggtgctancttccctagtcaggctgggattgcgaagaaagaaaccatcagattcacgggtctaaaggaacctgtaaatgcttgtgccccaaaatggggggcctcaccatattggggaagcttgaagcatccaaggttgctagccattgcttactt

SEQ ID NO: 61703 - protein, 145 aa, Zea mays
  misc_feature: Ceres CLONE 1524633
  misc_feature (27)..(108): Pfam Name: SUI1 Pfam Description: Translation initiation factor SUI1
  misc_feature (54)..(54): Xaa is any aa, unknown, or other
  misc_feature (71)..(71): Xaa is any aa, unknown, or other
  misc_feature (82)..(82): Xaa is any aa, unknown, or other
  misc_feature (97)..(97): Xaa is any aa, unknown, or other
MSDLDVQLPSAFDPFAEANAEDSGAGPGTKDYVHVRIQQRNGRKSLTTVQGLKXEFSYNKIPQDLKKEFCXHGTVVQDPELXQVIQLQGDQRKNGAXFPSQAGIAKKETIRFTGLKEPVNACAPKWGASPYWGSLKHPRLLAIAY

SEQ ID NO: 61704 - DNA, 703 bp, Zea mays
  misc_feature: Ceres CLONE 1524634
aagctggagctccccgcggtggcggccgctctagaactagtggatcccccgggctgcaggaattcgtctcacccctagaaaaaatattatccacaacatctcctccatctaggcacatacctactttcttctactacacgactactaacatgcttgacatcctgcgaagatccgaaagtggggtggatacaccggcgatcttcggcatctgagggctactccggaccggctgaccgaggtgaaggtcacggcgtacaacaacagctgcatccgctccatctccttcatctacatcggagcctgatggccagtcgtacgaggaggggccatggggtttcggtcatgctggcacgtagtacgagattgatctgggcacgttcaatcagagcttagacggagatctccggcaccacgggcccggtcctacaacattgacaatctggttcaagtctctcaaatttcgtttccttaaaaacggatcttacggacccgcccgggaaggaaacaagggcacccccgttacgggttcacggggatgaaccaacggcccccttccttggctttctttaggcccgctcctggcaaattgccccgaacgccaattcggccttataaacctcccccccaacttataaattacaaactaaagggtaccggaaccccttttttattgcccgcccccctcccattccgcccgccttgc

SEQ ID NO: 61705 - DNA, 756 bp, Zea mays
  misc_feature: Ceres CLONE 1524635
  misc_feature: Encodes the peptide sequence at SEQ ID NO. 61706
  misc_feature (756)..(756): n is a, c, t, g, unknown, or other
aacctggagctccccgcggtggcggccgctctagaactagtggatcccccgggctgcaggaattcgtctcacccctagaaaaaaagaagacaacccgtcagcccctctcgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggcgctggtcctggaacgaaggattatgtgcatgtgcgcatcccttttttcaaccgcccacagagggggggggggaggccaggcctaaaaaaccaccccccccccccaagattcttcagggtccgaagaaggaattctggttgagtgctactacacttcacgaccccgagactaggcccggtctttcccttcccacgttgccctgccgcaactatgcgcctacctcgcttacctccaggtccgccatcggcgtaccaccgcacatctccctactcgctccgctcccccagggcccttccgaccgctcccccccccttaaccagccgctggttctcgtcccctttccccgcgacgtttttgtccccgccctgcgggtttccgccgctcccgacgccctttcctggaccctgtgagacacccaacgctcgttccttgccccgctttn

SEQ ID NO: 61706 - protein, 70 aa, Zea mays
  misc_feature: Ceres CLONE 1524635
MSDLDVQLPSAFDPFAEANAEDSGAGPGTKDYVHVRIPFFNRPQRGGGRPGLKNHPPPPRFFRVRRRNSG

SEQ ID NO: 61707 - DNA, 709 bp, Zea mays
  misc_feature: Ceres CLONE 1524638
  misc_feature: Encodes the peptide sequence at SEQ ID NO. 61708
aagctggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttgggaatgcagcccaaatcgggcggtaaactccgtccaaggctaaacaccccccagagaccgatagcgaacaagtaccgcgaggaaaagaagaaggctgaatatgcacagaagatgaagaacaaggttgcaatgatacacaaggaagccgaatagaagcgagcgatggtggaggcaaaacgcggtgaggaggtcctgaaggccgaggagatggctgccaagtcccgggccaccggccacgctcctaagaagctcatcgggtgcttcgggacctaagaagccttcccagtcagaccgcagcagaaagtgaaaaccgtcgcccggggattgcttgggccctctcgctcctac

SEQ ID NO: 61708 - protein, 36 aa, Zea mays
  misc_feature: Ceres CLONE 1524638
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 438 in the 10/666,642 US patent application
  misc_feature: The sequence is a functional homolog of SEQ ID NO 496 in the 11/435,388 US patent application
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
MVEAKRGEEVLKAEEMAAKSRATGHAPKKLIGCFGT

SEQ ID NO: 61709 - DNA, 662 bp, Zea mays
  misc_feature: Ceres CLONE 1524641
  misc_feature: Encodes the peptide sequence at SEQ ID NO. 61710
  misc_feature (401)..(401): n is a, c, t, g, unknown, or other
ggagctccccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcggtgtccgcgtccgcgtcgtccacgctggcgggcgccttcttcgcggcgctggcgtcgtcgcccgacgctgcgctggcggacgtcntggcggcggcggacgccggcggcgacagccgcggccagctgctgctcgtcgtggtggcccccgcccatcggggtgggtggctgtacaaaaatcctggcaacccggggcttaaacccactgaaaccccatgcgccaaaaacccgggccggggccccctgggcctggggccttcggcccccccccccccccggaaagggggggccccccccccaaggccctcccccccccggggtggcaaggcccccccaaaaaaatcccccg

SEQ ID NO: 61710 - protein, 158 aa, Zea mays
  misc_feature: Ceres CLONE 1524641
  misc_feature (72)..(72): Xaa is any aa, unknown, or other
MATIATMALLKPAAKAAARSAPSTSSGSVSLRVRTGQAAKKAAVSASASSTLAGAFFAALASSPDAALADVXAAADAGGDSRGQLLLVVVAPAHRGGWLYKNPGNPGLKPTETPCAKNPGRGPLGLGPSAPPPPRKGGAPPPRPSPPRGGKAPPKKSP

SEQ ID NO: 61711 - DNA, 698 bp, Zea mays
  misc_feature: Ceres CLONE 1524642
  misc_feature: Encodes the peptide sequence at SEQ ID NO. 61712
ggagctccccgcggtggcggccgctctagaactagtggatcccccgggctgcaggaattcgtctcacccctagaaaaaactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcaccgccatggccgccgcgctcgtggcgtccgccgcagccgccgaggcccccgccccggctcccgcgtccgacgccgcggccgccgtacccctcgccgccttcgggtacctcttctgctagatccgcgctggatacgtggttcctgctccaaaatatgattcgtctgggctggcgcgcgcgagtccagctcgtgtgacgagcgtgtctctgtgtgaggtgtcggcggacgtgtgtatgtatggagtcggccgccgcggcggacgaggactgcgcgtggtggtggtggtacgtgcttcgacgcgccactgtttgtcgcggcgatcatgtactaccctgctgcgttctctggttatcgatgagatgatttatctgattgagcaaaaagaaggaacgagacgctcgaggtaccacattctgcctatagtgagacgtattacgcgcgctcactggccgtcagtttacaacgtggg

SEQ ID NO: 61712 - protein, 50 aa, Zea mays
  misc_feature: Ceres CLONE 1524642
MAGLRMKFVAVTAMAAALVASAAAAEAPAPAPASDAAAAVPLAAFGYLFC

SEQ ID NO: 61713 - DNA, 686 bp, Zea mays
  misc_feature: Ceres CLONE 1524643
  misc_feature: Encodes the peptide sequence at SEQ ID NO. 61714
ggagctccccgcggtggcggccgctctagaactagtggatcccccgggctgcaggaattcgtctcacccctagaaaaaactgactatctccctctgtcctccctctcctctgccgccgtcaccggcacttccttcgccgtaccatgacgagcacgcgccgtggtcacaatgaggtccttcaccgtgcgcgcctctctcctcaaggccaccgggatcgccgacgagacgatggctgctagctgcctgattaccggtggcgccaaggtccaggagatgatgctgggggcaggcaaaaagggagatatgcttccagaccatccagttcatcgtccatgaccgcgacaccatcccatttgacaacaacgtcagcttcccccacaacctcctcatccacaaagaccatggtgccgagccgcagacatacgccgacgagatgtcctacgacgactacaacgacgcggcaataaagaactactttgacaccctcaccaaggaggagaactcatagtttctgctgctatcctgatagagcaggcagaatggtctgtgacatctactatcaactaattaagaagcttctccctcgatatacatatgagtcttacctgttgagtactgtggtggactacgcctatcatcctctcacagcttgttctcgatatcactttgtgtaatgcttattatgg

SEQ ID NO: 61714 - protein, 55 aa, Zea mays
  misc_feature: Ceres CLONE 1524643
MRSFTVRASLLKATGIADETMAASCLITGGAKVQEMMLGAGKKGDMLPDHPVHRP

SEQ ID NO: 61715 - DNA, 671 bp, Zea mays
  misc_feature: Ceres CLONE 1524646
  misc_feature: Encodes the peptide sequence at SEQ ID NO. 61716
  misc_feature (516)..(516): n is a, c, t, g, unknown, or other
  misc_feature (571)..(571): n is a, c, t, g, unknown, or other
  misc_feature (625)..(625): n is a, c, t, g, unknown, or other
  misc_feature (650)..(650): n is a, c, t, g, unknown, or other
  misc_feature (651)..(651): n is a, c, t, g, unknown, or other
agctccccgcggtggcggccgctctagaactagtggatcccccgggctgcaggaattcgtctcacccctagaaaaaaaagcagaaagggagagagagacaggaccaagggagagaggagagagagcgatcgagagatgaggagggagcttgcctcccccttagctactgccgccgctgccacggccggtgcctccttctcggctgccgcctcgctccggggctggtgggacgatgtcaacgagtcgccccagtggcaggacggggccttcttctccctcgccgccgcctacgccctcgtctccgccgtcgcactggttgggaccgtgacagcaatttgtgttacctgctttctgataagatgtgttgtggtcacgctatctgcatttgatgctgatgtatctctcgaggttttggaccatccagtcctagatttcttctattatatgtttgcggagatactcccttctgcgctggttctcttcgtccttcggaagcttcctcccaagcgggtatcnggcgcataccaccctattaactagggagttctttgtttttatgatgttacatgcntagaactccggataagctggaactgctgaaacctacatccggttgtattgctgntatattttatggaagcatcccaggnntgcaagatgcatcatcacct

SEQ ID NO: 61716 - protein, 134 aa, Zea mays
  misc_feature: Ceres CLONE 1524646
  misc_feature (14)..(134): Pfam Name: DUF1084 Pfam Description: Protein of unknown function (DUF1084)
MRRELASPLATAAAATAGASFSAAASLRGWWDDVNESPQWQDGAFFSLAAAYALVSAVALVGTVTAICVTCFLIRCVVVTLSAFDADVSLEVLDHPVLDFFYYMFAEILPSALVLFVLRKLPPKRVSGAYHPIN

SEQ ID NO: 61717 - DNA, 542 bp, Zea mays
  misc_feature: Ceres CLONE 1524651
  misc_feature: Encodes the peptide sequence at SEQ ID NO. 61718
actcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgccttcggctacctcttctgctagatccgcgctggatacgtggttcctgctccaaaatatgattcgtctggtctggcccgcgtgagtccagctcgtgtgtcgtgcgtgtctctgtgtgaggtgtcggcggacgtgtgtatgtatggagtcggccgcggcggcggaggaggtctgcgcgtggtggtggtggtacgtgcttcgacgcgccactgtttgtcgcggcgatcatgtactaccctgctgcgttttctggttatcaatgagatgatttatttgattaaaaaaaaaaaaaaaaa

SEQ ID NO: 61718 - protein, 50 aa, Zea mays
  misc_feature: Ceres CLONE 1524651
MAGLRMKFVAVAAMAAALVASAAAAEAPAPAPASDAAAAVPLAAFGYLFC

SEQ ID NO: 61719 - DNA, 730 bp, Zea mays
  misc_feature: Ceres CLONE 1524672
  misc_feature: Encodes the peptide sequence at SEQ ID NO. 61720
ggagctccccgcggtggcggccgctctagaactagtggatcccccgggctgcaggaattcgtctcacccctagaaaaaaactctcctcttgcggcgcacaaggcagcagctaggaggcccgagtcgcgcgtcctgaaagaggaccccacgctcaagtccatcctcgactagtatcgagtccggacggccccgacgtcatgatgaagtactggaacgaccctgaagctctgcagaaattcggccgcgcgatgggcgtcggagtcggcccgtcccgcgactcctgctgtgcctagcacccccaggcgcaggacgacactggtaaggaaggcaaataatagaagtaatccgtcaactgccacaccaccattgttgtggacaatctaggacctcaagagtgcgatggcagacgcccacctacgggaccaggacgactcgtgaagggcctcgtggcctccactataagtcgctgctatgggcgaactcccgtgcgcgcaggtgtctcctggaggtcggcgccccgtctggacaccgtctacaataacaggaacactgtcgctatacctggccgaccggatacggccgcaatggactgagagatgcacccttctcgagaaggggctccaaccgggcagtgcagaccctagcaccggaaaaactcccttcgtagtgggaacaactagtgccccgggtcaggacacacccctagccgttttggtattctcccctaccg

SEQ ID NO: 61720 - protein, 31 aa, Zea mays
  misc_feature: Ceres CLONE 1524672
MMKYWNDPEALQKFGRAMGVGVGPSRDSCCA

SEQ ID NO: 61721 - DNA, 675 bp, Zea mays
  misc_feature: Ceres CLONE 1524696
  misc_feature: Encodes the peptide sequence at SEQ ID NO. 61722
ctccccgcggtggcggccgctctagaactagtggatcccccgggctgcaggaattcgtctcacccctagaaaaaatgcggctgtgtgcttcgttcagttaaattcataccgtgttcttgtttgcgacggcaagagagactgatagaggatgtcttgctgcggatgcaactgcgggtgcgggtccggctgcaagtgcggcaacggctgccgagggtgcaccaagatgtacccggacatggtcgatcaggtgaccaccaccaccacccaggctctcatcatgggtgtcgcaccatccaaggggcacgccgagggcgggttcgaggcggtcgcccgagctgagaacagcgggtgcaagtgcggtggcaactgccagtgcgacccctgcaactgcagccagtgagctaggtgctccaccctgcttgccggccggaggaagctagctaattatgaatcttaataaagtatagacgcgtcgctgtgtgtgtttcgagtacgacagacaaacagttgcgtgccatgggatgctcctagtctgataagatgatgatgcctgatggcggactcctgtcctccccaggtctcctggggcgcttctggcgaccaccgtgatgtcatctggtatcgtggtgacacacgctagcaggctgcccatgtgccctgctgtagtagggaccc

SEQ ID NO: 61722 - protein, 83 aa, Zea mays
  misc_feature: Ceres CLONE 1524696
  misc_feature (1)..(81): Pfam Name: Metallothio_2 Pfam Description: Metallothionein
MSCCGCNCGCGSGCKCGNGCRGCTKMYPDMVDQVTTTTTQALIMGVAPSKGHAEGGFEAVARAENSGCKCGGNCQCDPCNCSQ

SEQ ID NO: 61723 - DNA, 699 bp, Zea mays
  misc_feature: Ceres CLONE 1524886
  misc_feature: Encodes the peptide sequence at SEQ ID NO. 61724
  misc_feature (614)..(614): n is a, c, t, g, unknown, or other
  misc_feature (615)..(615): n is a, c, t, g, unknown, or other
  misc_feature (626)..(626): n is a, c, t, g, unknown, or other
  misc_feature (632)..(632): n is a, c, t, g, unknown, or other
  misc_feature (633)..(633): n is a, c, t, g, unknown, or other
gcggtggcggccgctctagaactagtggatcccccgggctgcaggaattcgtctcacccctagaaaaaatccactctcagcatcaccagctaagaacaggtcttcgtctcattaatggaaggcaaaacagggcagctcaggtgctgtttcgtcaccatcgtgctcgtcctgggtcttgtccttgagcagacccagcaggctgaagctagaggcaaatggtgctgcgaaaccgccaccgaaaaataccattttaatcgctgcgttgactcaggttgggtcgacaatattgggttctgtgcaagaaatgccagttgcatcattatggaggacagatgtggaggtcgttggccagagcctgctcgtgatgcgctttctctggatgtcatttgattacttatatacaagtacctgaagtgatgaaacgagggccagacgactgtctcccagtgattgcttatttgcgaacttgacagttgtcgtcttatttcaactttccaataaccccatacgtgtagtcgcgacctccccttcaagtttgtcgactgttgcgtaatcaatctatatagcaaataacactggcgcgtacgtgtaaagtctctatttctgatcgtgcnngcttttgcttntcgggnngtaatgaactgagctaacacaaaaacgagccctctaggtaccatttcgcctatagagagtcaatac

SEQ ID NO: 61724 - protein, 91 aa, Zea mays
  misc_feature: Ceres CLONE 1524886
MEGKTGQLRCCFVTIVLVLGLVLEQTQQAEARGKWCCETATEKYHFNRCVDSGWVDNIGFCARNASCIIMEDRCGGRWPEPARDALSLDVI

SEQ ID NO: 61725 - DNA, 699 bp, Zea mays
  misc_feature: Ceres CLONE 1524908
  misc_feature: Encodes the peptide sequence at SEQ ID NO. 61726
  misc_feature (699)..(699): n is a, c, t, g, unknown, or other
gctctagaactagtggatcccccgggctgcaggaattcgtctcacccctagaaaaagagaaatcattagacctcaagaaaacaggtcagcaatggaagccacggcgacgccacgaacccaagaagtgatgaagcccgagcccggcacggtcaaggtgaccgtggacgaggtgacgctccgcaagttcgagctgtccgacgtggacgccatgatggcgtgggcgtcggacccgcaggtggccgccttgtgccggtgggagccctacgagtcaacggagccgctgctggccttcatccgcgacgtggtgctcccgcaccagtggttccgcgccatctgcctcggcagcgagacccgccccgtcggcgcggtgtccgtgtcccccacgggggacccgtgccgcgccgagctcggctacgtgctggcgcgcgcgcattggggccggggcgtgcccacggcggcgtgaagcgcacggtggacgccgttgtcggccaaggccccggggcttggacccgttcaagcccttcgttgacttgcccaacttggctctcaacgggtgggtggaaaagggccgggttcccaagggagggccgggctccccaagtttgggccctaacaggggcctctcagggaaaaggggcttggtgattttttttaacccccaacaatgtgccaaagtgattttgcccccctggtccaaan

SEQ ID NO: 61726 - protein, 123 aa, Zea mays
  misc_feature: Ceres CLONE 1524908
MEATATPRTQEVMKPEPGTVKVTVDEVTLRKFELSDVDAMMAWASDPQVAALCRWEPYESTEPLLAFIRDVVLPHQWFRAICLGSETRPVGAVSVSPTGDPCRAELGYVLARAHWGRGVPTAA

SEQ ID NO: 61727 - DNA, 709 bp, Zea mays
  misc_feature: Ceres CLONE 1524911
  misc_feature: Encodes the peptide sequence at SEQ ID NO. 61728
ctccccgcggtggcggccgctctagaactagtggatcccccgggctgcaggaattcgtctcacccctagaaaaaaggccaccaaaggtaccttgcaatcacaacgaacagaatctctcgatctcaccgacaccgaggaagaagagatcattggcgtccgagcagggagtcgtgatcgcgtgccacatcaaggctgagttcgacgcccacatgaccaacgcccaggaagccggcaagctggtggtcatcgacttcactgccgcctggtgcggtccatgccacgccatctccccactgttcgtcgaacacgccaagaatttcactcaggtcgtcttcctgaatgtggacgtggacgaagtgaacgaagtcaccgcggcctacgaggtcgaggcgatgcataccttcctcttcatcaagaacgctagactgtcgcgaccatcgtgggtgccagaaggacgatctcctggccctatcgagaagcatgccgcgcctgcgactgcgtctgcgtctgcctaaggatatcagtcatcgccatcaagaagggccagcacgtatggctgtagatgctgtcgttatcagtccaggctttcaccatagcgtgcgagtgcgactagctagatgtttgattctgtccgagcgggagcgatactaatcatggatactgttgtaagttcctcccgtcgcagtgactctgcaatgactcactgctc

SEQ ID NO: 61728 - protein, 170 aa, Zea mays
  misc_feature: Ceres CLONE 1524911
  misc_feature (57)..(164): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
PRGGGRSRTSGSPGLQEFVSPLEKRPPKVPCNHNEQNLSISPTPRKKRSLASEQGVVIACHIKAEFDAHMTNAQEAGKLVVIDFTAAWCGPCHAISPLFVEHAKNFTQVVFLNVDVDEVNEVTAAYEVEAMHTFLFIKNARLSRPSWVPEGRSPGPIEKHAAPATASASA

SEQ ID NO: 61729 - DNA, 675 bp, Zea mays
  misc_feature: Ceres CLONE 1524920
  misc_feature: Encodes the peptide sequence at SEQ ID NO. 61730
aaagctggagctccccgcggtggcggccgctctagaactagtggatcccccgggctgcaggaattcgtctcacccctagaaaaaagcttcccgactttgtctgttctgcttcgctcgcgggcgctcatctccactcctccgatggcgccgccacccaccagcccctcattcctccgcccgccgccgctgccacaccacccgcaccctcgcctccttttgcgacctccctccgcctctttccgcgtcgccgaaatactcggcggtcggggcctctgcaatggtgaggtcggcgtccgcaaagaactcgcatccggctccaccacctcctcgcccgcgccctctcctcctccttcgacagattctcctccgcccgcggttgatccggacgcgttcgagaaggagatgatgggcctcacaggcggcttccctggcggtgaggtcggcctcaaggacttcgtagccaagaacccgcctcctcccaagaaatcagaatcccagccccaagccacgctctccgcgccgccgcggccgccggagctgccgctgttcttgcccggcatggtggtgctggtcaagaaacccaacaacgcctaccacatgtactgcggtatcgtgcagcgcgtcagcgacggcaaggtcgcggtgctcttcgagggaggagtgtgggacaggctc

SEQ ID NO: 61730 - protein, 178 aa, Zea mays
  misc_feature: Ceres CLONE 1524920
MAPPPTSPSFLRPPPLPHHPHPRLLLRPPSASFRVAEILGGRGLCNGEVGVRKELASGSTTSSPAPSPPPSTDSPPPAVDPDAFEKEMMGLTGGFPGGEVGLKDFVAKNPPPPKKSESQPQATLSAPPRPPELPLFLPGMVVLVKKPNNAYHMYCGIVQRVSDGKVAVLFEGGVWDRL

SEQ ID NO: 61731 - DNA, 681 bp, Zea mays
  misc_feature: Ceres CLONE 1524927
  misc_feature: Encodes the peptide sequence at SEQ ID NO. 61732
  misc_feature (494)..(494): n is a, c, t, g, unknown, or other
  misc_feature (503)..(503): n is a, c, t, g, unknown, or other
  misc_feature (539)..(539): n is a, c, t, g, unknown, or other
  misc_feature (575)..(575): n is a, c, t, g, unknown, or other
  misc_feature (600)..(600): n is a, c, t, g, unknown, or other
caaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggctgccgtggaagcggcggcggtgggtaccgtggtggccgtggaggcngctgctacngcggtggcgggcgctgtgatggcggtgggcgctacngcgggtgcggcggctacggtgggcggcgcggctacnggtgtggtggccgcggctacggcgntggcaacccgtggcggcggctaacggaacctccaacggaacctggaggacctgaacggttggggcctccccggccaaattt

SEQ ID NO: 61732 - protein, 165 aa, Zea mays
  misc_feature: Ceres CLONE 1524927
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (104)..(104): Xaa is any aa, unknown, or other
  misc_feature (107)..(107): Xaa is any aa, unknown, or other
  misc_feature (119)..(119): Xaa is any aa, unknown, or other
  misc_feature (131)..(131): Xaa is any aa, unknown, or other
  misc_feature (139)..(139): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGCRGSGGGGYRGGRGGXCYXGGGRCDGGGRYXGCGGYGGRRGYXCGGRGYGXGNPWRRLTEPPTEPGGPERLGPPRPN

SEQ ID NO: 61733 - DNA, 791 bp, Zea mays
  misc_feature: Ceres CLONE 1524932
  misc_feature: Encodes the peptide sequence at SEQ ID NO. 61734
  misc_feature (55)..(55): n is a, c, t, g, unknown, or other
  misc_feature (399)..(399): n is a, c, t, g, unknown, or other
  misc_feature (420)..(420): n is a, c, t, g, unknown, or other
  misc_feature (585)..(585): n is a, c, t, g, unknown, or other
caccacagtggcggccgctctagaactagtggatcccccgggctgcaggaattcntctcacccctagaaaaaacttctgtacccaacagaagagcggcggcgcggacggacaaggagcaggcggaagaggagttgtgccaaggcacaatgggtatctcgcgtgactcgatgcacaagcgccgagccaccggtggaaagcaaaaggcctggaggaagaagcgaaagtatgagcttggtcgccagccagccaacaccaagttgtcaggcaatattaccgcctggaggggccgtgttcctgaaggtaatgtgtatttgagggctctttcgccttgaaactggtaactacttttttcccccccccccgcggtgaagaaaggggcccttatctctcctattttnttggggccgtcccccaaaaanaaaaatttataaaaattccttacccttggtggggggggcccatggtcatgacgtaaaaggcggccccgatatatagctagtggcgagcgccctctactttacgggcctcccccccttagggaccaaaaaaagaaaccccacacatccagcacttgccgaccaaangtctagactgtcgaacgacgtttccgctcttctcttttgcggggccctaaagcatggttagataacagcccactcacataatgtctactagaaaagcttagtctcgagccgcgccctttcccctattcccccttgatagctggatggcgttgctcgtgcccacgcctaatacgtagtacgtttcctacgacgcatcacgcggctcg

SEQ ID NO: 61734 - protein, 61 aa, Zea mays
  misc_feature: Ceres CLONE 1524932
MGISRDSMHKRRATGGKQKAWRKKRKYELGRQPANTKLSGNITAWRGRVPEGNVYLRALSP

SEQ ID NO: 61735 - DNA, 726 bp, Zea mays
  misc_feature: Ceres CLONE 1524938
  misc_feature: Encodes the peptide sequence at SEQ ID NO. 61736
acccgcggtggcggccgctctagaactagtggatcccccgggctgcaggaattcgtctcacccctagaaaaaaccgccaccatctaggctagtctacagctagtacacaccccacaacaatataatcgtcgtcgtggcggattggagttgacagttgccataccaccagtactagctcgctcgctcgcttgctctcagaactgatcgctgtgaggagtatgccgtcgctgtggccaacgaggaagaagcgggcgcgaggctcggcggtccggtcgtggtcgcgccgccgcgagagcaagaaatcatcgtcgtcgtcgtcgctgggggcgctgtgggcgcggaatgtcagacccaccacggggaccgggaccgggactcggacccgggccggggggaacaaacccggtgctgctctcgcgcgccgcgcgggtgctctcctgcgggcgccgctcctactgatcgatgccatccggcgcggaccggccggcggggcatcaaatcgtccgaatccagatcctgcctgacctgcgcccgtgacttgtctctattcccttcctggggcgggttgttgcccagcccccaaaggggctgtgtttccccggccggggccaaaccggcttggcagctttaaaagcccccgggttgggggcccaaagattcggaatttaacttccccttgggcgggggaggtgttatcaaaaaaaacttcaaaacaaaaccttcccg

SEQ ID NO: 61736 - protein, 101 aa, Zea mays
  misc_feature: Ceres CLONE 1524938
MPSLWPTRKKRARGSAVRSWSRRRESKKSSSSSSLGALWARNVRPTTGTGTGTRTRAGGNKPGAALARRAGALLRAPLLLIDAIRRGPAGGASNRPNPDPA

SEQ ID NO: 61737 - DNA, 751 bp, Zea mays
  misc_feature: Ceres CLONE 1524939
  misc_feature: Encodes the peptide sequence at SEQ ID NO. 61738
  misc_feature (276)..(276): n is a, c, t, g, unknown, or other
  misc_feature (315)..(315): n is a, c, t, g, unknown, or other
  misc_feature (399)..(399): n is a, c, t, g, unknown, or other
  misc_feature (408)..(408): n is a, c, t, g, unknown, or other
  misc_feature (441)..(441): n is a, c, t, g, unknown, or other
  misc_feature (603)..(603): n is a, c, t, g, unknown, or other
  misc_feature (713)..(713): n is a, c, t, g, unknown, or other
gctctagaactagtggatcccccgggctgcaggaattcgtctcacccctagaaaaaacgcggtacgcgcactcagccaaaccatcctcctctccgccgcccgccgcccgccgcagcagcacccaccgggcaagatgaagacgatcctggcgtcggagacgatggacatcccggagggcgtcacggtcacagtggccgcctcgctggtcccggtgaagggcccccgcggcaggctcacccgcaacttcaagcacctcaccctcgacttccatctggngggaggcggcctgtagcttcaggtggattgatggtttgnttcctgctgatcctgggcctccttcggaagcgggatatcccggggtctggattctcttgatggtccccccccatagggaaacgntttacaaanagaaggtcgggctaagaagctttgccccataanccccctcctttcccggattcgagagcgcctttggcggtccaaaaaccccctcccctgagaaccagggcccaaaagggggaacaaggttggccggacgtggggttaccccccgggcacgccacaggcgaggcatggaggtccctcccttgaggggaaacgagngagggaaccggttagatactggctctttgccctcgtcctgctccacattgccctcttggccccaagcgggctgacccctccacttctcctaaaacagactccaatgaggnggccacactcgctggttcttcccccatacgcatcatac

SEQ ID NO: 61738 - protein, 52 aa, Zea mays
  misc_feature: Ceres CLONE 1524939
  misc_feature (48)..(48): Xaa is any aa, unknown, or other
MKTILASETMDIPEGVTVTVAASLVPVKGPRGRLTRNFKHLTLDFHLXGGGL

SEQ ID NO: 61739 - DNA, 667 bp, Zea mays
  misc_feature: Ceres CLONE 1524953
  misc_feature (485)..(485): n is a, c, t, g, unknown, or other
  misc_feature (486)..(486): n is a, c, t, g, unknown, or other
  misc_feature (509)..(509): n is a, c, t, g, unknown, or other
  misc_feature (526)..(526): n is a, c, t, g, unknown, or other
  misc_feature (535)..(535): n is a, c, t, g, unknown, or other
caaagctggagctccccgcggtggcggccgctctagaactagtggatcccccgggctgcaggaattcgtctcacccctagaaaaactccttcgcctggcacatcctcggcagcgtggcagcctgcttcttcaccggcgcggcggcctgcttcttcgacgacgcggaggcctgcagcggcctaccgagcggacggatccgcggacgaacggatctccggcgcctggcagatcttcggcgcgcggcctaccggttgtggacggatctccgctgcctggtgccctggtatatcctcggtgtcgcggcttgcttcttcaccggcgccgcggcctgattcttcgaaggcacagcgacctgattcttcgacggagcggcctgccggttttgtccaggcaggcagacgcggcagcctaccggtcttctccaggcgggtggatctccagcgctcctcgagctagagcaggcaggcgtgccggtcttccccagnncggtggatcttcaccggcgtggncgcctacccgggcgacngatccgcgntcgatctccggctgctccgtgctctgctgctccgtggctgagctccgggcgaccgatccgcggccagggactctgctgctctgctgctccggtctacagggaatcgtgcctctctgctcgaatctgagctcg

SEQ ID NO: 61740 - DNA, 733 bp, Zea mays
  misc_feature: Ceres CLONE 1524954
  misc_feature: Encodes the peptide sequence at SEQ ID NO. 61741
  misc_feature (407)..(407): n is a, c, t, g, unknown, or other
  misc_feature (408)..(408): n is a, c, t, g, unknown, or other
  misc_feature (416)..(416): n is a, c, t, g, unknown, or other
  misc_feature (524)..(524): n is a, c, t, g, unknown, or other
  misc_feature (561)..(561): n is a, c, t, g, unknown, or other
  misc_feature (565)..(565): n is a, c, t, g, unknown, or other
  misc_feature (585)..(585): n is a, c, t, g, unknown, or other
  misc_feature (589)..(589): n is a, c, t, g, unknown, or other
  misc_feature (596)..(596): n is a, c, t, g, unknown, or other
  misc_feature (597)..(597): n is a, c, t, g, unknown, or other
  misc_feature (665)..(665): n is a, c, t, g, unknown, or other
  misc_feature (682)..(682): n is a, c, t, g, unknown, or other
  misc_feature (701)..(701): n is a, c, t, g, unknown, or other
ccccgcggtggcggccgctctagaatagtggatcccccgggctgcaggaattcgtctcacccctagaaaaaatcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgccgtcctcgagtacctggccgccgaggtgctggagctggccnngcacgctngcaagggacacaagaagacccgcatcatcccgcgccacgtgctccttttgcatcgcaacgacgaagaagctcggcagctgctgtccggcgtcaccatcgcccacgggnggcgtcctccccacatcaacccggtgctcctgccaangaangacgctgaagaggcggcggncaangaggccnnagtcgccaagaagggcggcaagtcccccagaaggcatagagggcgcgggcgcccttaccgctgtgatngtgaatgctcgggtcantaaatctttacgtctggangggcctccttgttattggactggttaataaat

SEQ ID NO: 61741 - protein, 171 aa, Zea mays
  misc_feature: Ceres CLONE 1524954
  misc_feature (31)..(104): Pfam Name: Histone Pfam Description: Core histone H2A/H2B/H3/H4
  misc_feature (81)..(81): Xaa is any aa, unknown, or other
  misc_feature (84)..(84): Xaa is any aa, unknown, or other
  misc_feature (120)..(120): Xaa is any aa, unknown, or other
  misc_feature (132)..(132): Xaa is any aa, unknown, or other
  misc_feature (133)..(133): Xaa is any aa, unknown, or other
  misc_feature (140)..(140): Xaa is any aa, unknown, or other
  misc_feature (141)..(141): Xaa is any aa, unknown, or other
  misc_feature (144)..(144): Xaa is any aa, unknown, or other
  misc_feature (167)..(167): Xaa is any aa, unknown, or other
MDASAAGAGGKAKKGAAGRKAGGPRKKSVTRSVKAGLQFPVGRIGRYLKKGRYAQRVGTGAPVYLAAVLEYLAAEVLELAXHAXKGHKKTRIIPRHVLLLHRNDEEARQLLSGVTIAHGXRPPHINPVLLPXXDAEEAAXXEAXVAKKGGKSPRRHRGRGRPYRCDXECSG

SEQ ID NO: 61742 - DNA, 733 bp, Zea mays
  misc_feature: Ceres CLONE 1524959
  misc_feature: Encodes the peptide sequence at SEQ ID NO. 61743
  misc_feature (387)..(387): n is a, c, t, g, unknown, or other
tccccgcggtggcggccgctctagaactagtggatcccccgggctgcaggaattcgtctcacccctagaaaaaatatatgttatctggggacaaggaaagtgctgctatgaatgtggcttcagttgtcggtatccaggcagacaaggttcttgctgaagttaaaccacatgagaaaaagaagttcatatctgaactccagaaagagcacaaggtagtcgccatggttggtgacggcattaatgatgccgcagcactagcttcagctgatgttggaatcgcaatgggtggaggtgttggggcagctagtgatgtatcttcagttgtacttatgggcaacaggttatcccagcttctcgatgctttagagttgagtaaagaaacctgangacggtgaaacaaaatctttggtggggctttctaaattaacattgttggactacccattgctgcctggaacattgctttccgcttcggggaaccatccggacccccttcatagctgggactctgaaggggtttttatccgggcggggggaatggccaacccctttctttttgaaggggaaggtgaaccccaggggggaaacgaaaccccctgaagcgcctcctcttggaggggtgaaaaaaaattccccccccaaagggagaccccggaaaatttggaatttaaacctggtccccccccccctcttttaaagaattgggacccccccctaaggggatgtttctttt

SEQ ID NO: 61743 - protein, 102 aa, Zea mays
  misc_feature: Ceres CLONE 1524959
  misc_feature: SWISSPROT Homolog: EC 3.6.3.4 Copper-exporting ATPase
MLSGDKESAAMNVASVVGIQADKVLAEVKPHEKKKFISELQKEHKVVAMVGDGINDAAALASADVGIAMGGGVGAASDVSSVVLMGNRLSQLLDALELSKET

SEQ ID NO: 61744 - DNA, 528 bp, Zea mays
  misc_feature: Ceres CLONE 1524962
  misc_feature (182)..(182): n is a, c, t, g, unknown, or other
  misc_feature (353)..(353): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (493)..(493): n is a, c, t, g, unknown, or other
gcggtggcggccgctctagactagtggatcccccgggctgcaggattcgtctcacccctagaaaaaagccgcatcccttctttcattcgccgccgccgcctgctctctgctgccgtcgccatgggggagaaggccttgcgagatgctattcgccagattcaagaacaagcccttacccccangttccaaggttattggccgtgggttgtccccttaaccccccagaattttgggggtttttccccatttttttttgctttttaaaaaaaaaaaaaggggggttttttttataaaaattttccccccccccatcttttgtttggggggccccccccctttgttgtccccctttntgtgtgggaaaaaaagggggggggaaaatttttttttttttcccccccgcggggggggggggggttttttttttttgtggggggggcgcgcccccccccccccttttttttttttttttcccccgccccccccnnnacanaaaaaaaattgttttttttttttttttttcccccc

SEQ ID NO: 61745 - DNA, 658 bp, Zea mays
  misc_feature: Ceres CLONE 1524975
  misc_feature: Encodes the peptide sequence at SEQ ID NO. 61746
gctctagaactagtggatcccccgggctgcaggaattcgtctcacccctagaaaaagctagggtttatcctccggtggcgcgcgcgacggcggtttgatggtgcatcgtctgacctaccgcaagcggcacagctatgccacgaagtcgaacctgacgcgggtcgtcaagacccctggtggcaagctcgtgtaccagtacaccaggaagagagccagcgggcccaagtgtcacgtgaccgaggagaaatccagggcgttcctcatctgacgccagctgagtacaagacgtcaggttgtctaggagctgcgaactgtgaaccgtcctatggcggattactatctggacctgcgtagagaacggatctcgagctttctaggtgacagcatactatgtcgaaaagtgttgaacttcttagaccgagacaggactcctgcaatagtactctgagcagtagtgagcttctttcgagcaaggaagactttgtgcgacgttattacacgggcttagctcctcacctgttcaatggtctgggaactggacagaaaattgtttctagggaacttggaatcggcaccaaaaatctaaaattgggggaggctttgccccccattgggtttggtcctttgcaaaaaaaaaaaaaaaaaaaaccccccgggt

SEQ ID NO: 61746 - protein, 56 aa, Zea mays
  misc_feature: Ceres CLONE 1524975
  misc_feature (5)..(57): Pfam Name: Ribosomal_L34e Pfam Description: Ribosomal protein L34e
MVHRLTYRKRHSYATKSNLTRVVKTPGGKLVYQYTRKRASGPKCHVTEEKSRAFLI

SEQ ID NO: 61747 - DNA, 683 bp, Zea mays
  misc_feature: Ceres CLONE 1524977
  misc_feature: Encodes the peptide sequence at SEQ ID NO. 61748
  misc_feature (586)..(586): n is a, c, t, g, unknown, or other
  misc_feature (596)..(596): n is a, c, t, g, unknown, or other
  misc_feature (597)..(597): n is a, c, t, g, unknown, or other
  misc_feature (634)..(634): n is a, c, t, g, unknown, or other
aaagctggagctccccgcggtggcggccgctctagaactagtggatcccccgggctgcaggaattcgtctcacccctagaaaaaaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgaacctttgagtgacatgctacatcngtcagcctgnntcgtttggttttcatccgtacccggcttccactactnctatatgggttttgcctctatggattacagctacaacagtctaaatagc

SEQ ID NO: 61748 - protein, 174 aa, Zea mays
  misc_feature: Ceres CLONE 1524977
  misc_feature (44)..(108): Pfam Name: Glutaredoxin Pfam Description: Glutaredoxin
  misc_feature: SWISSPROT Homolog: EC 1.11.1.15 Peroxiredoxin
  misc_feature (142)..(142): Xaa is any aa, unknown, or other
  misc_feature (145)..(145): Xaa is any aa, unknown, or other
  misc_feature (146)..(146): Xaa is any aa, unknown, or other
  misc_feature (158)..(158): Xaa is any aa, unknown, or other
MVALLGRRIGVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTVDSYESGKLARLLNIGVKDEPLSDMLHXSAXXVWFSSVPGFHYXYMGFASMDYSYNSLNS

SEQ ID NO: 61749 - DNA, 573 bp, Zea mays
  misc_feature: Ceres CLONE 1524978
  misc_feature: Encodes the peptide sequence at SEQ ID NO. 61750
cagagctggagctccccgcggtggcggccgctctagaactagtggatcccccgggctgcaggaattcgtctcacccctagaaaaaaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacactgcaccgcgagttcacgagcgcaggagagcttctcgcagggctactgagccgccggcgccggcatccacgccgttcgtgctgcctgcgtgcctatgtatgtctgtggttgactggttgtgcaggggcatcgtaacttggctaatcgacgtgccaccacttccgctccctgtacgaaattacaaa

SEQ ID NO: 61750 - protein, 137 aa, Zea mays
  misc_feature: Ceres CLONE 1524978
MAYYQEVDYCSEEVRSVAPAGFGRHGGGVQQHVVKEKFEEVDTVSRAGANHHHHHGHHGGHGFVVRETRVEEDINTAPRVHERRRASRRATEPPAPASTPFVLPACLCMSVVDWLCRGIVTWLIDVPPLPLPVRNYK

SEQ ID NO: 61751 - DNA, 774 bp, Zea mays
  misc_feature: Ceres CLONE 1524989
  misc_feature: Translation starting site: 185
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (33)..(33): n is a, c, t, g, unknown, or other
  misc_feature (254)..(254): n is a, c, t, g, unknown, or other
  misc_feature (278)..(278): n is a, c, t, g, unknown, or other
  misc_feature (407)..(407): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (418)..(418): n is a, c, t, g, unknown, or other
  misc_feature (422)..(422): n is a, c, t, g, unknown, or other
  misc_feature (425)..(425): n is a, c, t, g, unknown, or other
  misc_feature (429)..(429): n is a, c, t, g, unknown, or other
  misc_feature (432)..(432): n is a, c, t, g, unknown, or other
  misc_feature (463)..(463): n is a, c, t, g, unknown, or other
nnaatgcnnnncttatattgtattctaagaggnggcggccgctctaaaactagtggatcccccgggctgcaggaattcgtctcacccctagaaaaaaaggcaaacaaaacaagctcaaacaacgtgtcctggggtacacagctatagcttcctcgctccgatcccttgcaacaaatcgaacgccatggctcctcgcgctaaaaactctctagtggcggagggtgacgtgagcgtgcaaaaggtgaaaaaaatcnagcctgtctacgactacaacctantctccagaccctgggtgttctgtatcccaagagtggggaacgggctggaaaggccgcctcttgttgccggggtttctgtcgccacacgccaaaatatttttcccccccccggggggaaagaaagggggnttttcannnantacnccncccnaanaatgaattatttagatctggagttcctctanccccgcgggggggtttagcatatatgggttggcacaagaaaagaatcctctcaggtactccccccccgcacatatcaaaacaagtacccggatcatttccccaactattttccctagtgttgcttcaatcattacgaataaccccattacggaagaggtaaagccccaaattccccctgctctaatgggccaaaaaagcgcacccaaataaaccgcctttttgcgaactacatttttttctaaaaccctggggggtttacccccttgaacggtccctcgaaaaaaatcccccgcaataaaacaaacctctg

SEQ ID NO: 61752 - DNA, 721 bp, Zea mays
  misc_feature: Ceres CLONE 1524998
  misc_feature: Encodes the peptide sequence at SEQ ID NO. 61753
  misc_feature (421)..(421): n is a, c, t, g, unknown, or other
  misc_feature (422)..(422): n is a, c, t, g, unknown, or other
  misc_feature (425)..(425): n is a, c, t, g, unknown, or other
  misc_feature (439)..(439): n is a, c, t, g, unknown, or other
  misc_feature (440)..(440): n is a, c, t, g, unknown, or other
  misc_feature (486)..(486): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (509)..(509): n is a, c, t, g, unknown, or other
  misc_feature (533)..(533): n is a, c, t, g, unknown, or other
  misc_feature (605)..(605): n is a, c, t, g, unknown, or other
cggagctggagctccccgcggtggcggccgctctagaactagtggatcccccgggctgcaggaattcgtctcacccctagaaaaagctattcgccccccaaactccggacgagccttccgcgcgacgctgcacggctccgccagccacccgtaaaaccctagacggctagccggcgcacggaagcgggcagcggagcggaggtgagcctctcctgcatcggattgtccccgcccccgctaggcgccatgaagctgacggtgaagaccctcaagggaacgcacttcgagattcgggtgcagcccaacgacacgattatggctgtgaagaagaatatagaagagatttttgggatagacagttatccttgggggcgacaactgctgattttcggtgtaaaggtgttgttttcccccccccccnntgncacagaataaggtnnatgaggatgggttttttagttgtcttgcgttgtaaggggggggttncnnnacctcttctgtccttcccncttttcccgattatataggaggcnctgccttgaagtatttctaagtttaagcctggttaaatgggacccctttgatttgcggcggcaaaacatttntgcccccatgcttcctgatcttaatccccggtgaggtggaaatctataaaatttacacaaaacaaaattaaaattattggcggcgcgccgccgggcccttctttcgcttccgtata

SEQ ID NO: 61753 - protein, 62 aa, Zea mays
  misc_feature: Ceres CLONE 1524998
  misc_feature (59)..(59): Xaa is any aa, unknown, or other
  misc_feature (60)..(60): Xaa is any aa, unknown, or other
MKLTVKTLKGTHFEIRVQPNDTIMAVKKNIEEIFGIDSYPWGRQLLIFGVKVLFSPPPXXTE

SEQ ID NO: 61754 - DNA, 906 bp, Zea mays
  misc_feature: Ceres CLONE 1525003
  misc_feature: Encodes the peptide sequence at SEQ ID NO. 61755
  misc_feature (1)..(1): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (24)..(24): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (361)..(361): n is a, c, t, g, unknown, or other
  misc_feature (390)..(390): n is a, c, t, g, unknown, or other
  misc_feature (482)..(482): n is a, c, t, g, unknown, or other
  misc_feature (483)..(483): n is a, c, t, g, unknown, or other
ngggggggaccacaaannnncncncnnnnttgtaannnnnnccaaactggaactaaccgcggtggcggccgctctaaaatagtggatcccccgggctgcaggaattcgtctcacccctagaaaaattcccaatctcgtcttgtgttgttcggagcggccatgagtagccagccgcatcagaatcctagtcgatcttcttctcctcctcagggaaaaaaagaagctgaaccatgaggaagagaaaggcatctgctaagccacctcctaagaagcggatggacaatcttgacactgacttttcctgcccattctgcaacaacggggagtagtgttgggtggagaattgaattaaaaaaaattnaaaaaaaaaggaaaattgaaaaaaactgnaacgaaaaacttgctgcccccactgccaaaggcacacggggggggggtaattgattaataaatagaaaagttggccccccctctggggtgtnnaaaaaatgataaacgcattgttaaaaagggggaaagtggaaaggtcctgtcgacattggcccaaaggggcgagcgaaaaatgcattggcatgcgagtgaggagcatggtaacggggagtgggggggctaccagaatgtgagtcagtgctgatcgtaagcagcgcgctctaagtgtgtgagggaaagattgtttgagggtctcaacgagagtaatttggtggtgtatggcagatatctaaatgacaacagtaatgcggggatgctacgccaactggtgctgtgtgcagataagcaagcatcacgtctaggcacgtgataggacacaccagatggggttgtgagacatcaagagcgctctgttggtgtccgtggcgagctacgggcgatcgaagcgaccgtgttgcagcgttgagacacagtatg

SEQ ID NO: 61755 - protein, 32 aa, Zea mays
  misc_feature: Ceres CLONE 1525003
MRKRKASAKPPPKKRMDNLDTDFSCPFCNNGE

SEQ ID NO: 61756 - DNA, 663 bp, Zea mays
  misc_feature: Ceres CLONE 1525009
  misc_feature: Encodes the peptide sequence at SEQ ID NO. 61757
  misc_feature (523)..(523): n is a, c, t, g, unknown, or other
ctggagctccccgcggtggcggccgctctagaactagtggatcccccgggctgcaggaattcgtctcacccctagaaaaagtctccgcccgccacaacaatatcgcattgacagatcgttcatcgtagctgcctccagtcgtctcccgagatcttctccggctataaatttccgccccaattccccaatccagatgcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaangtatgggagaagccatgggagaagttcaaggagctgcaggaattcaaacctgttgaagagggtgctagcgcctaaagatgtctccttctccatgtgcgagcctgaagctcaaagcaaagttgcagaataaagagccatgc

SEQ ID NO: 61757 - protein, 134 aa, Zea mays
  misc_feature: Ceres CLONE 1525009
  misc_feature (41)..(129): Pfam Name: Cystatin Pfam Description: Cystatin domain
  misc_feature (110)..(110): Xaa is any aa, unknown, or other
MRKHRIVSLVSALLILLALAVSSTRNAQEDSMANNTGTLVGGIQDVPGSENDLHLQELARFAVDEHNKKANALLGFEKLVKAKTQVVAGTMYYLTIEVKDGEVKKLYEAXVWEKPWEKFKELQEFKPVEEGASA

SEQ ID NO: 61758 - DNA, 806 bp, Zea mays
  misc_feature: Ceres CLONE 1525016
  misc_feature: Encodes the peptide sequence at SEQ ID NO. 61759
  misc_feature (335)..(335): n is a, c, t, g, unknown, or other
  misc_feature (644)..(644): n is a, c, t, g, unknown, or other
  misc_feature (692)..(692): n is a, c, t, g, unknown, or other
  misc_feature (693)..(693): n is a, c, t, g, unknown, or other
  misc_feature (697)..(697): n is a, c, t, g, unknown, or other
cgcggtggcggccgctctataactagtggatcccccgggctgcaggaattcgtctcacccctagaaaaagggagccacggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaagcgcgtcgctgctcgccgcagcgggcgcggtgaccgcgtcggngggggccgcgctggcgctcgtggacgagcgcttgtcctgggagggacccgggctgagcctccccccccccaaaaaacctggctgggggggaatcccccctggggggtctttcggccctcatctggggcccctcctaccccttctaaccccttttaaacctccaacaaagaacaaagaaaacccgggggggccccccccgcctcaaaatcccaccccccccctcccgggtaaaaggatctgaaaatgagaaaactggggcggggggggcattctcctgaaatattaagcaacaggggttttttttggccncccaaaaaacacaaaccccccccctcagttaaaatatggtttggagannattncgctcgacccgcaaaagaataaaaacaacttttgggaaaacaatcctttttctgcccaaaaaaaaaaaaaaacaaggtcgcccgctgggggacccctattttccccctg

SEQ ID NO: 61759 - protein, 146 aa, Zea mays
  misc_feature: Ceres CLONE 1525016
  misc_feature (1)..(132): Pfam Name: PsbW Pfam Description: Photosystem II reaction centre W protein, PsbW
  misc_feature (67)..(67): Xaa is any aa, unknown, or other
MATVSAAVVTTIVARAAIARPNALGLPALRARSERVRCSYAKDAAPVSTKGASASLLAAAGAVTASXGAALALVDERLSWEGPGLSLPPPKKPGWGGIPPGGSFGPHLGPLLPLLTPFKPPTKNKENPGGPPPPQNPTPPLPGKRI

SEQ ID NO: 61760 - DNA, 674 bp, Zea mays
  misc_feature: Ceres CLONE 1525018
  misc_feature: Encodes the peptide sequence at SEQ ID NO. 61761
  misc_feature (536)..(536): n is a, c, t, g, unknown, or other
aagctggagctccccgcggtggcggccgctctagaactagtggatcccccgggctgcaggaattcgtctcacccctagaaaaaccccaacacaatcctccttccccgatccagtctcgcggtcgcggccacgctgagggacagcgagaagagacagacacagatcgcgcgcggagatgtcgtcggactcgtcgtcgtgggcgcgcgccctggtgcagatctcgccctacaccttctccgcaatcggtatcgccgtctccatcggcgtctccgtcctcggcgcggcatggggtatcttcatcacggggagcagcctcatcggggccgccatcaaggcgcccaggatcacttctaagaacctcatcagtgtcatcttctgtgaggctgtcgcaatttatggcgtaattgtggcaatcatcctccagacaaagcttgaaagtgtgccaacatctcaaatgtatgatccggagtctcttcgagctggctatgcaatctttgcatctggcctttatcgtggctttgctaatcttgtttgcngggtatgcgtggggataattggagcagctgcgcactgtctgatgctcagaactctccatccttccaaagattttgggggattgaaatctttcgagcccctttgggacgtgtcgggtcattttgggcactcttttgtcc

SEQ ID NO: 61761 - protein, 166 aa, Zea mays
  misc_feature: Ceres CLONE 1525018
  misc_feature (20)..(85): Pfam Name: ATP-synt_C Pfam Description: ATP synthase subunit C
  misc_feature: SWISSPROT Homolog: EC 3.6.3.14 H(+)-transporting two-sector ATPase
  misc_feature (121)..(121): Xaa is any aa, unknown, or other
MSSDSSSWARALVQISPYTFSAIGIAVSIGVSVLGAAWGIFITGSSLIGAAIKAPRITSKNLISVIFCEAVAIYGVIVAIILQTKLESVPTSQMYDPESLRAGYAIFASGLYRGFANLVCXVCVGIIGAAAHCLMLRTLHPSKDFGGLKSFEPLWDVSGHFGHSFV

SEQ ID NO: 61762 - DNA, 678 bp, Zea mays
  misc_feature: Ceres CLONE 1525026
  misc_feature: Encodes the peptide sequence at SEQ ID NO. 61763
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
aaagctggagctccccgcggtggcggccgctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgtgtgccatcgtcgcctcaaannnnannnnnnnnnnnnnnnnnnnnnnagnnnnnnnnnnnnnnnnnnnnnnnnnnnnnnnnnntnnnnnnaaaaaaaaccgagccgctcgaggtccccaattcccccaatagggagtcgtataacgcccgctcccg

SEQ ID NO: 61763 - protein, 63 aa, Zea mays; identical to SEQ ID NO: 28299
  misc_feature: Ceres CLONE 1525026

SEQ ID NO: 61764 - DNA, 806 bp, Zea mays
  misc_feature: Ceres CLONE 1525028
agagctggagctccccgcggtggcggccgctctagactagtggatcccccgggctgcaggaattcgtctcacccctagggaggtcaccaaacaagcaagctagctggtcaccagttgttaacatatacatcagcaagctccacgaaagcaagaagaagaagaaacatgacgaccactgctgcggtcgtcaagctcctgacagccgtactcctcttcttcgccgtctctcttcggggaaccagggccagccatgcggcacgtccaagattcagctgcagaccgtctcccactggcgcggacggggcttccggtgacacgctgttcccgcggcctgccaaaaacccggcgctattcgttgtttgtgacttgcgccccggggggggggggattttgggaggggagggtaacccccccacccccccattgttttcagcgaaagcaaggccgctcgtctctacacatcaaccccccatacccccatctccgccccccaccacagtatatattagcccccccccgcccccgcaatgtgggacggtctttcctcccccaaccaccctttacgccctcccaccgaatccccgccctgcacaccgggtctttacccccacgcccgcgttaagtgttattcccccgtgctttgcatcttacctaccttatccgctttatcccccgcacttccaacgtgcgcccgctttctttagcacaccccccggcccccggtcccattcggcggtgagatttatggagaataactacgtgacaccctccccgcccgcctattatttctatagccacaccgcccc

SEQ ID NO: 61765 - DNA, 709 bp, Zea mays
  misc_feature: Ceres CLONE 1525045
  misc_feature: Encodes the peptide sequence at SEQ ID NO. 61766
aaagctggagctccccgcggtggcggccgctctagaactagtggatcccccgggctgcaggaattcgtctcacccctagaaaaaaatatgccccactgaagcccagaagctacctaaacttccagccgtctcctccgcacgcgaaaaccctagcagctccgtagtccctctcctctggaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcggcggcggtgtggctgttgcggcaggtgcacctgctgctggcggagctgctcctgcagctgaggcaaagaaagaagagaaggtggaagagaaaggagaaagcgatgatgatatgggcttcaggcctcttcgactaggttgcacagtcatcacagtattgtttccggcagtggaatcaaaagggaaaccagagtcatgtttagattttaaccttattttatgttggaaagtactgcaaagactgcctaatggcctctggatttgggaaattcagctggaaaattgctttgaggg

SEQ ID NO: 61766 - protein, 165 aa, Zea mays
  misc_feature: Ceres CLONE 1525045
  misc_feature (17)..(108): Pfam Name: Ribosomal_60s Pfam Description: 60s Acidic ribosomal protein
MKVVAAYLLAVLAGNASPSAEDLTGILESVGCEVDNERMELLLSQLSGKDITELIAAGREKFASVPCGGGGVAVAAGAPAAGGAAPAAEAKKEEKVEEKGESDDDMGFRPLRLGCTVITVLFPAVESKGKPESCLDFNLILCWKVLQRLPNGLWIWEIQLENCFE

SEQ ID NO: 61767 - DNA, 631 bp, Zea mays
  misc_feature: Ceres CLONE 1525050
  misc_feature: Encodes the peptide sequence at SEQ ID NO. 61768
gctccccgcggtggcggccgctctagaactagtggatcccccgggctgcaggaattcgtctcacccctagaaaaatactactggattctcacaccgcagcatccgttctcgtgtcttcaccccaagtgatgtctctctccttcctctctgctacggctgggtgaggcgagaggctactgcagccgcctaacgccaggttccgaggccttcatcggtctatgtgccggcgatgaacatccaccacggatggttgcaacaattggggcatagcgttggcatcggtggttcaaagatcgttctccatatgacccacaatgtattcagttgtcgatgctttgctgccaatgggcgtgacttcagtgcacattctaccaacaagagaaaacttacagctagaagagacgaaaggatgttgcactgcaatcaagtgaggcaatatctggaaactctaggactgggaccaatgggtgccagaacttaagaactgaaagtgaatacgaatctggtaaaaaagtcatgcataagaaattctttggaaaaagtggaagccggtccgaaggtctgcccttgagaaaaaaaaaaaataacacgagacgctcgaggtacccaattcgccctatagtgatgcctt

SEQ ID NO: 61768 - protein, 83 aa, Zea mays
  misc_feature: Ceres CLONE 1525050
MNIHHGWLQQLGHSVGIGGSKIVLHMTHNVFSCRCFAANGRDFSAHSTNKRKLTARRDERMLHCNQVRQYLETLGLGPMGART

SEQ ID NO: 61769 - DNA, 697 bp, Zea mays
  misc_feature: Ceres CLONE 1525054
  misc_feature: Translation starting site: 171
  misc_feature: Pfam Name: Bac_globin Pfam Description: Bacterial-like globin
  misc_feature (521)..(521): n is a, c, t, g, unknown, or other
  misc_feature (522)..(522): n is a, c, t, g, unknown, or other
gctctagaactagtggatcccccgggctgcaggaattcgtctcacccctagaaaaaacggcgcacacatatcccttccttcactgcggtcccggcaaaagtcagtcaactcatccaacaagcgctgctgctcgggcacgggtggtttgggaggccggacgcaacgtcgggatgcattcgctgcacgacaaggcgtcggaatggagcggggtggcggccgccgatgcctttgccatcgacgacgtcaacatattcgagtccctcggcggcactccgcagccattcgtcgacctctccaccaatttctacaccagggtttatgaggactaggaggagtggtttcgggagatattcggggggtccaagaatgaggatgccatccagaaccagtatgagttcctgatccagcgcatgggcggcccgcctctattctcccagagagaggacaccctgcccttatatgacgacatcgaccattcttgggtacccaccgagctgcagagcggtggttacaccacatgnncacagctttggacgcaactgacagcatatatgtggactcaaaaacgaggatgatgaacttctttaggcacactgcttacttccttttgtgctgcaatgagatgacagggcacagggccatggagtagcctgcaacatgcaacaagtaaaccagctgagtaccctttttagcgtga

SEQ ID NO: 61770 - DNA, 648 bp, Zea mays
  misc_feature: Ceres CLONE 1525055
  misc_feature: Encodes the peptide sequence at SEQ ID NO. 61771
  misc_feature (470)..(470): n is a, c, t, g, unknown, or other
ggagctccccgcggtggcggccgctctagaactagtggatcccccgggctgcaggaattcgtctcacccctagaaaaattcctaagattggagggaagctttgctcaccttcttctgttcctgaagtcaagttatctcagtgcatttcagcattggggaatcgtgaaacattgatagtgctacaacaggcctcttgtattttgaaatcccttaagattgataggctctcaagaatgactccgttctatgacttctctgtcctggagaagatctctgttcatgctgccaaagaaaattttgttggtataagagttgaccatttatcgagagttgccctgtttggtgctgtggatcctaaaccctgaccgcccaagtgaataccttccttgttcttgctgattcaaccacccccccaaagattcatatcttgtcctccactgaataaggacttttaaaacccggagaatgtnccacctagtctgggggcattttggggaaaattgaacatttgaaggctgccttgggagggaaatccctccttctaaaatcgggttaaaaaagctttgagcgggaaattttgtggaggagggtacattgaggaagaacaaacacgagatcgggcccccccctaataaatcctcgtggaaa

SEQ ID NO: 61771 - protein, 43 aa, Zea mays
  misc_feature: Ceres CLONE 1525055
MTPFYDFSVLEKISVHAAKENFVGIRVDHLSRVALFGAVDPKP

SEQ ID NO: 61772 - DNA, 537 bp, Zea mays
  misc_feature: Ceres CLONE 1525056
  misc_feature: Encodes the peptide sequence at SEQ ID NO. 61773
  misc_feature (354)..(354): n is a, c, t, g, unknown, or other
acttctggagctccccgcggtggcggccgctctagaactagtggatcccccgggctgcaggaattcgtctcacccctagaaaaagcacctatgacctgttgcatcttgatggcctgttcacagcagagtctcacaggtgcgagatgaagtacgtgctccttgagatggaccgtatccttcgtcccacgggctacgccataatccgggagagcacctacttcctcgattctgtggcaccccttgccaaagggatgcgatggagctgccgagaaccacagcagcgagaacaaggcccacaaggaaccagaccccccccctgcccaaaaaaagcctttggccaagaaaaacaggggncgaaagaagaatctccctcctccctccagaggtaaaaaagagagccccccaatccgttccccccccgggccctcattccgcccaaaagggaaaaggggccccctcccccccccgggaaaaaaacaccccccccccctcccttaataaaagagggggcccccgcccttctccccacaaaaaaca

SEQ ID NO: 61773 - protein, 81 aa, Zea mays
  misc_feature: Ceres CLONE 1525056
  misc_feature (71)..(71): Xaa is any aa, unknown, or other
MKYVLLEMDRILRPTGYAIIRESTYFLDSVAPLAKGMRWSCREPQQREQGPQGTRPPPCPKKAFGQEKQGXKEESPSSLQR

SEQ ID NO: 61774 - DNA, 688 bp, Zea mays
  misc_feature: Ceres CLONE 1525059
  misc_feature: Encodes the peptide sequence at SEQ ID NO. 61775
aaagctggagctccccgcggtggcggccgctctagactagtggatcccccgggctgcaggaattcgtctcacccctagaaaaagcccgcgcgcgcttccaacaatcacacaccaggccaccaccaccaccaagcagggtccagactccagagacaatccagccatgccgcctccgtccaccgccgcggcagtctcctccattatccgcccgacgccgcctccggccgtatccttccaccccgtacccctcccgcagatcaggcggcgctcatcagctggcgccgcagccgcttcccggctcgccgtggcgcgcgccgccgcctcgggggcgcgcggcggcggcaacgccgagacggagttcttcgacggcggcgcgcactacggcgacctgacggctaacctgctcctgggctgaccctgctgtggctgccgctgacctggctgccgtgtcccgcgcgttcatcctgcggtacggctcacctcccggcgcgtgacgggtgtctcggggctctcggggtccaaccggacgacttcccctaattgtcattaagtcccggggggtcctccccccgttcttgggccaggggggccacttcgccttccccttcgggacggtcccaaggtggcctccggggggtggcccgttttccggaggggcccgaattatggccgttcctgggccgccggg

SEQ ID NO: 61775 - protein, 83 aa, Zea mays
  misc_feature: Ceres CLONE 1525059
MPPPSTAAAVSSIIRPTPPPAVSFHPVPLPQIRRRSSAGAAAASRLAVARAAASGARGGGNAETEFFDGGAHYGDLTANLLLG

SEQ ID NO: 61776 - DNA, 847 bp, Zea mays
  misc_feature: Ceres CLONE 1525060
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (395)..(395): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (415)..(415): n is a, c, t, g, unknown, or other
  misc_feature (445)..(445): n is a, c, t, g, unknown, or other
  misc_feature (448)..(448): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
ttatattctnnnnnnnnnnnnnngnnnnnnnnnnnggacctnnnncaccccacccccctctanntnnnnntgccgctctccatctactggatcccccgggctgcaggaattcctctcacccctagaaaaaaattgcgattgcgagtcctccaaaccatggggctcgccctggcctctccaatggcgtctctctccttccacttttggaggatggggggggggtctatcggaggcgtctgcccgccctcccacgccggccccgctgggctaatcccccccccccgttcctcccaatttccttccgtcctggccccccccgcgtggctctctttttcccccccggggaggggggtttttctgtggcatttttttttaaaaaaaaaaaaaaaaaaaanannnnnatttttttctcctncccatcccgagggaaaagaaaaggggattnttntccctcannncccccccccccccccctcggtttaacaaaaccccccccccgggtggggtgggggggggagcgtccaaccccttttgaccttttatttgagtgagtatttatacatatatcgttcttttagtcgttttccacttcaggtgcctcgtttcctctcgccccacatcttctttgtcctcttgtgtccctccgtctttatgcgcttccgtttaccactttttatatctctgtggctcttgcatcctcgtctagctgctcggcaagtcaccccgtcttcacgccacgtcacctaccctcttttcaccaccgggggccaactccctgcacttcgcctctcgcgttcccatgtctccccctcctctccgcttgttgctccctctaccgcctccccgc

SEQ ID NO: 61777 - DNA, 701 bp, Zea mays
  misc_feature: Ceres CLONE 1525063
  misc_feature: Encodes the peptide sequence at SEQ ID NO. 61778
  misc_feature (560)..(560): n is a, c, t, g, unknown, or other
  misc_feature (571)..(571): n is a, c, t, g, unknown, or other
  misc_feature (580)..(580): n is a, c, t, g, unknown, or other
  misc_feature (622)..(622): n is a, c, t, g, unknown, or other
  misc_feature (623)..(623): n is a, c, t, g, unknown, or other
gcggtggcggccgctctagaactagtggatcccccgggctgcaggaattcgtctcacccctagaaaaagcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtatgggagaagccatgggagaagttcaaggagctgcaggaattcaaacctgttgaagaaggtgctagcgcctaaggatgtctccttctccatgtgcgagcctgaagctcaaagcaaagttgcagaataaggagccatgctcccttgtgtaatttcataagactancaccctattanggcttgttnggttgtgtctgtatcgaaggaatttgaggggattaatttccnntctatcaaaaaaagggtttaaatctcctccataccttcaatccaaactaaccgaacagcctttaaaagaaatcttact

SEQ ID NO: 61778 - protein, 103 aa, Zea mays; identical to SEQ ID NO: 59401
  misc_feature: Ceres CLONE 1525063
  misc_feature (10)..(98): Pfam Name: Cystatin Pfam Description: Cystatin domain

SEQ ID NO: 61779 - DNA, 673 bp, Zea mays
  misc_feature: Ceres CLONE 1525064
  misc_feature: Encodes the peptide sequence at SEQ ID NO. 61780
tagagctggagctccccgcggtggcggccgctctagaactagtggatcccccgggctgcaggaattcgtctcacccctagaaaaaatcgcgataggcccgttcgcacgaatcactgctctgctttcaccccccgcatcgaacctcacccccgatctgatcgaatcgaaggctgcggcggcgatgggcggtgaccatggcggtgggcacgccggcggcgacttccgccagaaggtatggagcatgacgggcggcccgtactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactgaaggaccctctcactagcatgaagtgcgggcaccttgcttttgccttctttttgtggaaacctgtgcctagccataatgctgggttaagtgttaggagcatctctggaatgcttcgcgtagtatctttggattcttcttttcttcgggtacaattgaaatgcctgatgaactcaaataatgaccgtggaacaaaagctgggatggatttcctcgaggggtttgatcatggattggaaacctggc

SEQ ID NO: 61780 - protein, 82 aa, Zea mays
  misc_feature: Ceres CLONE 1525064
MGGDHGGGHAGGDFRQKVWSMTGGPYCRPVHWRRNTAIAMFGVFLICIPIAMKSAELEQRPHHPVRPIPSQLWCKNFGKKEY

SEQ ID NO: 61781 - DNA, 634 bp, Zea mays
  misc_feature: Ceres CLONE 1525068
  misc_feature: Encodes the peptide sequence at SEQ ID NO. 61782
tggagctccccgcggtggcggccgctctagaactagtggatcccccgggctgcaggaattcgtctcacccctagaaaaagctctttactcttcgtcgtactcgtctcctcccacccgcaaccgcagggagagaaaggggaagcccgccgccgccccggcccccagcaaccagcagatcgggacctctgttctgcgcaatccatccatggcggaggaatcaggccgtcccttgccaaagtttggtgaatgggatgtcaacgatccggcttccgcagacggatttactgtcatattcaacaaagccagagatgagaagaagggtgggaatggtcaagacacagactcaccttccaaggaccccaggactgagagggtggagtcttatgctgcaaaaccaagcacccaccaaatggtttttgttgtgtggacagccagcccctacgccaattcctgaaggaaaggcaatttgcatgccgctgggaaatacctggcccccttttaatttttccaaaccataccttattccttaaaaaaccccttgtaaaaggggacccccctgggggctctcttgggggcccccccagagaggggggggttttcctaaaaaaaaaacattttgggggcgggggggtgg

SEQ ID NO: 61782 - protein, 82 aa, Zea mays
  misc_feature: Ceres CLONE 1525068
  misc_feature (1)..(73): Pfam Name: NOI Pfam Description: Nitrate-induced NOI protein
MAEESGRPLPKFGEWDVNDPASADGFTVIFNKARDEKKGGNGQDTDSPSKDPRTERVESYAAKPSTHQMVFVVWTASPYANS

SEQ ID NO: 61783 - DNA, 667 bp, Zea mays
  misc_feature: Ceres CLONE 1525070
  misc_feature: Encodes the peptide sequence at SEQ ID NO. 61784
  misc_feature (416)..(416): n is a, c, t, g, unknown, or other
  misc_feature (646)..(646): n is a, c, t, g, unknown, or other
  misc_feature (651)..(651): n is a, c, t, g, unknown, or other
  misc_feature (652)..(652): n is a, c, t, g, unknown, or other
acagctggagctccccgcggtggcggccgctctagaactagtggatcccccgggctgcaggaattcgtctcacccctagaaaaaagcagcagcacagtcatccacactaacgaacgaactgaggtcgacgacgactgatcgagcagcgacgatggcggctgtgctgaacagcaggaagacgccgcaggtggttgccgtgctggtggcggcggcgctgctggcgtcgtccgcttcggcggcgatcacctgcgggcaggtggggtcgtcgctggctccgtgcatcccgtacgcgacggggagggccagcgcgctccccgcgtcgtgctgcaacggcgtcaagagcctcaacagcgcggcgcggaccagcgcggaccgccagggggggtgccgctgcctcaagagcctcgccaacaccntcaagagcgtcaacatgggcaccgtcgccaccatccccgggaagggcggcgtctccgccggattccccctccgcatgtcccccgatttgcaacaagatcccctaagtttaccgacgaccaagcttataagccctcccgaccgtccccgtcgtcccccgcgcctgcaaaaaggatggaagcccggggaaaaaataaaattaagcgctgccttacttggccagagaccagcntgccnnttctccgtcttgaag

SEQ ID NO: 61784 - protein, 172 aa, Zea mays
  misc_feature: Ceres CLONE 1525070
  misc_feature (33)..(120): Pfam Name: Tryp_alpha_amyl Pfam Description: Protease inhibitor/seed storage/LTP family
  misc_feature (89)..(89): Xaa is any aa, unknown, or other
  misc_feature (167)..(167): Xaa is any aa, unknown, or other
MAAVLNSRKTPQVVAVLVAAALLASSASAAITCGQVGSSLAPCIPYATGRASALPASCCNGVKSLNSAARTSADRQGGCRCLKSLANTXKSVNMGTVATIPGKGGVSAGFPLRMSPDLQQDPLSLPTTKLISPPDRPRRPPRLQKGWKPGEKIKLSAALLGQRPACXFSVLK

SEQ ID NO: 61785 - DNA, 743 bp, Zea mays
  misc_feature: Ceres CLONE 1525087
  misc_feature (379)..(379): n is a, c, t, g, unknown, or other
ctccccgcggtggcggccgctctagaactagtggatcccccgggctgcaggaattcgtctcacccctagaaaaagtgctctctcagaggtgggctggcttctcctccccctcttacaaagtcctcttcgggttagggttacttagggttttgtggaggggcgatggcggcggctgatgtggagtaccgttgcttcgtcggcgggcttgcctaggccaccagcaacgagtcgctggagaatgccttcgcctcctacggcgagatccctcgactccaaggtcatcaccgaccgggagaccgggaaaggtctccgcggctttcgctttcggtacctttctcctcccaaaaactccatggctcgacgcctatccaagaacacncaaccggcataagaactccgacgggccgtaaaccatccacccccttaacccaagcccccaattcccagtgggaggtaggaccattggctccgcccggtggccttacaggagagccatgtcccccgcccaccacaactcccttattatctgaccaaacccccccctctaaaccccccctttttgggccccccgatctggccgctctcacggatgtttccccgccccaagaagtgtggctggactcatcttctcttccgcgaaggccctggggcgggcgatacaccgcagaaccacgccgcgacggtgcgtgccccacagttcccatacaacccggctgcttccattattgggcggcgctgaacat

SEQ ID NO: 61786 - DNA, 692 bp, Zea mays
  misc_feature: Ceres CLONE 1525093
  misc_feature: Encodes the peptide sequence at SEQ ID NO. 61787
aagctggagctccccgcggtggcggccgctctagaactagtggatcccccgggctgcaggaattcgtctcacccctagaaaaagctcctgccatcagaatcggaccaccacacgcccgaggcccgactgcaagcgcctgagcccaagacccatggccatggccgccgccaccgtcgcagcgtctctgcccgtggcgcaggggctcgggaagcccctctgcgccggaagcaacgcgccgtcgctccgggccgtcgcgggcgcgccccgtcgtcggtcggccaggaccaggatggccgtcgtccgggcgtccgcgcaaaagcagcacccggccaaggagtgggcggccgcggctgccgtggcggcggcgctggtgcttccggaggtcgcggaggccgcgccggggatctccccgtcgctcaagaacttcctcctcagcatcgtctccggtggggtcgtgctcgtcgccatcgtcggcgccgtcgtcgccgtctctaacttcgatcccgtcaggcggggttgagctgcatgcgtcgttgtgtgttgttgtacctatgtactgagatctctctccccgtgtgcttcccaatgaaaacagtgtttaatgcgtgaatgtgtaaatttcatttcatgccatctgtatgtatgtatgagacggatttcacagcgcattcgggtttcttatgttgtggact

SEQ ID NO: 61787 - protein, 122 aa, Zea mays
  misc_feature: Ceres CLONE 1525093
  misc_feature (85)..(122): Pfam Name: PsbX Pfam Description: Photosystem II reaction centre X protein (PsbX)
MAMAAATVAASLPVAQGLGKPLCAGSNAPSLRAVAGAPRRRSARTRMAVVRASAQKQHPAKEWAAAAAVAAALVLPEVAEAAPGISPSLKNFLLSIVSGGVVLVAIVGAVVAVSNFDPVRRG

SEQ ID NO: 61788 - DNA, 613 bp, Zea mays
  misc_feature: Ceres CLONE 1525108
  misc_feature: Encodes the peptide sequence at SEQ ID NO. 61789
ctccccgcggtggcggccgctctagaactagtggatcccccgggctgcaggaattcgtctcacccctagaaaaaaccgactcgatacagcaagagcgacagagagagagagagagagaccgacgcgccggcagatcccaagttcaccggagagggggaagagggcgaccgaaggcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgcccgccgtcgggacccctacgacgacctcatcgcccgccactctggctcgccgccgtcttcctgaacacccgttccgatctttgcccagaaggtctacttgggcatcaataaaaaactctttccccctcaactgattgtggttccatcctcttctgtccgggaaatgttgtcaccaaacttacctattttccttttccagtttggcatggaaatata

SEQ ID NO: 61789 - protein, 93 aa, Zea mays
  misc_feature: Ceres CLONE 1525108
MGFIMDFAENLILRLMEDPDKRDQVRREHVYKMKERCERTKAAWSLPLRPYGFWTFDRFNSQLSWDPQISQAARRRDPYDDLIARHSGSPPSS

SEQ ID NO: 61790 - DNA, 660 bp, Zea mays
  misc_feature: Ceres CLONE 1525111
  misc_feature: Encodes the peptide sequence at SEQ ID NO. 61791
atagctggagctccccgcggtggcggccgctctagaactagtggatcccccgggctgcaggaattcgtctcacccctagaaaaagcctctccaattagacgcgagccacccaccgcgcgacctcagggtgcctgtgcctgctctcgctgttccttcctcatggccaccgcctgccacctcgccgcgccgctcggcctcgccccgttgccccgcggctgcgcctctgctggcgtcgtggccgtcgtccggtgcgctcggtcgtcaggctccaagatcccgagaggcgttgctgtcagggcgacgtccggcggctagggcgcccccggaggacgtgccggaaaattgtgaaggctgcccaagacccgtgggaacaaagttgaggacaattacgccttggccaccattcggtgtcgctgcccacctccccgccctgaacgggtacaaggggccatccaaggccatcaaaaagccttccccttcctaccctggggccccttgagaatgtttggaaattgggtattacaggggtggttccacaaccccttaacctccttctttccatcccagaaatggatggcctctgaatacagtaaatttccaggagccccttcccaaggaaaacccgccggggtgccgcccacccgaccccaacacatcctt

SEQ ID NO: 61791 - protein, 51 aa, Zea mays
  misc_feature: Ceres CLONE 1525111
MATACHLAAPLGLAPLPRGCASAGVVAVVRCARSSGSKIPRGVAVRATSGG

SEQ ID NO: 61792 - DNA, 852 bp, Zea mays
  misc_feature: Ceres CLONE 1525114
  misc_feature (27)..(27): n is a, c, t, g, unknown, or other
tcaaaaagaatatagaagggaaggagnggccccacaagaagaggggggggttttttgttcaaagctgggagctccccgcggtggcggccgctctagaactagtggatcccccgggctgcaggaattcgtctcacccctagaaaaagagatctgggggagctcccattctctagatgcacgacttctgcttcaccatcccctacgggttcgccgtgctggccggcggtgtgccgggctacctccgcgcggaacactcctgccttccctgggcgggggggcgccgtgtacttgtgggtgctgcttgcttcctcatagcgtttccggccacccctaaaacggcctcgacgcagtaagaggaaagaattggagccaaaaagtaagagccggaaaagtctcttttaacatacccccccccttttccattttatttgtgtttgactcccccgcctactctatctctatttacatttccccacaccgcttttattttttcttttaccctccactccccccccgcctacacaagtatgtggatccccgtgtttcagatgttcttaattttttttgaccccacgtggtgtgcggctgagccgcgggcgtaggtggaggcataaagtagtcgaaataatcagcctacctatacacatagtcaatgatgttaggtggtgtcgtgcgcactttcgttccaatcgggtggtaacacgtgcacaactccaccttgcttcataggcccgattgtttgtttgttgcgcttttcacctatgccccgacggcgaccgtgtggctagtcaagcacctattatatggattaaacagtatctacaatgtaccacgcgatacaccaatgtgtat

SEQ ID NO: 61793 - DNA, 634 bp, Zea mays
  misc_feature: Ceres CLONE 1525117
  misc_feature: Encodes the peptide sequence at SEQ ID NO. 61794
aagctggagctccccgcggtggcggccgctctagaactagtggatcccccgggctgcaggaattcgtctcacccctagaaaaaaactctcccgcgacccgtaccccgcctcccggttcagtcgcacttcctccggcggcggcaactcgacagacaaccgcgccaccctggcgcggaaaccatggtgcatgttaacttctaccgaaactatgggaagactttcaaaaagccaaggcggccgtatgagaaggagcgcctagatgctgagctgaagctggttggtgagtatggcctgcggtgcaagcgtgaactgtggcgcgtgcagtatgccctgagccgtatcaggaatgcagccagggagttgctcaccctggatgagaagaacccacgccgtatctttgagggcaaagcactcctccgtcgcatgaacagatatggccttcttggcgagggacagaaaaagcttgattacgtgcttgccctcactgttgataacttcctccagcgccgcctccaaaccatcgtcctcaataatggcatgggaaagtccatccaccatggttcttgtcctgatcatgcaacgccccatcagagttgggaaaggaactcgtcaaaattcccctccttcctggtag

SEQ ID NO: 61794 - protein, 151 aa, Zea mays
  misc_feature: Ceres CLONE 1525117
  misc_feature (7)..(108): Pfam Name: Ribosomal_S4 Pfam Description: Ribosomal protein S4/S9 N-terminal domain
MVHVNFYRNYGKTFKKPRRPYEKERLDAELKLVGEYGLRCKRELWRVQYALSRIRNAARELLTLDEKNPRRIFEGKALLRRMNRYGLLGEGQKKLDYVLALTVDNFLQRRLQTIVLNNGMGKSIHHGSCPDHATPHQSWERNSSKFPSFLV

SEQ ID NO: 61795 - DNA, 646 bp, Zea mays
  misc_feature: Ceres CLONE 1525119
  misc_feature: Encodes the peptide sequence at SEQ ID NO. 61796
  misc_feature (44)..(44): n is a, c, t, g, unknown, or other
  misc_feature (292)..(292): n is a, c, t, g, unknown, or other
  misc_feature (301)..(301): n is a, c, t, g, unknown, or other
  misc_feature (316)..(316): n is a, c, t, g, unknown, or other
  misc_feature (319)..(319): n is a, c, t, g, unknown, or other
  misc_feature (324)..(324): n is a, c, t, g, unknown, or other
  misc_feature (349)..(349): n is a, c, t, g, unknown, or other
  misc_feature (363)..(363): n is a, c, t, g, unknown, or other
  misc_feature (365)..(365): n is a, c, t, g, unknown, or other
  misc_feature (366)..(366): n is a, c, t, g, unknown, or other
  misc_feature (440)..(440): n is a, c, t, g, unknown, or other
  misc_feature (472)..(472): n is a, c, t, g, unknown, or other
  misc_feature (487)..(487): n is a, c, t, g, unknown, or other
  misc_feature (542)..(542): n is a, c, t, g, unknown, or other
  misc_feature (556)..(556): n is a, c, t, g, unknown, or other
ctccccgcggtggcggccgctctagaactagtggatccccgagnctgcaggaattcgtctcacccctagaaaaaatcttatcccaaacacaacccacactactaccctacccgtccgcctctctcgaaagcgcagcaccagcgagcatgtcgcctgtcaccgcactcctggcgggcacggtggtgccgccggcctcggccccgtcgccagcgaggcacgcccgccattactccgtcggcttctccccgctccacggcggggggcgcgcggggctgggggtggagtgctcgtngtggccgcnaacgaaggggaccangcnccacntgaagacgcgggcccagaagacgcngccgggggacatcnanngcccaccccacgatgtacccggcgctgccgccgctccccccagacctggacgctcgtcaccttctgcgcccctngtggacgtgcgaggaacagaagacccccagcnccccccccccacctntcgtccctcaacacggtccgccaccaccaaactaaaggaccccaacaccgtgtantccaaatacggtcncctgtaacctcccacctacacaccgactttcccgacagacacccccccatcctaaccaacgaccccccccgcccacccccgatctataac

SEQ ID NO: 61796 - protein, 138 aa, Zea mays
  misc_feature: Ceres CLONE 1525119
  misc_feature (49)..(49): Xaa is any aa, unknown, or other
  misc_feature (52)..(52): Xaa is any aa, unknown, or other
  misc_feature (57)..(57): Xaa is any aa, unknown, or other
  misc_feature (58)..(58): Xaa is any aa, unknown, or other
  misc_feature (60)..(60): Xaa is any aa, unknown, or other
  misc_feature (68)..(68): Xaa is any aa, unknown, or other
  misc_feature (73)..(73): Xaa is any aa, unknown, or other
  misc_feature (74)..(74): Xaa is any aa, unknown, or other
  misc_feature (109)..(109): Xaa is any aa, unknown, or other
  misc_feature (114)..(114): Xaa is any aa, unknown, or other
  misc_feature (132)..(132): Xaa is any aa, unknown, or other
  misc_feature (137)..(137): Xaa is any aa, unknown, or other
MSPVTALLAGTVVPPASAPSPARHARHYSVGFSPLHGGGRAGLGVECSXWPXTKGTXXHXKTRAQKTXPGDIXXPPHDVPGAAAAPPRPGRSSPSAPLVDVRGTEDPQXPPPTXRPSTRSATTKLKDPNTVXSKYGXL

SEQ ID NO: 61797 - DNA, 678 bp, Zea mays
  misc_feature: Ceres CLONE 1525124
  misc_feature: Encodes the peptide sequence at SEQ ID NO. 61798
  misc_feature (574)..(574): n is a, c, t, g, unknown, or other
  misc_feature (603)..(603): n is a, c, t, g, unknown, or other
tggagctccccgcggtggcggccgctctagaactagtggatcccccgggctgcaggaattcgtctcacccctagaaaaaaccaagaacaaaccattgttggacgcgttcccctcctgcacgcaacctcatctcgtcctccagatcctggatggccgtcctccttgataccttgcctcgcgagtgctctcggtgagctactttgtttgatttatcaggaaatccgtttgcttcatgttatgcaggctcagatctgattgctggattcggcatcttacgggcttgattagagctaggactggaagaaaacaacaaacccgcgttggatcctgtatcggttagtccttgccttcaaggttcatgttgttttggttttgggggtcgagcatcgcatgttctgcttctgccccccaaatctggaaaaatttcaaagtcgtcttcctccctcctccttcgtttcccgaacgaatctgaaggcaaccaatggctcgaaggcggccgggaatctccttgggcttgaactcccggctttcccctcccagggaatgaattgcccccgcaccgaatcaattcatngggaccaattgccgaaaaatttattatcnaaagacctttgaacaaattgccccgccccgcgaaaaagggcaagcgtaaccccgccaagcattttaaacagcgcg

SEQ ID NO: 61798 - protein, 35 aa, Zea mays
  misc_feature: Ceres CLONE 1525124
MLCRLRSDCWIRHLTGLIRARTGRKQQTRVGSCIG

SEQ ID NO: 61799 - DNA, 830 bp, Zea mays
  misc_feature: Ceres CLONE 1525132
  misc_feature: Encodes the peptide sequence at SEQ ID NO. 61800
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (41)..(41): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (509)..(509): n is a, c, t, g, unknown, or other
  misc_feature (517)..(517): n is a, c, t, g, unknown, or other
  misc_feature (581)..(581): n is a, c, t, g, unknown, or other
nnnnnnggggggcgccgaannntccntccctccctctattnttnnnntnggggnnnnnnnaaatactgggactcaccgcggtggcggccgctctttaatagtggatcccccgggctgcaggaattcgtctcaccccctagaaaaaagcaggcctcccgaatccccaaagcctccgacccccttcctctctccctccgccggcgctgcgcacgcagggaacatgcgacatgggcgtctacaccttcgtgtgccgcaacaacgggggcgaggggaccggccagcagcactccggcgagatcgaggcttccgccgctaccgcatacgagctggggggccgtttgtttgtttggggcgtcgggggaaaattaagaactacgtcttcttttttttccttggggtgtggtggggtttggtgttgctgtcttcgttctcccccccccccccgccgggggggcggggggggaggtttggtgtttgtggtgtgtgtttggtgaccccccccccccccncccggtgntgtgtggtgtttgtagcgtgggggggttgggtgtgtgggggtgatgcgggcgggcgcggtgcgntatgtgaggtggtcttggggagggtgcgtctctgtgagaccttctcggccgagcgaggggggacggtgggtggggggcgacggactctatgagcgtcggtggggctagggagaagtgtcgacgcctgtcgccagagatggctattttcctggtctcccttgccaccgtctgctgcgcgccgacctggtgtcgcgtcccgtcgccttccgtgcccctcggccaggacacgcacagacaggcgccggccgg

SEQ ID NO: 61800 - protein, 88 aa, Zea mays
  misc_feature: Ceres CLONE 1525132
MGVYTFVCRNNGGEGTGQQHSGEIEASAATAYELGGRLFVWGVGGKLRTTSSFFSLGCGGVWCCCLRSPPPPRRGGGGGGLVFVVCVW

SEQ ID NO: 61801 - DNA, 642 bp, Zea mays
  misc_feature: Ceres CLONE 1525135
  misc_feature: Encodes the peptide sequence at SEQ ID NO. 61802
  misc_feature (322)..(322): n is a, c, t, g, unknown, or other
atagctggagctccccgcggtggcggccgctctagaactagtggatcccccgggctgcaggaattcgtctcacccctagaaaaaagcacatgtgcatctcagcagcactagcagtgacaaactcgaagcttgccttcttgtttacaccctaaaactaaaactagagtcgtcggcggcaacaagcggtacgtacgtagaggatgaagagcaggagcagcactctgttggtgatcctagttctccaggcccttctgctctctgcggctgtggccaaaggacctgcagggccgaagaagcagtgctggtgcggcgagtgcaccanctggtcgggcgtgtggacctgcgacgacctcctcaccaagtgcgccgccacctgcaagaactgcgtccccgtgtccacgggcaaagcccccaccaagtacaggtgcccgcaacttcctcccccgataactgcgggtgcaagatccactaaactcattcaattccaccatgggcccagcagccgaaggatcccttcttccaaatgcatgttcctccctccgcccgtccggcctagcttggctacaagaaggcgctaaataagcaagccggcctgttgttggtttggcctggttggaattaagggaaccccttccccctcca

SEQ ID NO: 61802 - protein, 125 aa, Zea mays
  misc_feature: Ceres CLONE 1525135
  misc_feature (41)..(41): Xaa is any aa, unknown, or other
MKSRSSTLLVILVLQALLLSAAVAKGPAGPKKQCWCGECTXWSGVWTCDDLLTKCAATCKNCVPVSTGKAPTKYRCPQLPPPITAGARSTKLIQFHHGPSSRRIPSSKCMFLPPPVRPSLATRRR

SEQ ID NO: 61803 - DNA, 629 bp, Zea mays
  misc_feature: Ceres CLONE 1525145
  misc_feature: Encodes the peptide sequence at SEQ ID NO. 61804
  misc_feature (372)..(372): n is a, c, t, g, unknown, or other
  misc_feature (453)..(453): n is a, c, t, g, unknown, or other
  misc_feature (464)..(464): n is a, c, t, g, unknown, or other
ctggagctccccgcggtggcggccgctctagaactagtggatcccccgggctgcaggaattcgtctcacccctagaaaaagttgcagcctctctacctctacctactggagtagggagcacgccgcacgagccctttccgccgccgccaaaatggtgaacgttcctaagaccaagaagacctactgcaagaacaaggagtgcaagaagcacactctccacaaggttactcagtacaagaagggtaaggatagcctgtctgcccagggaaagcgccgttatgaccgcaagcagtcaggatatggtggccagaccaagcctgtcttccacaagaaggccaagaccaccaagaaaatcgtattgaagctgcagtngcagagctgcaagcactactcacagcacgcaattaagaggtgcaagcatttttgagattggtggagacaagaaggcaaggnaacatctctcnttctaagtttctcatccgccatctcgatgtggaatcgaacctgtgggccactactgttccaaaaactcgccaatttcatggtaaccagtagtccgaaagaaggcctgcctgggtatcaattccaatgccgaactttccccgaaaggggggtttgcctttggcaaa

SEQ ID NO: 61804 - protein, 91 aa, Zea mays
  misc_feature: Ceres CLONE 1525145
  misc_feature (19)..(91): Pfam Name: Ribosomal_L44 Pfam Description: Ribosomal protein L44
  misc_feature (74)..(74): Xaa is any aa, unknown, or other
MVNVPKTKKTYCKNKECKKHTLHKVTQYKKGKDSLSAQGKRRYDRKQSGYGGQTKPVFHKKAKTTKKIVLKLQXQSCKHYSQHAIKRCKHF

SEQ ID NO: 61805 - DNA, 591 bp, Zea mays
  misc_feature: Ceres CLONE 1525146
  misc_feature: Encodes the peptide sequence at SEQ ID NO. 61806
  misc_feature (137)..(137): n is a, c, t, g, unknown, or other
  misc_feature (144)..(144): n is a, c, t, g, unknown, or other
  misc_feature (398)..(398): n is a, c, t, g, unknown, or other
  misc_feature (460)..(460): n is a, c, t, g, unknown, or other
  misc_feature (521)..(521): n is a, c, t, g, unknown, or other
  misc_feature (545)..(545): n is a, c, t, g, unknown, or other
gctccccgcggtggcggccgctctagaactagtggatcccccgggctgcaggaattcgtctcacccctagaaaaaaacactcaggcaacccagctttggctgcccttgcttgctgctcagttctttagccccctgtntcctccntcctcctcttttcgcacctcggcgcctgcttcggcatcaactgcgaccgagatggaggcgcaagacgactgcaagtggcgccaagtcccggcgttcggcgactggaacctgtgggacgacatgcccgtcacccagtactttcaggcagggaccttcttcttcgccgcgccgacgacagagaaggacgacgacgaggatctcttcaaggtgccccagttccctgccacgccctacagctacaagaagtgcgttgnttcgagtgaagggggagaaaggaactgctgtgcctccggcgggcgaagaagggaggaaggangcgccgcgtgaacgagcaacagaagtggaagcccaagggagctgtggacgaggacctctancagatatccccgcagcttctctgncagaagaagctcctgaggaatctgctgggaaggtgcctgggcctga

SEQ ID NO: 61806 - protein, 91 aa, Zea mays
  misc_feature: Ceres CLONE 1525146
  misc_feature (68)..(68): Xaa is any aa, unknown, or other
  misc_feature (89)..(89): Xaa is any aa, unknown, or other
MEAQDDCKWRQVPAFGDWNLWDDMPVTQYFQAGTFFFAAPTTEKDDDEDLFKVPQFPATPYSYKKCVXSSEGGERNCCASGGRRREEGXAA

SEQ ID NO: 61807 - DNA, 663 bp, Zea mays
  misc_feature: Ceres CLONE 1525147
  misc_feature: Encodes the peptide sequence at SEQ ID NO. 61808
agctccccgcggtggcggccgctctagactagtggatcccccgggctgcaggaattcgtctcacccctagataactggcgagccgcggctacagtatagccaccgcaacaccgcatctcaagcgcaagacctcctcgcggctatggcgaagcgtctgatcccgtcgctgaaccgggttctggtggagaagctgctgaagcccagcaagagcgccggcggcatcctcctcccggagaccaccaagcagctgaacgccgctaaagtcgttgctgttggccctggtgatcgtgataaggatggcatagctgatccctgtatctctgagcgaaggcgacactgttctgcttgcggaataacgcggggaccggagtgaaacttgtcttaacgagataaccttcgtttacaaagagccccaacattctgggggaagctccaaggaataagctctgggactgttacagattggagttgttttgaaagttaggtatgcaaagaattttggcccacggcttaatctttttttttttggtacgggggggaacaattggataaactgcaacccctttgttgagtaatggcagttaaacactgtccgtttttcttggaaaatactttctttttggggggtgcgcccgcaaacattttagtcaaaaatattcgggg

SEQ ID NO: 61808 - protein, 76 aa, Zea mays
  misc_feature: Ceres CLONE 1525147
MAKRLIPSLNRVLVEKLLKPSKSAGGILLPETTKQLNAAKVVAVGPGDRDKDGIADPCISERRRHCSACGITRGPE

SEQ ID NO: 61809 - DNA, 758 bp, Zea mays
  misc_feature: Ceres CLONE 1525155
  misc_feature: Encodes the peptide sequence at SEQ ID NO. 61810
  misc_feature (307)..(307): n is a, c, t, g, unknown, or other
  misc_feature (308)..(308): n is a, c, t, g, unknown, or other
  misc_feature (405)..(405): n is a, c, t, g, unknown, or other
  misc_feature (407)..(407): n is a, c, t, g, unknown, or other
  misc_feature (416)..(416): n is a, c, t, g, unknown, or other
  misc_feature (631)..(631): n is a, c, t, g, unknown, or other
caatgctggagctccaccgcggtggcggccgctctagactagtggatccccgggctgcaggaattcgtctcacccctagaaaaaaaaacagctgtcgatccaattgtcacttgctctccctccaacaagctaattaaggccggtcatccctcttctagctcgtttcattatggatggcggaggagaagcaccaccaccaccacctgttccaccacaagaaggacaaggagcaggaggagcagcccgccggcgccgggtacggcaagtctccccatttcttttttttccccccgagaaaaaaaacaanncccacaccataacaccttttcccaccatcaccacggtaagaggtaaagcaagttttttttttcccccccccccacgggagggaagaaggggggcacncnccccacccncccccccaccccccccccccccccacgtaggccgtggatgatacaaactctggccccctacatcctccccccacctctccctccgccactcacaacacccctgcggcgccactcccatactgtgagcagcctccccccccgcccctctcccctgactcgctcgcccctttaccgtcgtctacctcaccacccccctctcagagcgcggccccctnacgtccgccgcctcgtgaccgcccctctctgttgcctggccctcgcacggccatctcaccgcgctacacctccacccccctccacaccccaaacgatgtaccttcatcgctcacacactcactccca

SEQ ID NO: 61810 - protein, 48 aa, Zea mays
  misc_feature: Ceres CLONE 1525155
  misc_feature (45)..(45): Xaa is any aa, unknown, or other
MAEEKHHHHHLFHHKKDKEQEEQPAGAGYGKSPHFFFFPPRKKTXPTP

SEQ ID NO: 61811 - DNA, 645 bp, Zea mays
  misc_feature: Ceres CLONE 1525160
  misc_feature: Encodes the peptide sequence at SEQ ID NO. 61812
atagctggagctccccgcggtggcggccgctctagaactagtggatcccccgggctgcaggaattcgtctcacccctagaaaaagtcttgccgccgatcctttttccgaaacctagctcgcccgcccgacctccgaccttctagaaccttgcctccgaggtgccgccctccccgccccgcctgcgccgcttgctcatcgcttctctccccgcggcggcctcccagatccggttggatcgaggggcaaggtcaagagatggggcaggccttccgaaagctgtttgatgccttcttcggcaacaaggagatgcgggtggtgatgcttgggttggatgcagctgggaaaccaccatactctataagcttcacattggtgaagttctctccactgtccctaccataggtttcaatgttgaagaaggttcaatacaagaatgtagtgttcaccgtgtgggatgttggtggccaggagaagctcaggcccctgtggaggcactacttcaacaacactggagctctgattttcctggtttgattcccggaatagagagagaatcgggaggaccaggggcggagtttccaggctttaatcatgaacccctttttgcttaacagtgtggttattggtgtttgcctaacaggcaa

SEQ ID NO: 61812 - protein, 48 aa, Zea mays
  misc_feature: Ceres CLONE 1525160
MGQAFRKLFDAFFGNKEMRVVMLGLDAAGKPPYSISFTLVKFSPLSLP

SEQ ID NO: 61813 - DNA, 760 bp, Zea mays
  misc_feature: Ceres CLONE 1525274
ggagctccccgcggtggcggccgctctatactagtggatcccccgggctgcaggaattcgtctcacccctagaaaaagcagtcgcccccaaatttccccgaaccaaatcactcccaccgtctccacagcaaccagtacacattttcctttggcggatcgaaggaaggaaggaacgacgagatgggtggtggtgtggatgtgcacaaaaactggtggattcaagagtggatcgctcgtcgccgagaacctcgagattcctttcttctggacccggctcagcctctccgatcgcagagtactttggcctcgttgtccccttcctcctgcgacaagggtacctgactgccctctttcttatttcccccctacgagtccgggggggggggtgtcttcactcttacctttaacccccccccccccccccccctacggacacttgttcctcccgcgccgctttttcgttgtcactcccagttcttactcgcctccttttcgtttcgcgcgcttgcttgccggtttctatatccccgcgtttacccttgtcttttttctctttcccgttggtaatagtgtgcggtgccctcggcctccatcccccccttcgcttgcccttatattgatcctccgccccattagactcgattcgctgcacattcggtcccgttcctatcacttctgaccttttcaccccacccatacctccatctcttgtaacttgattgttcccttttccgtccagcttttgaccatttcctgtccg

SEQ ID NO: 61814 - DNA, 696 bp, Zea mays
  misc_feature: Ceres CLONE 1525276
  misc_feature (523)..(523): n is a, c, t, g, unknown, or other
caaagctggagctccccgcggtggcggccgctctagaactagtggatcccccgggctgcaggaattcgtctcacccctagaaaaattgattctatgggtggtggtgcatggccgttcttagttggtggagcgatttgtctggttaattccgttaacgaacgagacctcagcctgctaactagctatgcggagccatccctccgtagttagcttcttagagggactatggccgtttaggccacggaagtttgaggcaataacaggtctgtgatgcccttagatgttctgggccgcacgcgcgctacactgatgtatccaacgagtatatagccttggccgacaggcccgggtaatcttgggaaatttcatcgtgatggggagagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttccgatctcngcgaccggggcggttccccgccccccaagtccccgagaatccattgaacctttatcttttacgggagggagaaagtcctaacagggtttcctaaaggggaacctccgaaaggattctttccctgacccttaaaaaaaaaaaaaaaaccaacccctccgaggtcccccatcccg

SEQ ID NO: 61815 - DNA, 744 bp, Zea mays
  misc_feature: Ceres CLONE 1525277
  misc_feature: Encodes the peptide sequence at SEQ ID NO. 61816
aagctggagctccccgcggtggcggccgctctagactagtggattcttgggctgcaggaattcgtctcacccctagaaaaaaaaagctccccaacgaagtgcgagcgacccacgtccacacgacacgaaccaccaccaccaaccagcagccgcaccacgcacccagggcaaagcgatggcgtcgctcagcatgatggcgtccttcgccgccgtggcggtggccgcgtcttcgcgccgcggcagcttcgtcatggtcaggtccccccaggtcgaccgcttgccacgaaccggcgacgttccccgcagccgaggcccggcccgcccccgcacagacgcggatgggtgcatatttgcgtgggcctgcggggggcctcgcgaggccatcccgcgctttttagtgtagtccccacccccccccgcattccacgtcgcccggcgccgggggctagtaggatccttccccggccccctggtgtacccgttgtgtggttgccctgcccccgccgctgcgtcctgcggtgcgtgttcccccgccgcgtggcgatgggggcagcccctcgcagggtggggtgagggaaacgcgggccgcaacgcccctcgccttctccttctatccgtccggcgggcgggcgtcggttagcgcgtgtttagtagatggtccccccctcggagcctccctctcctcctaccgcgcgcgcgcgtcgatgtatggcctctcctgagtgaaacccacctggcgggtgg

SEQ ID NO: 61816 - protein, 75 aa, Zea mays
  misc_feature: Ceres CLONE 1525277
MASLSMMASFAAVAVAASSRRGSFVMVRSPQVDRLPRTGDVPRSRGPARPRTDADGCIFAWACGGPREAIPRFLV

SEQ ID NO: 61817 - DNA, 657 bp, Zea mays
  misc_feature: Ceres CLONE 1525279
  misc_feature: Encodes the peptide sequence at SEQ ID NO. 61818
aaagctggagctccccgcggtggcggccgctctagaactagtggatcccccgggctgcaggaattcgtctcacccctagaaaaaactctccgcctccctccccgccgcacagcctccatagcccgaaaccctcgccgccgatcggtttcggagaagagaagcaaatcaagatgtttctcggctcgctcccgcggcgcccgagcaaggaggctgcgtacaagcagctgcggtcgcacatcatcatcatggcctcctgcgccgccgtcatccgcgccaccccttacatcctccatttcctcgcccgcgacggcgacatccaggaactcaagctcgatctgtaggcccgtccgttgcttccccacctccagaggtgctacaaaggcaaccgttagttcgaggccactgcaacccaccatggagttagtggctacagtgcctgcttaagtttctttggtgttcccagtttagtgacaaaactgacaagggtgtagcaactggggtgtgctgcgaccaggattttcttttttgcctaccggtattgggctagtcccttgtttgccctgggggaatttgccgagaatgttttcctttccacaaggtttctggggccccgttggcaaatgcccctaagccccgcggaaaaaaaaaaaaaaaaaa

SEQ ID NO: 61818 - protein, 56 aa, Zea mays
  misc_feature: Ceres CLONE 1525279
MFLGSLPRRPSKEAAYKQLRSHIIIMASCAAVIRATPYILHFLARDGDIQELKLDL

SEQ ID NO: 61819 - DNA, 729 bp, Zea mays
  misc_feature: Ceres CLONE 1525280
  misc_feature: Translation starting site: 190
  misc_feature (312)..(312): n is a, c, t, g, unknown, or other
  misc_feature (363)..(363): n is a, c, t, g, unknown, or other
  misc_feature (408)..(408): n is a, c, t, g, unknown, or other
ctggagctccccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaangctgcgctgtccgtgtccgcgtcgtccacgctggcgggcgccttcctcgcngcgctggcgtcgtcgcccgacgctgcgctggcggacgtggccccngcggacgccggcggcgacagccgcgggcagctgctgctcgtcgtggtggcgcccgccatcgggtgggtgctgtaaacatcctgcagccggggctgaaccagctgaaccgcatgcgcaacagccaggcgtggcccgccggcctgggcctcgggcgccgccgcgccccccgggatggcggcccccgccgaagcccccgccgccctggtggaaggacctcccgggaaattgccgccgccggggcccgccaaaaacagcccggggccctcccctggttcatcggtcgtcccgcccccccaattgttggggggcccctcaacaacc

SEQ ID NO: 61820 - DNA, 767 bp, Zea mays
  misc_feature: Ceres CLONE 1525281
cggaagctggagctcaccgcggtggcggccgctctagactagtggatcccccgggctgcaggaattcgtctcacccctagaaaaaccaccagtaccacaccactccgcgctagctgaggacggtacagcggcacagaggtgcgacgtacgacgacgacgacgcaggcgccacacatggcatcccagctctccgccgccgtgcccccggttccacggcctccggggctactccgggtcccaggtcctcgctggcagcgctgccgcccgtgaggccggcaccgcataggccgccccctcagggcatccgccgcccattccgtcgggtcctccaccccccttaaccccgggcaccaacgaccactttttattttgttgtgtttgtgtccgttagaattatcctatattaagaaaaaaagtttttcccccccccgttgattattaaaccgccgacgcgcggtatactccccccaccttttgggccgcggtgggacctaccggtgggcatccgttttccccccccaacccaccttacttccgccggagccgcgcttcacttcaccccgccaccgcggctttcgggatgcgggcgcatcaggcgctatgcccttccccgccccctccgggccggtatgcacttgcccctcccccctatccgccgcgctgttgttttcgcccgccccccgcaaacagtcttcgccccgcccagtaccccatgatggagtgtcgaccccccatcgcgccagatttttttagttaccccccccacc

SEQ ID NO: 61821 - DNA, 661 bp, Zea mays
  misc_feature: Ceres CLONE 1525283
  misc_feature: Encodes the peptide sequence at SEQ ID NO. 61822
gagggaattcgtctcacccctagaaaaagccactaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacaacgacgacgcttatgcccatcacggggcggttcgggctggcgccttcttctaaccccaaggcgacggcggggctgaagctggaagcgcgcgactcctgcctgcaaacgggtgaacccgccggggtttaccctcgccgacacgctgggctggagtgtcggtgggtagcatacgcgggggccagtattaatggctttggttctaggaggaccggcgcgccccgaggaagattattggggagaaaaccaaccgccgcgttggttgaagattcggctccgggcagccttgaatttattccggccgggcggtcaaggggggcgtaaagggggcgggaattcgccaaacgggagtttggtaggcgctag

SEQ ID NO: 61822 - protein, 164 aa, Zea mays
  misc_feature: Ceres CLONE 1525283
MASQLSAAVPRFHGLRGYAAPRSAVAALPSVRVGRKRSSSQGIRCDYIGSATNLIMVTTTTLMPITGRFGLAPSSNPKATAGLKLEARDSCLQTGEPAGVYPRRHAGLECRWVAYAGASINGFGSRRTGAPRGRLLGRKPTAALVEDSAPGSLEFIPAGRSRGA

SEQ ID NO: 61823 - DNA, 732 bp, Zea mays
  misc_feature: Ceres CLONE 1525285
  misc_feature: Encodes the peptide sequence at SEQ ID NO. 61824
  misc_feature (492)..(492): n is a, c, t, g, unknown, or other
  misc_feature (617)..(617): n is a, c, t, g, unknown, or other
  misc_feature (642)..(642): n is a, c, t, g, unknown, or other
ctggagctccccgcggtggcggccgctctagaactagtggatcccccgggctgcaggaattcgtctcacccctagaaaaactagcgccgcaccctcccgcccaccgccgtcgccgcccagccgcagtaaggaggaaggagcaggaagatgccggcggggcacgggctgcggtcgcggacccgcgacctgttcgcgcggcccttccgcaagaaggggtacatcccgctcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccattggcgtcgagatcaacaagcaggttaacggtcgcatcatcaggaagcggatccatgtccgcgtggagcatgtgcagccctcccgttgcacagaggagttccgcctgaggaaagccaagaatgaccagctncaggcggatgccaaggcccgcggtgaggtgatcagcaccaagaggcagcctgtgggacccaaacctggcttcatggtcgagggtgctacactcgagacagtcactcctattccttatgatgtggntcacgatcttcagggcgggtactanagagaattcttgtaccttcagcagttcaacgagctggcaacttatctgatcttttttgataatgggctagtcttctgtctggtgttatga

SEQ ID NO: 61824 - protein, 194 aa, Zea mays
  misc_feature: Ceres CLONE 1525285
  misc_feature (2)..(100): Pfam Name: Ribosomal_L21e Pfam Description: Ribosomal protein L21e
  misc_feature (157)..(157): Xaa is any aa, unknown, or other
  misc_feature (165)..(165): Xaa is any aa, unknown, or other
MPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRKAKNDQLQADAKARGEVISTKRQPVGPKPGFMVEGATLETVTPIPYDVXHDLQGGYXREFLYLQQFNELATYLIFFDNGLVFCLVL

SEQ ID NO: 61825 - DNA, 753 bp, Zea mays
  misc_feature: Ceres CLONE 1525287
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
aaagctggagctcaccgcggtggcggccgctctagactagtggattcttgggctgcagaatcgtctcttcttagggagagcagcctcccaggagaaggagatccaatcctgcgggcgggcgtcccccgtatcccatcatcgatccgaatctcggaatctgcaggaccctgcggcgcggcttcttcgtggagaagaggttgctgccgaagccaccgccaggtaaccatgtcgtcctccgggctgagggctgcgcccgacagggccattcccgggcgggccctcgagggaggaaccccctgtcttccaggaatcgggaagcaactccgcctaaaggcaagcgggcatactttttggcctgggcgcgccaggggggggggggcgatnnnactttctcaacacccccccccccgggcgtattaagcggggaagagtttggtggagcgtttgtcgggagggaaagagttttatctggtctcccctggtggccgggtgcggctctgtaatcggggcacccccgccgcccataaggggcaaccggcttggcagagaacccgcccataccagccgcactgagcggtggcccgtcgaagtcggggagcgtgcgaagaggggcggatgggtgccctggggggagggatagttttttgaggcgcgggcgcggcgttcgtagacgcgcccggccgctgggcggtgtgtgttgggttggtttggggcacgtacgctccgatactgatgtataggtgatgggcgggt

SEQ ID NO: 61826 - DNA, 719 bp, Zea mays
  misc_feature: Ceres CLONE 1525292
  misc_feature: Encodes the peptide sequence at SEQ ID NO. 61827
aaagctggagctccccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcaaacccccccccagcagacgccggcagcgacagccgcggccagctgctgcttcgcatggtggcgccccccaatcggtgggtgctgtaaaaaatctgcagccggccctaaaccaactaaaacgcatgcccaagcaaccagacccatggtctcccggggctgggacttcggaactatccacccacctcccggaatggtagccccccgcccgaaaaccttccacccgcccgtggtgttaaggaacttctcgggaaataccaccatctggtgtttaaactctcttaactaaaagcccggggggtatactctcttggcccttagg

SEQ ID NO: 61827 - protein, 97 aa, Zea mays
  misc_feature: Ceres CLONE 1525292
MATIATMALLKPAAKAAARSAPSTSSGSVSLRVRTGQAAKKAALSVSASSTLAGAFLAALASSPDAALANPPPADAGSDSRGQLLLRMVAPPNRWVL

SEQ ID NO: 61828 - DNA, 717 bp, Zea mays
  misc_feature: Ceres CLONE 1525293
  misc_feature: Encodes the peptide sequence at SEQ ID NO. 61829
  misc_feature (427)..(427): n is a, c, t, g, unknown, or other
  misc_feature (430)..(430): n is a, c, t, g, unknown, or other
  misc_feature (431)..(431): n is a, c, t, g, unknown, or other
ctccccgcggtggcggccgctctagaactagtggatcccccgggctgcaggaattcgtctcacccctagaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaagaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaagagctgggccanttnncccaagccccgcccgtaaactcccaattctgggctggggctagtgacgtggcacttgggcctgttcatcgggcctcacttccggcaaatcggattcaaaggcaggacccaagactacttcgaaagtggaaccggtaaaaacctatcatccatcctgggggtgcccctcattgcgtttgggggggggccccccccaaccaaactttggctgaaaaaggttcccatttcccccaaagaaaaggaaaaaggcccctttgaacctcaatgaaaaccccacccgcccggcc

SEQ ID NO: 61829 - protein, 147 aa, Zea mays
  misc_feature: Ceres CLONE 1525293
  misc_feature (101)..(101): Xaa is any aa, unknown, or other
  misc_feature (102)..(102): Xaa is any aa, unknown, or other
  misc_feature (103)..(103): Xaa is any aa, unknown, or other
MAASASTVSGLAGASLASRPAFSTSFTRGSRVSARNPLMSRNLEKNGRITCMTFPRDWLRRDLSVIGFGLIGWMGPSSVPAINGNSLTGLFFSSIGQELGXXXQAPPVNSQFWAGASDVALGPVHRASLPANRIQRQDPRLLRKWNR

SEQ ID NO: 61830 - DNA, 720 bp, Zea mays
  misc_feature: Ceres CLONE 1525294
  misc_feature: Encodes the peptide sequence at SEQ ID NO. 61831
  misc_feature (629)..(629): n is a, c, t, g, unknown, or other
acccgcggtggcggccgctctagaactagtggatcccccgggctgcaggaattcgtctcacccctagaaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagagacggcggaagaggcgtccagcggcgggagcaagggaggccagtcgcccaggaggccgccaagtcccccagaaggcataggggttggaagcngatcccatgttgtcatgtggaggttgtaagcgggcaatgtgattggctgtgtatctgcttcgctcagttgctttatgccttcctaatgaaa

SEQ ID NO: 61831 - protein, 158 aa, Zea mays
  misc_feature: Ceres CLONE 1525294
  misc_feature (31)..(104): Pfam Name: Histone Pfam Description: Core histone H2A/H2B/H3/H4
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGVLPNINPVLLPKRRRKRRPAAGAREASRPGGRQVPQKA

SEQ ID NO: 61832 - DNA, 682 bp, Zea mays
  misc_feature: Ceres CLONE 1525297
  misc_feature: Encodes the peptide sequence at SEQ ID NO. 61833
aaagctggagctccccgcggtggcggccgctctagaactagtggatcccccgggctgcaggaattcgtctcacccctagaaaaacgcacgaatcactgctctgctttcaccccccgcatcggacctcgcccccgatctgatcgaatcgaaggctgctgcggcgatgggcggtgaccatggcggtgggcacgccggcggcgacttccgccagaaggaatggagcatgacgggcggcccgtactgccgccccgtccactggcgccttaacaccgccatcgccatgttcggcgtcttcctcatctgcatccccatcactatgaagtccgcagagctctagcaactcccgcttcacccagtctggccaatcccatctcaactgcggtgcacaagctttgctaagaaggaatactgaaggaccctccaactagcatgaagtgcgggcaccttgcttttgccttcttattgtggaaacctgtgcctagccatcatgctgggttaagtgataggagcatctctggaatgcttcgcgcagtatcttttgattcacctttccttcgggttacatgtcgaatgcctgatgaactcacataatgaccggcgatacaaagggctgtgatgaatttactcacaggtcttgatcgtgtacctgtaaacctggcatgtcgtctgcacacttaatgtt

SEQ ID NO: 61833 - protein, 57 aa, Zea mays
  misc_feature: Ceres CLONE 1525297
MGGDHGGGHAGGDFRQKEWSMTGGPYCRPVHWRLNTAIAMFGVFLICIPITMKSAEL

SEQ ID NO: 61834 - DNA, 725 bp, Zea mays
  misc_feature: Ceres CLONE 1525299
  misc_feature: Translation starting site: 164
  misc_feature (331)..(331): n is a, c, t, g, unknown, or other
  misc_feature (471)..(471): n is a, c, t, g, unknown, or other
  misc_feature (492)..(492): n is a, c, t, g, unknown, or other
ctccccgcggtggcggccgctctagaactagtggatcccccgggctgcaggaattcgtctcacccctagaaaaaacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctncggcgaggccggcgccatcgccgccggcgccttcgcactctacgagaagcacgaggcgaagaaggaccccgagcacgcgcacaggcacaagatcacggaggaagtcgctgcccgcgcggccgtcggcgccggcggctacntattccacgagcaccacgagnagaagaaggaccacaaggacgcggaagaggctagcggcaaaaagaaacacaccacctcttcggctgaccgtattaccggccggggcggcgacggaaagttaattaggtccggggcaaaaaccaaaaaccggtttaattccgaccgcgaggcgggggaaatttgaagttccaaaaaaagagccccttccccggacttgggaaaaaaaaaaaaaaacgagaaggctggagtcccc

SEQ ID NO: 61835 - DNA, 686 bp, Zea mays
  misc_feature: Ceres CLONE 1525302
  misc_feature: Encodes the peptide sequence at SEQ ID NO. 61836
aaagctggagctccccgcggtggcggccgctctagaactagtggatcccccgggctgcaggaattcgtctcacccctagaaaaaattattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctgcagaggaatggcatgatcacctgcatgacgtttccccgggactggctgcggagggacctgagcagtcatctgcttcaggctcatcggctggatggggccgtccagcgtcacggccatcaacggacacagcctcacggggctcttcttctccagcatcggccaggagctggcacacttcctcacgcccgcgcgcgtgacctgccagttctggctgtggctagtgacgtggcacttgcgtctgttcatcgcgctccccttcggccagatcgggatccaagacagggccgaagactacttcagaaatgcaagcggtaaaaatcctattcatcatcccgggagattgccttcaatgcggtttcgggcctggctccccccaatcaaaacttttggtggttaaggtttccaatttccccaaaagg

SEQ ID NO: 61836 - protein, 147 aa, Zea mays
  misc_feature: Ceres CLONE 1525302
MAASASTVSGLAGASLASRPAFSTSFTRGSRVSARNPLMSRNLQRNGMITCMTFPRDWLRRDLSSHLLQAHRLDGAVQRHGHQRTQPHGALLLQHRPGAGTLPHARARDLPVLAVASDVALASVHRAPLRPDRDPRQGRRLLQKCKR

SEQ ID NO: 61837 - DNA, 725 bp, Zea mays
  misc_feature: Ceres CLONE 1525303
  misc_feature: Encodes the peptide sequence at SEQ ID NO. 61838
tccccgcggtggcggccgctctagaactagtggatcccccgggctgcaggaattcgtctcacccctagaaaaaaaattgttgtacaatgccattgtacacaattcctttcttgttttccacatcgtaattttcttctatttctttatccatatagaactttcttgtcatttcttgtttttggtctcatataatcaaggaaggggtataaactaaaatccagtcaaatttcacctataaaagaaagactactattccttagtaatgtataggaagaaggggtcatcttttttagggataggaaaatctcgtctatacggttcattctatatatatataatatttattttgtttttttagttaggaatttcgcctaaacaaaagaaatacaaaggatcttgggcaagagtatctgatcatatatgtattccaatacggaaggaggattttcaatgcgggatataaaaacatatctctctgtagcacccgtgctaagtactctatggtttggggctttagcaggtttattgatagaaatcaatcgtttattcccagatgctttgtcattccctttttttttaattctagttattcctatgcgagagatagaattcttcgtgacatgacgaaaatttcccctttttgaaattcttttttaggatatgaagcaaaaaaaaaaaaaaacgagacgctcgaggtacccaatccgccctatagtgagtcgtat

SEQ ID NO: 61838 - protein, 67 aa, Zea mays
  misc_feature: Ceres CLONE 1525303
  misc_feature (11)..(47): Pfam Name: PSI_PsaJ Pfam Description: Photosystem I reaction centre subunit IX / PsaJ
MYSNTEGGFSMRDIKTYLSVAPVLSTLWFGALAGLLIEINRLFPDALSFPFFLILVIPMREIEFFVT

SEQ ID NO: 61839 - DNA, 704 bp, Zea mays
  misc_feature: Ceres CLONE 1525304
  misc_feature (521)..(521): n is a, c, t, g, unknown, or other
  misc_feature (536)..(536): n is a, c, t, g, unknown, or other
  misc_feature (558)..(558): n is a, c, t, g, unknown, or other
  misc_feature (611)..(611): n is a, c, t, g, unknown, or other
agctcaccgcggtggcggccgctctagaactagtggatcccccgggctgcaggaattcgtctcacccctagaaaaagcggtttcatccgtacccatcctgcacacgaagcctagaatagccctcccctgctccgccacctcactcggaatcccgaaccaccccaccccccacccccagaaaaaaagggttggattggaggggctaaaaaaagggaacgcctttcttttcccaaggcccgcgggaagaaaattttccttccccccggggggggggggaaaccacaatcccccccaggggggggggaaaaaacgtggagaaaatctcatttttaccacccaggttttttttaaaaaaaaaaaaaaaaaaatttttccttcacaaaaagggggcggccggaaaaaaggggggggggggaggctcccacagaaaaggaaaatttaaattaacacccccccccccctccctaatgaaaggaaaaaaggggggtatattagatattagatgaggggggggggagagnaaattcaagagacanccccccccccccccacagatcncataggggggggggggggggtggcatataaaaatcaacccccaccaagaaagntgggagggtcagacgcctcgcagcactcggtcgggggcgggtggccaataataataacccacaacccaacattctctgtgggtgggtgggtgg

SEQ ID NO: 61840 - DNA, 654 bp, Zea mays
  misc_feature: Ceres CLONE 1525306
  misc_feature: Encodes the peptide sequence at SEQ ID NO. 61841
aaagctggagctccccgcggtggcggccgctctagaactagtggatcccccgggctgcaggaattcgtctcacccctagaaaaaagcagtgacgaactcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcaccaccaagtacaggtgccgcgacttcctccccgaaaactgcggctgcaagatccactagactcatccacagcggcacagccgatggatccttccatgctcctccgtccgtccgccttgctataagcaggcaggcagccaccaataagctagctcttgctgttgttttgcatgtttgattgggtgtcccttcccagtcgagatggattaaataaatgtcaggcgcacgtacagatgtgttattacgatatttctcccctacaaataaaactcgatttgtgggggta

SEQ ID NO: 61841 - protein, 89 aa, Zea mays; identical to SEQ ID NO: 50292
  misc_feature: Ceres CLONE 1525306

SEQ ID NO: 61842 - DNA, 696 bp, Zea mays
  misc_feature: Ceres CLONE 1525309
  misc_feature: Encodes the peptide sequence at SEQ ID NO. 61843
acccgcggtggcggccgctctagaactagtggatcccccgggctgcaggaattcgtctcacccctagaaaaaatctttcgctcgctctcggcgacagctgggcgaccgtcgtcgccgccgcccttctctaggtgcccaggtcttcgccggtccctttgccgcctcttcgccgccgatgagcaccagccaggaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatctgtcaggaaaacttcagcacaactgttaatgcactcactgagcctattgatatatatagtgaatggattgacgagtgtgagcgtgtcaacactgttgaaggcgacgatgatgcgtgagcttgccccatgcgatgaaactgttacctaccatcgtaatgtaatgtgctagtattctcgaatgccttaccccatagtcggccatggcttgaaataacgtagtggctgactgatatgccagtaggcaccttatctagtacttacagaactaccaaaagtttggattatacatatttgggccacccttatagggggtttggggtggcaacaaaaaaaa

SEQ ID NO: 61843 - protein, 89 aa, Zea mays
  misc_feature: Ceres CLONE 1525309
  misc_feature (8)..(68): Pfam Name: Elf1 Pfam Description: Transcription elongation factor Elf1 like
MGKRKSAAKPPPKKRMDKLDTVFSCPFCNHGSSVECRIDMKNLIGEASCRICQENFSTTVNALTEPIDIYSEWIDECERVNTVEGDDDA

SEQ ID NO: 61844 - DNA, 670 bp, Zea mays
  misc_feature: Ceres CLONE 1525312
  misc_feature: Encodes the peptide sequence at SEQ ID NO. 61845
  misc_feature (391)..(391): n is a, c, t, g, unknown, or other
agagctggagctccccgcggtggcggccgctctagactagtggatcccccgggctgcaggaattcgtctcacccctagaaaaagttgcactggtgcttcttctccatcatcatcatcagaggaggagctacctacctaccttttgatgcaggttgccatggccaccaccaccagcagcagcttggtcaccggcttgaggtgcaggacaggtgcagcagtggcattgatcagacccactagtgccgctggggatcgccggggctggaggacgacggcgtccggccgtggagcccgcaggggcaaggtcacggtcgctgcggcctgcaagacatgcaaaggaaagggggcagtagaatgcccagggtgcaagggcaccggcaagaacaagaanaacggcaacatcttcaaaacacccaagtgctttgactgccaggggttcgggctcaagagctgccctacctgtggcaaaggaggtctcacacctgagcagcgaggggagagatgaatcaaccatatacaacgaaaactgcattcactgtataccaggcactgctgataaacctgcacttccagaaacaccaccactatattttttcctttctcctgcatgtctgtgccatccccggggccttcccaaaaaaccaaaccctgagtaccatcaaaaagggga

SEQ ID NO: 61845 - protein, 115 aa, Zea mays
  misc_feature: Ceres CLONE 1525312
  misc_feature (78)..(78): Xaa is any aa, unknown, or other
MATTTSSSLVTGLRCRTGAAVALIRPTSAAGDRRGWRTTASGRGARRGKVTVAAACKTCKGKGAVECPGCKGTGKNKXNGNIFKTPKCFDCQGFGLKSCPTCGKGGLTPEQRGER

SEQ ID NO: 61846 - DNA, 645 bp, Zea mays
  misc_feature: Ceres CLONE 1525316
  misc_feature (347)..(347): n is a, c, t, g, unknown, or other
  misc_feature (348)..(348): n is a, c, t, g, unknown, or other
  misc_feature (350)..(350): n is a, c, t, g, unknown, or other
  misc_feature (353)..(353): n is a, c, t, g, unknown, or other
  misc_feature (356)..(356): n is a, c, t, g, unknown, or other
  misc_feature (451)..(451): n is a, c, t, g, unknown, or other
gcggtggcggccgctctagaactagtggatcccccgggctgcaggaattcgtctcacccctagaaaaaacatcctctcttcatactatctaccacaactagttgccagagttcgtcatggacttctacaaagagttcgtggagacttcgtccgatgacgattccgaagactgaggtcgacactcgacaccatgtacgtttagcaagcccttgagcaactaggtgttggaggttcgagcgggcgtcgtagacgctcttccttgccacgtctagtaatccatagggatcacagtgctagcgaaaatctgataaagctccactacttcggtccaaatcctgtctaattcnncncgnccncccaacaattttttcccccaaacggaaagagggttttttccgggggaaatgtgccccaagccccgggggggcccccctttttttggatgtttccncccctggggccggtttaattcctttaagagggtggtggcagccaaaggtgggacgggaattttttttttacttggtttaagggtggtgggaaggcctaaccgggggtttttaaggccgggggaacctccgggttcccgttttggcacaaaaaaagggcccccctgggccggggctttttggggcggggggcccc

SEQ ID NO: 61847 - DNA, 708 bp, Zea mays
  misc_feature: Ceres CLONE 1525318
  misc_feature: Encodes the peptide sequence at SEQ ID NO. 61848
  misc_feature (87)..(87): n is a, c, t, g, unknown, or other
  misc_feature (351)..(351): n is a, c, t, g, unknown, or other
  misc_feature (422)..(422): n is a, c, t, g, unknown, or other
  misc_feature (472)..(472): n is a, c, t, g, unknown, or other
  misc_feature (478)..(478): n is a, c, t, g, unknown, or other
aaagctggagctccccgcggtggcggccgctctagaactagtggatcccccgggctgcaggaattcgtctcacccctagaaaaaccntctccaccgcttgctatccgtcgcctcgccgcgcgcgcgtacgttcggttctcggccactgctcagctctcgctgcagcgatggccctgcaggccccgtcactcatgcgcgcgccggcggcacagcggtccgcgccgccacggccctccttctccgccccgtggtcgctgcggctgccggcgccggcgcggcgccgggtggccacggccgcgcggatcaccatgcgggtcgcgtccaagaagggctaaatctgccgtgactgcnggtacttctacacccacccgagggggggggagggggtggctgataaatatttatccccccccggtgggaanccccaaaaaaaaggttcaaaccccaacaagcccggaagtctcccaaaaantggaanggcgaccaaggcccgaaaaggctacgaaagcagcgacctgaaaaagggaggaaaagactgggggaaaagatatgataaatatgaaatcctaccccccgccccccctggacgtgagaatagaactgtgcatttagagcccccacccaaaagacccagcggatacaacaaacaaaaaaaataccgcgatgcggccggaggacaaaacacggtactaatctactcgcaaaatt

SEQ ID NO: 61848 - protein, 55 aa, Zea mays
  misc_feature: Ceres CLONE 1525318
MALQAPSLMRAPAAQRSAPPRPSFSAPWSLRLPAPARRRVATAARITMRVASKKG

SEQ ID NO: 61849 - DNA, 709 bp, Zea mays
  misc_feature: Ceres CLONE 1525323
  misc_feature (53)..(53): n is a, c, t, g, unknown, or other
  misc_feature (152)..(152): n is a, c, t, g, unknown, or other
  misc_feature (406)..(406): n is a, c, t, g, unknown, or other
  misc_feature (407)..(407): n is a, c, t, g, unknown, or other
aaactggagctcaccgcggtggcggccgctctagaactagtggatttcttggnctgcaggaattcgtcttcaccctaggaaaaaccgccgccatcgatcgatcgcccggaaactgacctctaccgatgtctggagccggctaggaggataanaagcccgcggagggcggcgcccacatcaaccttaaggtcaagggacaggatggctatgaggtgttctttcgcataaagaggtccccccagctgaagaagctgatgaacgcctattgcgaccgcctcttttcgcgcaggaaggcgggtgctttcctgttgcatggtccgagggcctcccgcccacagaacccctcgcctatttttttccccccccccggggggggggggggggggcctttccctctcccaaaaannaatgggcccccccccccccccagaaagaaacaattaggcttctcctccgtgcgtgcggccttctagcgcgaggcttgcgtggttggcgaacttatagggtgcgcgtgtggggttggttacgagagactgttcgcgtcctatgccctcgtttattcgtcagaccgcgcgctcccatgaagaccctgggctccgcgtccgtctgctttgcacgcgtcccctacgcgcgcacccacgcctccccggcgtgtagcagcccgcgcaccgcttttcctcgcgcgcctatcgcccacggcccacctccg

SEQ ID NO: 61850 - DNA, 627 bp, Zea mays
  misc_feature: Ceres CLONE 1525324
  misc_feature (156)..(156): n is a, c, t, g, unknown, or other
  misc_feature (175)..(175): n is a, c, t, g, unknown, or other
  misc_feature (362)..(362): n is a, c, t, g, unknown, or other
  misc_feature (363)..(363): n is a, c, t, g, unknown, or other
ccgctctagaactagtggatcccccgggctgcaggaattcgtctcacccctagaaaaactctcgtgtgtctggaaaccctagccgccatatctcacgatccactcgagcaccaagccgagggaaggtgaggagcgatggcgcgcggcgtggtgtcngcaaagggcggcgcggtcncgggcaagaagaaggggtcggtttccttcacgatcgactgccaccaagccagtgggaggacaagatcatgggagggtccgcctctcctcccccaagtccctggccgggaccccccttccggggccccccggggggaaaaggcttggcccccccttcggggaaaccccccggcccccttttttttttnnccccccccccaagaggggggggggggggggccccccttaaaaaaacccctttcctccccacaaagttcttttaaaaaactttctcccccaacaaaccctctttggaggggccccccctcgccccggtatttcctgcccccccgccgtggtcccccccccccacgggggggcccaaaaactcctttgtggcggttccctcctcccctttctcaaaggtggcgtgggggaaagaaggggcgggggggaaaaaacgatcaatttttg

SEQ ID NO: 61851 - DNA, 658 bp, Zea mays
  misc_feature: Ceres CLONE 1525327
tcaccgcggtggcggccgctctagaactagtggatcccccgggctgcaggaattcgtctcacccctagaaaaactctacaatgatctgctgatgcaagccggcaaacttggggaatgtgcaatcagagctgcttctccgcaaggactcccgggactttcattttcaaaaaggggaggggccttccccccccccagttttcttccatgggggataattgtgtccctgccccctctctggaaaatatacctggggtggcccaaaggcaaacccctttaaaaaaaacccttggggcttccccttccttgggtgtttcccggggttcgccctggctcttcccccgtgtcggtttaatcccccggaccctcaggtgtttttattatcccccccttcctcgtgagagggggggggggggggggtcctttttctcctggtcatattcgcgacataactgtttgtgctatcctatccccacaccggggggggttggtcccaccccccccattcgcaattatcgtttccaccgcgtgaggaacattgcccatgccccccccccgtccacccacaatttaatttcccccccccttttatttatccagccaccagccccccccttacttgtgacccctgcccccctcttttttttttcctgtccccccg

SEQ ID NO: 61852 - DNA, 488 bp, Zea mays
  misc_feature: Ceres CLONE 1525329
  misc_feature (180)..(180): n is a, c, t, g, unknown, or other
acccgcggtggcggccgctctagaactagtggatcccccgggctgcaggaattcgtctcacccctagaaaaagtcactttcaataacgagcggccaacccaacccaacccaacccaccactgcctccctccccgttccccagtccccaccccgaccggctgctcctcctcctttccccgncgccatccctcgaaggggcattcacccgggcgccgcaacttcgttgaggagaagccgcaccgccccgatcgatggcaacagcactcccgcgggatctcaggaacccacgatgctcacagcagcgccggatcaccgtcccctcgaagaaaaatgcctactcaagtttaatcttgggccggccatcccccttaaggggggtttttacctgaaaccttttaccgggaaaaacccggggggccccaaaggtatggttttgaacaaaatattttcccccacttttaaaacattgggggaaaaccccccccatc

SEQ ID NO: 61853 - DNA, 715 bp, Zea mays
  misc_feature: Ceres CLONE 1525333
  misc_feature: Translation starting site: 254
  misc_feature (403)..(403): n is a, c, t, g, unknown, or other
acagctggagctccccgcggtggcggccgctctagaactagtggatcccccgggctgcaggaattcgtctcacccctagaaaaagcaagccagacagaagacaacccgtcagcccctctcgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctgaaacgaaggattatgtgcatgtgcgcatccagcagcgcaacgggggagagagtctgactaccgtccancgcccccaccaaggagttcagcttatacaagatcctcaaggatcctgaagaaggaattctgctgcaatggtactgaagttcaggaccccaagctaggcccagtcatttcacctcccaggggaaccacccaaaaaatgtgcctaccttcctaagtcaggctgggattgccaaaaaagaaaacctcaggattccggggttctaggggacccggaaagggctggggcccaaatatggtggtccccccctattggggacctttaagcactcaccctggcctattattggcttaacttaataaaaacaccagcggag

SEQ ID NO: 61854 - DNA, 701 bp, Zea mays
  misc_feature: Ceres CLONE 1525335
  misc_feature: Encodes the peptide sequence at SEQ ID NO. 61855
  misc_feature (537)..(537): n is a, c, t, g, unknown, or other
  misc_feature (625)..(625): n is a, c, t, g, unknown, or other
  misc_feature (629)..(629): n is a, c, t, g, unknown, or other
acccgcggtggcggccgctctagaactagtggatcccccgggctgcaggaattcgtctcacccctagaaaaaaaatacgcctctgctttagcagtagtttccaaccagaggcaggcacctcgagaggcgggtgaacatggagggcgataagaaggcgggcgccgtggcagagaagaaggcggcggcggcggatcagagcaaggaggtggccgctggtgatgtgagcctgaaggagctgtccaggaggctcaacgacttcgccaaggagagggactgggagcagcaccatagcccccggaacctgctgctcgccatgatcgctgaggtcggggagctgtcagagctgttcatgtggaaaggggaggtgcgcaagggcctcgccgactgggacgaggcggagaaggagcacctcggcgaggagctctccgacgtgctgctctacctggtccgcctctccgacatggtgcggcgtcgacctcggcgacgccgccctcaggaagatcgtcaagaacgcccgtcagtacccggcgccgtccnaggaacaaggcgcctgatgatgacaaacaataccacctgtgatgccttctttgatgctttgggatagctgggtgctggtaaagaccangcancgagatatatgactgatgcttggaccctttttcccctttttttgcggtgcatgctcgaagttaataattgat

SEQ ID NO: 61855 - protein, 155 aa, Zea mays
  misc_feature: Ceres CLONE 1525335
  misc_feature (134)..(134): Xaa is any aa, unknown, or other
MEGDKKAGAVAEKKAAAADQSKEVAAGDVSLKELSRRLNDFAKERDWEQHHSPRNLLLAMIAEVGELSELFMWKGEVRKGLADWDEAEKEHLGEELSDVLLYLVRLSDMVRRRPRRRRPQEDRQERPSVPGAVXGTRRLMMTNNTTCDAFFDALG

SEQ ID NO: 61856 - DNA, 540 bp, Zea mays
  misc_feature: Ceres CLONE 1525336
  misc_feature (235)..(235): n is a, c, t, g, unknown, or other
  misc_feature (246)..(246): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
agagctggagctccccgcggtggcggccgctctagactagtggatcccccgggctgcaggaattcgtctcacccctagaaaagtgctttcttagaggtgggttggcttctcctccccctccggttcgggttcgggttcgtgaggttctccggggttcggtttcgtgggtgagcggatcgagatgcggctcggagttgatacgctgctcgtcggcgctcgcctggcacgacgacanctcctcacacngctcagactacgcgaggtctcgagtcaaatcatctcgatcggagacgcaaaggtccgcgctttcgcttctcacctctcacggaagagcaatgcggaacccctccaggcatgaacggaaggaactgaacggcccaaattaccgtaaaaaaggcaaacccccgnnncccttaaaacccccccttggtaaccgggggccctggaacccgcctacccgggggggggccccttaatggcgcggcctaaccggggggggggggggttaaagggggggggggatccccttgggtggccccc

SEQ ID NO: 61857 - DNA, 636 bp, Zea mays
  misc_feature: Ceres CLONE 1525342
  misc_feature: Encodes the peptide sequence at SEQ ID NO. 61858
  misc_feature (406)..(406): n is a, c, t, g, unknown, or other
caaagctggagctccccgcggtggcggccgctctagaactagtggatcccccgggctgcaggaattcgtctcacccctagaaaaaaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgactaccgtccagggattgaagaaggagttcagctacagcaagatcctcaaagatctncagaaagagttctgctgcaatggtacagtggtcccaggacccaggaacttgggacaaggtcattccgcctcccgggggaatcgaaagaaaaaaccctcctcaaaatttcctccccccaagccccggattttttgagaaaaaaagaggcccccctccccgagatttttgggggttttttaataaaaaaacccccccggggtttaaataaaaaaaaaaaaacaccccgcgtg

SEQ ID NO: 61858 - protein, 109 aa, Zea mays
  misc_feature: Ceres CLONE 1525342
  misc_feature (27)..(96): Pfam Name: SUI1 Pfam Description: Translation initiation factor SUI1
MSDLDIQIPTAFDPFAEANAGDSGAAAGSKDYVHVRIQQRNGRKSLTTVQGLKKEFSYSKILKDLQKEFCCNGTVVPGPRNLGQGHSASRGNRKKKPSSKFPPPKPRIF

SEQ ID NO: 61859 - DNA, 702 bp, Zea mays
  misc_feature: Ceres CLONE 1525349
  misc_feature: Encodes the peptide sequence at SEQ ID NO. 61860
  misc_feature (213)..(213): n is a, c, t, g, unknown, or other
  misc_feature (259)..(259): n is a, c, t, g, unknown, or other
  misc_feature (371)..(371): n is a, c, t, g, unknown, or other
  misc_feature (414)..(414): n is a, c, t, g, unknown, or other
  misc_feature (415)..(415): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (615)..(615): n is a, c, t, g, unknown, or other
  misc_feature (619)..(619): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (634)..(634): n is a, c, t, g, unknown, or other
  misc_feature (637)..(637): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
aaagctggagctccccgcggtggcggccgctctagaactagtggatcccccgggctgcaggaattcgtctcacccctagagagatcgccccttgaaccctagctcccgcaactgccgccgccactcccacgcccgcagccatgccgcccaagctcgacccgtcgcaggtggtggaggtgttcgtccgtgtgaccggcggcgaagtcggcgcancgtcttcgctgggcccccagatcggcccgctcgggctttcccccanaagatacgaaaggacatctcccaggaaccgccaagactggaagggcctccgcgccacgtcaagctcacctcccgaaccggcggccaagggtctccgttgtcccctcgggggncccccccccccccccccccctggggggcccccgggggggaaannaaaaaagggcagaacttcaagggaaggggggaaaatttggcctcgaaaaactttcttcaaattcccccggacccttaagggcacaggtccttggggccaagggaaatgacccggccacccccccagggaaaaaccccccggagaccctggggtccccacggcgtggggggggccggccgaaannnntcgggggggccccnccanccccggtnnnnnngngantnnnnnnannngggggggggggggaacccccccccgccccacaaaaagaaaagtggttctgccgc

SEQ ID NO: 61860 - protein, 127 aa, Zea mays
  misc_feature: Ceres CLONE 1525349
  misc_feature (25)..(25): Xaa is any aa, unknown, or other
  misc_feature (40)..(40): Xaa is any aa, unknown, or other
  misc_feature (92)..(92): Xaa is any aa, unknown, or other
MPPKLDPSQVVEVFVRVTGGEVGAXSSLGPQIGPLGLSPXRYERTSPRNRQDWKGLRATSSSPPEPAAKGLRCPLGGPPPPPPPGGPPGGKXKKGRTSREGGKIWPRKTFFKFPRTLKGTGPWGQGK

SEQ ID NO: 61861 - DNA, 727 bp, Zea mays
  misc_feature: Ceres CLONE 1525354
  misc_feature: Encodes the peptide sequence at SEQ ID NO. 61862
agagctggagctccccgcggtggcggccgctctagaactagtggatcccccgggctgcaggaattcgtctcacccctagaaaaagccacgattgcagagccagagcgagacgcgactgcttttctgcttcatccacattggtagctagcttacacgttcacgcatcgctttccgggccgtctccggtggtttagctcagcagagcggggaaggaagaagatgacctccgtgagcgcgaggaccgttggcgtggggtactgcttcggcggggcgaggtgccagccacggtcgcgggtgcgggtttcggccgcggcctcggcagtgaccgcgccggcgcccgcgatggcggcgacgatgtacaagctgttcgccgtccaggagacggcagggccctacgagaataatgccccccaccggttccccccgcggcgggggcaccccgaacccctgcccccggcagccccaaccgctttcatgggcggcagtggagggcctacgagggtgctgtccaaacccccaaccccaggccccggttaacaaaatccaattttccgctggcgggggcccaatttcgggaaaccccccggaaaaccctccggaaaaccccccacccggggtttccccgaattgggaaggtcgcaactctaaaccggtcttccaatggtcccacaggtgggggccctggactcggtccccccctcgagcggggaaaactttttggggaacg

SEQ ID NO: 61862 - protein, 105 aa, Zea mays
  misc_feature: Ceres CLONE 1525354
MTSVSARTVGVGYCFGGARCQPRSRVRVSAAASAVTAPAPAMAATMYKLFAVQETAGPYENNAPHRFPPRRGHPEPLPPAAPTAFMGGSGGPTRVLSKPPTPGPG

SEQ ID NO: 61863 - DNA, 667 bp, Zea mays
  misc_feature: Ceres CLONE 1525358
  misc_feature: Encodes the peptide sequence at SEQ ID NO. 61864
ctccccgcggtggcggccgctctagaactagtggatcccccgggctgcaggaattcgtctcacccctagaaaaagcttctcttcgacagaaaactagggttttgctcttggaatctctctccccgctgccgccgccgccggacagtgcaccgacgatacgacctcctccttcctccgatctggcctttttaatccgcggatcccgtacaagatgcttcccctctcgctcctcaagaccgcccaggggcacccaatgctcgtggagctgaagaatggtgagacgtacaacgggcatctggtcaattgcgacacgtggatgaacatccaccttagggaggttatttgcacctcaaaggatggtgacaagttttggaggatgccagagtgttacattcgtgggaacacccattagtatcttcgagttcctgatgaggtgattgacaagggtcaggaggaaactttccaaaagccgggtcaaataaggaggccacccaggtggttggcccccgaaaaaaaaaaaagggggggacattttgggcctaaaacccgggggggggaaagggatttcgaaaagggggccccaaaataatttgggggggtaaaacggccgggggggggcccccacaaaaaaaggggggggggtttttttttccccaaaagaaggaag

SEQ ID NO: 61864 - protein, 66 aa, Zea mays
  misc_feature: Ceres CLONE 1525358
  misc_feature (5)..(67): Pfam Name: LSM Pfam Description: LSM domain
MLPLSLLKTAQGHPMLVELKNGETYNGHLVNCDTWMNIHLREVICTSKDGDKFWRMPECYIRGNTH

SEQ ID NO: 61865 - DNA, 692 bp, Zea mays
  misc_feature: Ceres CLONE 1525359
  misc_feature: Encodes the peptide sequence at SEQ ID NO. 61866
  misc_feature (420)..(420): n is a, c, t, g, unknown, or other
aaagctggagctccccgcggtggcggccgctttacaatagtggatcccccgggctgcaggaattcgtctcacccctagaaaaactttctgggaactcaaccagtgctgcacaggatgctgagaaggaaggtgccaacctagctggtgatgcagagaaaaaggaagatgctactgtcctctcagagagcaagacctccaagaagaagaaaaagaatgacaagagttcaaaggagggaagaaaagaaactcacgatgtagtcgaggggtcagaggagactgccaatgcatgacctgatgaagaacataccactgctgtggacgtgaaggagcgtttgaagaacatggcttctatgaagaagaagacatcgagtcaggagacggacacccctttcaaaatcgccactacccccccccggccanagaacgcaacgcctgccttcggtcgggagaaagataagattcttttcaacccgtagtccggggcggtaaaggcgataaaagttttaggcatttggtgcccctcaacttaacgtttcctttactggcggactcaccattaaacttttttgcaggtttttggattttgtgactcgccgacacgtccgtttgagtctccaattccccaattcaatacaagacctttggagagtctcataacggggtggcgggcctcatggctcaaaaagatggca

SEQ ID NO: 61866 - protein, 95 aa, Zea mays
  misc_feature: Ceres CLONE 1525359
SWSSPRWRPLYNSGSPGLQEFVSPLEKLSGNSTSAAQDAEKEGANLAGDAEKKEDATVLSESKTSKKKKKNDKSSKEGRKETHDVVEGSEETANA

SEQ ID NO: 61867 - DNA, 640 bp, Zea mays
  misc_feature: Ceres CLONE 1525360
  misc_feature: Encodes the peptide sequence at SEQ ID NO. 61868
  misc_feature (402)..(402): n is a, c, t, g, unknown, or other
  misc_feature (623)..(623): n is a, c, t, g, unknown, or other
acccgcggtggcggccgctctagaactagtggatcccccgggctgcaggaattcgtctcacccctagaaaaagacacaccgacgcgtacgtagcacagtccattattgccgtctcccttttgcgtgagcaaagaaagagagcgagaagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgactagtccggcgacccacaggagaaaaagggacagaagaagaatgataanaagaagcccggcgagggccacgaaccacgactggcgggcacagtagcaacagcagcgacaggcgactgaaaatcctggtgtccccagcacaaggtgccaacacaagttatgccttgctggaatgggaaggatccttacccacctgatgcccgaatggaaatggtttccccgtgggggcccatggccttgccatggaatcccgggcctttttttaaaccccnagagggaaaaaaaaaaa

SEQ ID NO: 61868 - protein, 66 aa, Zea mays; identical to SEQ ID NO: 60676
  misc_feature: Ceres CLONE 1525360

SEQ ID NO: 61869 - DNA, 755 bp, Zea mays
  misc_feature: Ceres CLONE 1525361
  misc_feature: Encodes the peptide sequence at SEQ ID NO. 61870
aagctggagctccccgcggtggcggccgctctagaactagtggatcccccgggctgcaggaattcttctcacccctagaaaaagtgtcccaggtcatatcatccctgactgcctccttgaggttcgatggtgctcttaacgtggatgtgaatgatttccagaccaacttggtgccctaaccgaggatccacttcatggttttctcctatgctcccgtcatctctgctgagaaggctaccacgagcagctgtctgtggcccagatcccaacaccgccttcgagcctccctcctgatgggcaaatgcaatccccgccatggaaaatacatgggctgctggctcatgaacccggaaaatttcgcccccaacgatgtaaatggtggtgtggcccccattaaaaaccaaccgcccctcccattttgggggatgggtgccaaattggtttttaaattgggctttactcaccacccctccaatgtggggcccctggggtggacctgggcaaatggcaaccaacgctgcggcagttatactctccccccccccacagggtgggtggagagggttctcccgcgaataaacccacaattcccacctcattattcaccaaacattccctttaggaaactggatagtgtgggcagaggatataacaaaggaccaattctccttcacaacccgaaagaaaatgcgtggcctcttctacagaagctaaccacgatcttgtgggcctcatattaaacaaatgctgaaaga

SEQ ID NO: 61870 - protein, 58 aa, Zea mays
  misc_feature: Ceres CLONE 1525361
AGAPRGGGRSRTSGSPGLQEFFSPLEKVSQVISSLTASLRFDGALNVDVNDFQTNLVP

SEQ ID NO: 61871 - DNA, 802 bp, Zea mays
  misc_feature: Ceres CLONE 1525364
  misc_feature (410)..(410): n is a, c, t, g, unknown, or other
acaagctggagctcaccgcggtggcggccgctctagactagtggatttcttgggctgcaggaattcgtctcacccctagggaggagcttgccaattgccattgcactgcgcgcgcgcacctcacatccgccgccagcaggtgccaccgccatctctgctttctctctctctctctctctctctctctcaagcaacgcccgcctgcccgcccgccatggcgaccatagccacgatggccctgttgaagcccgccaggatcgtggagcggtcggcgcctccgtccaccagcggcagcgtctttcctgcgcttctcgggcccgtgaccaaaaagggccgccgcggccgctgttcgtgtctttccgcgctggtgggagcctttctttcccggcccttacacttcactcaaaaanccaccccccccccccgtagcccccatggccacaaatttagccgcccgccggcccaaacctccgtggatgtgcaacaacccaagggcgccgccttctgtctcttttttttcgggttgcttcccccccccctttctgtggcggcgctcctctctatacaccctccgctcatgccctcattttctgaaagcgccccctttaccgctcctttgcacctcccaccacgtacgccgttcccctcctcccccgggtctcttacgccccactcacaccctcctcttgcggtgttgagttccacactctccatattactcatactccccatgctttcgttactagcagacccacctgtatgtcttcgctcctcgctatagcaaccaccttctcatccttca

SEQ ID NO: 61872 - DNA, 693 bp, Zea mays
  misc_feature: Ceres CLONE 1525365
  misc_feature: Encodes the peptide sequence at SEQ ID NO. 61873
  misc_feature (104)..(104): n is a, c, t, g, unknown, or other
acagctggagctccccgcggtggcggccgctctagaactagtggatcccccgggctgcaggaattcgtctcacccctagaaaaacgcaggcagaggcagcatancagcagccagctccatccatcctctttcccctcctcgcttcgcttcctcggcggattcctcctccctcgaccgtccccgtccccgtccccttccggcgcgcaagctcgcccgagatggcaaacgcgagatcgggtgtcgctgtgaatgacgagtgcatgctcaagttcggcgagctgcagtcgaagaggctgcaccgcttcctaactttcaagatggacgacaagttcaaggagatcgttgtggaccaggtcggggatcgcgctaccggcgacgaggacttcacaaacagcctcccctaaaatgactgccgatacgcgatctatgatttccactttgtcactgcagaagaagttcaaaaaagcaggatcttctatatcctatggcccccatcctcccccaggggaaaaacaaaaatctttttgccacctcaaacaaaaaattcaagagtgggctcatggggtttccgggggaactccaggttactgatgccaataaaaaccactcttaagaaaatcaggattgggttttccaaggctttatcctgatattgggctcagggaattggctctttttttggggattttcatg

SEQ ID NO: 61873 - protein, 61 aa, Zea mays
  misc_feature: Ceres CLONE 1525365
MANARSGVAVNDECMLKFGELQSKRLHRFLTFKMDDKFKEIVVDQVGDRATGDEDFTNSLP

SEQ ID NO: 61874 - DNA, 686 bp, Zea mays
  misc_feature: Ceres CLONE 1525367
  misc_feature: Encodes the peptide sequence at SEQ ID NO. 61875
  misc_feature (269)..(269): n is a, c, t, g, unknown, or other
  misc_feature (277)..(277): n is a, c, t, g, unknown, or other
tggagctccccgcggtggcggccgctctagaactagtggatcccccgggctgcaggaattcgtctcaccccctagaaaaaaacgctctccgccgccacttctcctccggcatcgacgaggcgaagccccagcgcccgagtccctctccctgctcccacgacccatggcggcggatatggcgtacgcgccgccgatgaaggcgggcaaggccgggttcgaggctggcatgatggatccgcagcacaggatccgcatcacgctctcctccnagagcgtncagaacctcgagaaagtctgcggggatctggtgaagggcgccaaggggtaggagctcaaggtcaaggggcccgtgcggatgcctaccaaggtgcttcacatccacaccagggagtcttccctgttgagaaagtaccaacccctggggatcgcttttgagatgaggaattcccaagaggggggatcgatctccctccggaccccccgacgtttggcaaggagaatccccctcaatccccccttgaacccaggggttccagggttaaagtgaacttttcaggggacccttaaaaatgggaaggccttttctcttttcaaaagagggttctttaggggaacagggaattttttccaattcccccatgtggagaaatttttggtaaaccaaggagattcccaggtgtttttta

SEQ ID NO: 61875 - protein, 54 aa, Zea mays
  misc_feature: Ceres CLONE 1525367
  misc_feature (36)..(36): Xaa is any aa, unknown, or other
MAADMAYAPPMKAGKAGFEAGMMDPQHRIRITLSSXSVQNLEKVCGDLVKGAKG

SEQ ID NO: 61876 - DNA, 709 bp, Zea mays
  misc_feature: Ceres CLONE 1525370
  misc_feature: Encodes the peptide sequence at SEQ ID NO. 61877
aagctggagctccccgcggtggcggccgctctagaactagtggatcccccgggctgcaggaattcgtctcacccctagaaaaagcagcagtctggatctccaaccccatctccggagccctcgccgtcggtcggcggaggcaagtggtgcgtggccaagtccggcgcgagcgcaaccgacctgcagaacaacattaactacgcctgtgcctacgtcgactgtaggccgatccatagcggcggcgcgtgcttggaccccaacaacatccactcacatgcctcgtacgtcatgaacgcgtactaccaggccaatggcatgcacgactatgactgcgacttcaatggcacctgcgtggtcacctccagagaccccagttacgggagctgcaaatacaacgcctcctcctgacggctcgcagttagtccagctggcactactgcaccagcctccagtccacatcgtccttcagctccaggcgtctacccatggacaccctggggactgggagagttccgtactggcaactgccttgcacccatacttggatacccctgtctaaaacccctgcttcttgtgcctcccaaccccactagcccttctcatgtgtcagataccaaattaaaaggcccctcccccccccggttaactgaaaccattgcccaggggaaggaactaggggggggaaaaaaaaaaacctcccattcccggg

SEQ ID NO: 61877 - protein, 39 aa, Zea mays
  misc_feature: Ceres CLONE 1525370
  misc_feature: SWISSPROT Homolog: EC 3.2.1.39 Glucan endo-1,3-beta-D-glucosidase
MNAYYQANGMHDYDCDFNGTCVVTSRDPSYGSCKYNASS

SEQ ID NO: 61878 - DNA, 734 bp, Zea mays
  misc_feature: Ceres CLONE 1525371
  misc_feature: Encodes the peptide sequence at SEQ ID NO. 61879
  misc_feature (734)..(734): n is a, c, t, g, unknown, or other
tccccgcggtggcggccgctctagaactagtggatcccccgggctgcaggaattcgtctcacccctagaaaaagccacctgctgcagcttctcaaccggataggtagcaccggagcaggtagaacgctgcacaatccccttcgccgccgccaagatggtgaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtggcagagcctgcaacactactcacagcacgccatcaagagatgcaagcattttgagatttgtggagacaagaagggcaagggcacatctcttttctaaccttctcgtccacctgtctggttgttgagttgaagctgggggtctactactacgggtataaaaaactgtcccccaaatttcaatggtaagggaacaatgaaaaccaaacatgccttggttacccaaattcccatggccgagaatttggtcccggaggggttgggcccaactttttggcgtaaaagagaaattttcgccacctcgggaaaaaaaaaaaaaaaaaaccgaaaagccctcgaagggaccccattttcccccctan

SEQ ID NO: 61879 - protein, 105 aa, Zea mays
  misc_feature: Ceres CLONE 1525371
  misc_feature (19)..(95): Pfam Name: Ribosomal_L44 Pfam Description: Ribosomal protein L44
MVNVPKTKKTYCKNKECKKHTLHKVTQYKKGKDSLSAQGKRRYDRKQSGYGGQTKPVFHKKAKTTKKIVLKLQWQSLQHYSQHAIKRCKHFEICGDKKGKGTSLF

SEQ ID NO: 61880 - DNA, 708 bp, Zea mays
  misc_feature: Ceres CLONE 1525373
  misc_feature: Encodes the peptide sequence at SEQ ID NO. 61881
  misc_feature (346)..(346): n is a, c, t, g, unknown, or other
  misc_feature (363)..(363): n is a, c, t, g, unknown, or other
  misc_feature (375)..(375): n is a, c, t, g, unknown, or other
  misc_feature (437)..(437): n is a, c, t, g, unknown, or other
  misc_feature (479)..(479): n is a, c, t, g, unknown, or other
  misc_feature (581)..(581): n is a, c, t, g, unknown, or other
ctccccgcggtggcggccgctctagaactagtggatcccccgggctgcaggaattcgtctcacccctagaaaaaaaccaacgaagaacaagccttccacccagctagcgcatccagagcaagcgatcgagcgagctctctcggcttgctagctagctccattatatataacatcgatcgcttgatagtttttggtagctagaaagaagagagagaaagagcagctagctagtacagggatggagaagatgaacgtggttgcgagcaggaagcagcagggcggcgactggatctgccggtcgtgccagtacgtgaactttctgcagcgcgacgcgtgccagcgctgncgcaagcgaaactgggncgtgagcgaacngactacggcgcgctgggcggcaactgggacgtgaagcccgcgactggtactgctaccgctgncgcgtgaacactacgcctcccgcgccggctgcttcaagtgcngcgcccgcaagaacgagtctccgccggcccgcgtcgcgcaggggtggggctacaccgccgcccggcaggccggaatgaagcccgccgactggatctgcccangactgggctgcaacgtgcaaaactacgcccaccgaaaccgagtgcttccggtgcagcatgcccaaatcatactacggttgataggccactgcccgtaccctgatcgatgaaaggaaaaaaaaacata

SEQ ID NO: 61881 - protein, 56 aa, Zea mays
  misc_feature: Ceres CLONE 1525373
  misc_feature (36)..(36): Xaa is any aa, unknown, or other
  misc_feature (42)..(42): Xaa is any aa, unknown, or other
  misc_feature (46)..(46): Xaa is any aa, unknown, or other
MEKMNVVASRKQQGGDWICRSCQYVNFLQRDACQRXRKRNWXVSEXTTARWAATGT

SEQ ID NO: 61882 - DNA, 697 bp, Zea mays
  misc_feature: Ceres CLONE 1525374
  misc_feature: Translation starting site: 251
  misc_feature (403)..(403): n is a, c, t, g, unknown, or other
aagctggagctccccgcggtggcggccgctctagactagtggatcccccgggctgcaggaattcgtctcacccctagggagcttccactgcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggaagacgaggagccgcggcancaggcggaggccgtgacggtcacggccgtggggcccagcctcgcggaccggttccggagcaggttccggccgtcgcgctacgggcggggccgggggcggggactgccgcgtgtgcctggtgcggttcgagacggaatcgggggtgcaacggctccccctgggccacctcttccaccgggcctgcctcgagacctggatccactaccaacacgccaactggcccgctgggcccgcaccgcctcctgccccccgccggttgccaccaaaaaggtcccccggaattcccgattaacc

SEQ ID NO: 61883 - DNA, 817 bp, Zea mays
  misc_feature: Ceres CLONE 1525375
  misc_feature: Encodes the peptide sequence at SEQ ID NO. 61884
  misc_feature (1)..(1): n is a, c, t, g, unknown, or other
  misc_feature (427)..(427): n is a, c, t, g, unknown, or other
naaaagctggagctcaccgcggtggcggccgctctagaactagtggatttcttcggctgcaggaattcgtctcacccctagaaaaaaaaccacaacgcaggacaagccatcgccccgatggacaccgccgcctcatgccgcctcctctcgccggcctcctcctctccgcccccctgtccgaagcagctacccaagcggcgaccgaccttcgcggcctcgcagcagcagtcgcccagctccagcgccaagttcaggctcctctggctcctccatgacaagcccgcctcgcccaccacgggcgtggaagatgcataactcccatttcccagttccacacgcccgcgcaaccgcgtctgcaaaggcggagattttttgggggcatatggtcgcgggggcgtgcgcgtcctctttgtacccgatatttaanaaacccccccccccggttgccacagctaatgagatcctggcgccgccgatccccgcgcttcgttaggttactttcctatcaaatctccctacgggccgccttcctgtcgcggtgtaagtgccgtgcaccacgtgacaccccctgccctaccgtgtttctcccccccctcgtcttcccctctttaaaagctgcggcaaacattgaccacttccgaggatactcaccatccgaacccccttgccctagctcgccgcctaacgactccgcgcgcaacaactctctaccggcccataaaggcacaacgcgccccagtgcgcacccccccctccttgaaacacgtacgaatcccacattttaagcgggctccattcttcccccgtcctgccctaa

SEQ ID NO: 61884 - protein, 65 aa, Zea mays
  misc_feature: Ceres CLONE 1525375
MDTAASCRLLSPASSSPPPCPKQLPKRRPTFAASQQQSPSSSAKFRLLWLLHDKPASPTTGVEDA

SEQ ID NO: 61885 - DNA, 631 bp, Zea mays
  misc_feature: Ceres CLONE 1525379
  misc_feature: Encodes the peptide sequence at SEQ ID NO. 61886
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
ggagctccccgcggtggcggccgctctagaactagtggatcccccgggctgcaggaattcgtctcacccctagaaaaagtcgggtcttcaagccacaccaaaccacactgcgacacacagtaggcgaggcgaaggagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcaggccgaaatagggctatactgttagctaatgctagtgagatcgcttgacactttgagtgcatatcatggaagctggacatgcagttcctggcattttggttccccccacgttttaatctgctgaattagtaaatcctggagaattcaaaagcgttttcaagtactgcagtgtgtgttctgtctatgttctcaatctaatctcaagcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 61886 - protein, 37 aa, Zea mays; identical to SEQ ID NO: 60895
  misc_feature: Ceres CLONE 1525379

SEQ ID NO: 61887 - DNA, 727 bp, Zea mays
  misc_feature: Ceres CLONE 1525381
  misc_feature: Encodes the peptide sequence at SEQ ID NO. 61888
  misc_feature (727)..(727): n is a, c, t, g, unknown, or other
aaagctggagctccccgcggtggcggccgctctagaactagtggatcccccgggctgcaggaattcgtctcacccctagaaaaagaagaagaccagttcccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgccagcggcttctccgcgaagctcaccccccagcaggtcaaggatctcaaggagcaaccaggtgttctccaggttgtgccgagccaaactcccccccttcttggcccctgggtctggcactcaccaggggcacgacccacaccttgggccttatgtgaagggcgtatgagaatcaagaagacttttgtttagtatgggttgtatggcccaggtcttaaccaaaggtgtatagtaccattacctatgtaaagaataaggggacgttttcgtctattttcccggctttttccacatgcttccgccccttgtttctaaagcttggaaatggcgaccaatggccgtactgttttctcataacaatggagccagtatttgcctaaaacaaaaataaaaagaaaactaaggcccccn

SEQ ID NO: 61888 - protein, 123 aa, Zea mays
  misc_feature: Ceres CLONE 1525381
  misc_feature (17)..(94): Pfam Name: Subtilisin_N Pfam Description: Subtilisin N-terminal Region
  misc_feature: SWISSPROT Homolog: EC 3.4.21.25 Cucumisin
MAAEPEKQAAPAAQETAVHIVYVDRPEDADPEEFHIRTLTPVLGSEQKARDAVLYHYKNAASGFSAKLTPQQVKDLKEQPGVLQVVPSQTPPLLGPWVWHSPGARPTPWALCEGRMRIKKTFV

SEQ ID NO: 61889 - DNA, 692 bp, Zea mays
  misc_feature: Ceres CLONE 1525382
  misc_feature: Translation starting site: 144
  misc_feature (465)..(465): n is a, c, t, g, unknown, or other
aaagctggagctccccgcggtggcggccgctctagaactagtggatcccccgggctgcaggaattcgtctcacccctagaaaaaatacagctgctaccaatgctttccgtggattgcaagattttggtttctacggcaaaaaaatgcgagtacaatatgcaaaaacaaaatcagactgtattgcaaaagaagatggtacttatgcacctaaggagaaaaggaagaagcaagaggagaaagctgctgagaaaaaacgacgaacagaagaggcacaacaagctggcctcaatgctgctgctgcccaaagcaatggaactggctatcaagcgtctcgtctgggcaaggcttcacaggagccacctgcgcctccgaacaacatcctcttcatccagaatctgcagaccagaccacgagcatgatgctccagatccctgtccagcagtaccctggcttccgggaagtacngatgatcgaagctaaaccaggcatcgctttttggtgatttcaagacgatggccagtccatggtcgcgatgcaggctctccaggcttcaagatcaccccgaagaacccatggcttatatctaatgcaaaaaatgaaaccctagggggactctggaaccgctttggtttcgggaccctagtattgatccaaatccccattggcctaagggggaattggggggaaattat

SEQ ID NO: 61890 - DNA, 672 bp, Zea mays
  misc_feature: Ceres CLONE 1525383
  misc_feature: Encodes the peptide sequence at SEQ ID NO. 61891
  misc_feature (410)..(410): n is a, c, t, g, unknown, or other
  misc_feature (446)..(446): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
tggagctccccgcggtggcggccgctctagaactagtggatcccccgggctgcaggaattcgtctcacccctagaaaaaaaaagcaaaagcaacaaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcctcgccccngcgatgcgcacgagagtcgagaggaagaggacgacnacnnnagcgtataatataatagcggcgtccagtaaataagatccctgtcactgcacccgccattatccatggtcgctcgctcctcgcctgcgtctctgggtctgggggtcctctgaacgttctcccggtttcagacggcgatgcgcctccgtcgatcctggcgtcttcggccgaattaaaataaaacaaaaggcggtttttccgcgttattactaaaaaaaaaaaa

SEQ ID NO: 61891 - protein, 83 aa, Zea mays
  misc_feature: Ceres CLONE 1525383
  misc_feature (1)..(82): Pfam Name: Metallothio_2 Pfam Description: Metallothionein
MSSCCGGKCGCGSSCSCGSGCNGCGMYPDVETAATSSVKTTVLAAPTTKASAGGFEAATEGGGCDCNTCKCGTSCGCSCCSCN

SEQ ID NO: 61892 - DNA, 750 bp, Zea mays
  misc_feature: Ceres CLONE 1525388
  misc_feature (1)..(1): n is a, c, t, g, unknown, or other
  misc_feature (138)..(138): n is a, c, t, g, unknown, or other
  misc_feature (412)..(412): n is a, c, t, g, unknown, or other
  misc_feature (469)..(469): n is a, c, t, g, unknown, or other
  misc_feature (473)..(473): n is a, c, t, g, unknown, or other
  misc_feature (474)..(474): n is a, c, t, g, unknown, or other
  misc_feature (514)..(514): n is a, c, t, g, unknown, or other
  misc_feature (515)..(515): n is a, c, t, g, unknown, or other
  misc_feature (521)..(521): n is a, c, t, g, unknown, or other
  misc_feature (522)..(522): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (575)..(575): n is a, c, t, g, unknown, or other
  misc_feature (590)..(590): n is a, c, t, g, unknown, or other
  misc_feature (687)..(687): n is a, c, t, g, unknown, or other
  misc_feature (688)..(688): n is a, c, t, g, unknown, or other
  misc_feature (729)..(729): n is a, c, t, g, unknown, or other
  misc_feature (730)..(730): n is a, c, t, g, unknown, or other
  misc_feature (750)..(750): n is a, c, t, g, unknown, or other
nactgctggagctccccgcggtggcggccgctctagactagtggatcccccgggctgcaggaattcgtctcacccctagaaaaactccactaccccactcccaggagccgcccaggtacgtcgccggcggcgatgacnacccgcttcaagaagaaccgcaagaagcgcggccacgtgtccgccgggcacggccgcatcggcaagcaccggaagcatcccggaggtcgccggaaccccggtgggttgcaccaccccctcatctccttcgagaaggcccgtcccgggttccgtcggaagagggcgcattgccctcctccccaaaggtccccccacaggttctagtgccccggcggcctttttttttcccccccccccgcggggggggcggggccaaacctttaccttatatttnatcccacgggggccgcctcggccgccgcgaccgccattccccgccgcccgcggcggngggnnggggggcctacgagtgcgcgcccccgtgtccccccgcggnnccacgnnttccggtctcgctccgcgcctcgccgcggccctccctgccccccgcggnnnantccgagagtaggggncaggccggctctctacggtaccgccgcctgcccgtaccgccttcatggagggcggcgcgcggcggcgcgcgtttctctcccccgcctgcgcctcgtnngtcccctcaccgcccatcgggagcctccgccggcgtccccnngccttccatacggcgccgcn

SEQ ID NO: 61893 - DNA, 688 bp, Zea mays
  misc_feature: Ceres CLONE 1525389
  misc_feature: Encodes the peptide sequence at SEQ ID NO. 61894
  misc_feature (601)..(601): n is a, c, t, g, unknown, or other
  misc_feature (622)..(622): n is a, c, t, g, unknown, or other
ctccccgcggtggcggccgctctagaactagtggatcccccgggctgcaggaattcgtctcacccctagaaaaaaccttcgtctgtagtctcgtctcgtccacctccccagcggcgcgtgaagcttgaagcaatccccgccctctctagccctgcgcaaccagttcggttccatggccaacagcaatctcccgcgccgaatcatcaaggagacgcagcggcttctcagcgaaccagcaccggggattagcgcgtcgccgtcggaggagaatatgcggtacttcaatgacatgatccttggccccgcgcagtcaccctatgaaggtggagttttcaagcttgaactattcttgcctgaggaatatccaatggctgccccaaaagttagatttctcacaaaaatttaccatcctaatattgacaagcttggtaggatatgcctcgacattcttaatgacaaatggagtccagctcttcagatacgtacagatctactgagcattcacgcacttctgatcgccacaaacccagatgatgctctctcagacaacattgcgcaacactggaaaatcaacgaagctgaagcatgtgagacagcgaangagtgaactcgcctgtacacnagtggtgcatgacagccaagtgttgttccagatgtaacagcacttccatagtttggggtcgaatga

SEQ ID NO: 61894 - protein, 144 aa, Zea mays
  misc_feature: Ceres CLONE 1525389
  misc_feature (9)..(144): Pfam Name: UQ_con Pfam Description: Ubiquitin-conjugating enzyme
  misc_feature: SWISSPROT Homolog: EC 6.3.2.19 Ubiquitin--protein ligase
  misc_feature (143)..(143): Xaa is any aa, unknown, or other
MANSNLPRRIIKETQRLLSEPAPGISASPSEENMRYFNDMILGPAQSPYEGGVFKLELFLPEEYPMAAPKVRFLTKIYHPNIDKLGRICLDILNDKWSPALQIRTDLLSIHALLIATNPDDALSDNIAQHWKINEAEACETAXE

SEQ ID NO: 61895 - DNA, 945 bp, Zea mays
  misc_feature: Ceres CLONE 1525391-R
  misc_feature (945)..(945): n is a, c, t, g, unknown, or other
cgagcgtctcgtttttttttttttttttcggttttttttttttttttttttttttttagattgtttaattcactttcctcttgttttggttattaaggttttttctttcgtttttatttagtgcgaagaacgatatgaactggctagctcgtactagtgcgcatgataccacgattgggaggctatacatatgcatgcaatacatgactgtgcaggggttgaaattttattcgctgaacatggacgtgtacttgacctccggagcgctggggtttgctatggcctggggcgcgctgcggacgaagcccgggggagccttcttgtcgtaggggccgcctacagtaggggtaggtggtgaacttgtagggccttttggggcacgtggggaggttcttgggggaagacttgagaacgccccccctcttgggggggtgggggaagcgggcgccctgtgggaacgctttgctcttttgggcggagggccttctgggaggggcagggcttcgttgggggggccccctttggccgccgccccccgcgagcggggggagtattaaaccgccctggtgaaagattacggggggggggcgcgtgggtcgctcctcctttgtttgaggttgggggggacttgggataggtggggggaaggaacccctctgatttttggtggggggatatcgcccccccccgagaggggagtagagattcccgggggcggcccgcgcatgcgtcttgtcgaggggggggagaaccgtgtgggggggggtctctctcggcgtgttgggcgcaagaccgcagccaacggttctggtggtgttagaaaggcgggcgccgtcaggaaagtatgaattttgcttggcgtttagggggtgaaggtagtatagtgttcgcgggtatgtttgttttaagagcgcgcgggatgaagaaaggccgctcgcgtattcn

SEQ ID NO: 61896 - DNA, 658 bp, Zea mays
  misc_feature: Ceres CLONE 1525391
  misc_feature (303)..(303): n is a, c, t, g, unknown, or other
ctggagctccccgcggtggcggccgctctagaactagtggatcccccgggctgcaggaattcgtctcacccctagaaaaaagcagcagcgcacgtgcttcacactacttacataattgtcgtcttactactactgatcgagtggtgactatggtcgttgtgctgaacagtaggtagacgccgaaggtgattgccgtgctggtggcgccggcgctgctggctgcgtccgcttcagctgcaatcacctgcgggcaggtgcgtgcgtctctggctccatgtgtcccatgcgcgacgggtagggccnacgagctccccgcttcatgttgcgacgacgtcaccactctcaacagcgcacatcggaccaacgatgacctgcaggcggtgtgacgctccctctgaagactcgccgacagcgtatacaccgtctgaataggcaccgtctcaaccatccccagaaagtgtggcgtctcacctcggattctccatccccatgtccacctactgcacctcgatcacctcagttataccaccaacatgctaatatacctaccgtacgtactcgtacgttacgcgtagctgcgcgagtgctgacgaccagggaagactagcggtattcttcctgtaatggccggaagcccatggcagactccatctattct

SEQ ID NO: 61897 - DNA, 689 bp, Zea mays
  misc_feature: Ceres CLONE 1525392
  misc_feature: Encodes the peptide sequence at SEQ ID NO. 61898
aaaactggagctccccgcggtggcggccgctctagaactagtggatcccccgggctgcaggaattcgtctcacccctagaaaaaacacgtggattggctactccttcaccttcgggagtcctgacggcttctgacgtgttcggagttggtatgtcttgtagtgcatggattgaaatggcgccgtcgtatgtagattagcggtggtttctcggcgggctcgactgatgctccggacgactagtagctccagaatctctttagctacctgtcgcttaggtactggagtccaacatccatcctgcgatcgtcagatctcgacgtctggcaccgttctacttcatcatcttctccacgaaagaggccatgcagaactacgtccatggtctgaaggcatcagagctgagaagcttgaacatctttctcgagtacttgcattccatccccagaccaggaggtttatctctgagaatattgtaggagcacattgagcaggttattacaaacatggccgacatattgatagctactgctgctacctattcgtcagttgtgactacaacgatcatgttggctaatctgcatgatttcaataacttagacgatatctatggtggatatttctcggcgcctcacctgggagatgcacctactgagtggcgggcgctgcactgcatgctcagcatgacatt

SEQ ID NO: 61898 - protein, 61 aa, Zea mays
  misc_feature: Ceres CLONE 1525392
MADILIATAATYSSVVTTTIMLANLHDFNNLDDIYGGYFSAPHLGDAPTEWRALHCMLSMT

SEQ ID NO: 61899 - DNA, 867 bp, Zea mays
  misc_feature: Ceres CLONE 1525392-R
aagcgtctcgtttttttttttttttttgctgcgcaagaagttcatttttttcttgaagattaacttaggataaggcctgacaggggtaacagcatccatcgatccgcagtccatgctggttgatgcatgggtctgctggagcctaggatgaacacagtactaacaactgacacaaagcgaccttgcaatctaaaagcgccgatgggctaacgacaaacatgagactaacaaagataaaccctctggactacggtaaacaacactgtagcgaacatgataacttggccgcgcggggcccaacgatcagatcctccagttcccgtcggagttgccgtagccgccgccacggttggcagcgccgtagccggcgacgccaatactgtaggcgccggcgccacggtagacgcggccgccaccgccgtagccgccgccgccatcagggcacccgccaacagggtagccgtctgctccacggacaccaacgtagccaccgacgccgtcttcacgggcgccgggggactgggcctcgttgaatgtgatgttgcggccgttcagatcacagccggttaggcccctggatgggagtccgggatctgcctcttcggggaagaaggtgacttaccctgaagccccggggaaactatggcgctcccggatgagggagaattttgggaccggaagacctcccctttacgatcctaaaggaattttagaaagaaatgggcctcccgggggctccgggcaggcctggcaaaaaaaacaggggggacccaaaaaaccggggggcccccaatcctgagccggaaaagctgttaaaacgggagccggggggaaacttttacaaaacctaaacccggagacggaggg

SEQ ID NO: 61900 - DNA, 687 bp, Zea mays
  misc_feature: Ceres CLONE 1525397
  misc_feature: Encodes the peptide sequence at SEQ ID NO. 61901
  misc_feature (667)..(667): n is a, c, t, g, unknown, or other
ctccccgcggtggcggccgctctagaactagtggatcccccgggctgcaggaattcgtctcacccctagaaaaaatccaccatcacacacagcaatccacacaagcacttcgacgtcacacgggcgctgcacacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaggtccacgagcgcagggagagcttcctcgccagggctaactgagcagcccgggcggccggcatccacgcccgttcgtgcctgcctgcgtgccttatgtatgtctgtgattgtgcagggtcatcgtacttggctagcgtacgtacgtgcacgcactcagctcctgtacgaattacgacaataagctcgtgacctgaataaaactttctcgtaatactaatacctacatcaccacgcaaaaaaaaaaaaaaaacgagacgctcgaggtacccnattcgccctatagtgagtcg

SEQ ID NO: 61901 - protein, 93 aa, Zea mays
  misc_feature: Ceres CLONE 1525397
MAYYQEVDYCSEEVRSVAPAGFGRHGGGVQQHVVKEKFEEVDTVARAGANHHHHHGHHGGHGFVVRETRVEEDINTCTGEVHERRESFLARAN

SEQ ID NO: 61902 - DNA, 684 bp, Zea mays
  misc_feature: Ceres CLONE 1525400
  misc_feature: Encodes the peptide sequence at SEQ ID NO. 61903
  misc_feature (463)..(463): n is a, c, t, g, unknown, or other
  misc_feature (466)..(466): n is a, c, t, g, unknown, or other
  misc_feature (533)..(533): n is a, c, t, g, unknown, or other
  misc_feature (545)..(545): n is a, c, t, g, unknown, or other
  misc_feature (597)..(597): n is a, c, t, g, unknown, or other
tggagctccccgcggtggcggccgctctagaactagtggatcccccgggctgcaggaattcgtctcacccctagaaaaaaccagcaacccccaacagcgccactgtccagtgcgcgcgtcaagcttgcttagctagccgccatggcctccctcgccgccgtctccgtgaagcccgtggccatcaagggtctcgccggcagctctatctccggaaggaagctcgccgtcgccaggccgtcggcccgctccatccgcaggccccgcgcagccgccgtggtggccaagtacggcgacaagagcgtctacttcgacctcgacgacatcggcaacaccaccggacagtgggacctctacggctctgacgcgccctcgccctacaacccgctacagagcaagttctacgagacgttcgcggctccgttcaccaagagaggtctgctgctcaagttcctgctgctgggcngcngctcacttctggcctacgtcagcgcgtcggcgtcaccggacctccctgcgatcaggagggacctcangagccgccgcantcgggcccgcgcgcaagatctaagctcagctactccatttggatggcctagnaaataactggctttggactgctagccgccggtgcaatccgtcccaatcgccatggtaaaaccctcatatttgttggtaccctatcaa

SEQ ID NO: 61903 - protein, 153 aa, Zea mays
  misc_feature: Ceres CLONE 1525400
  misc_feature (5)..(139): Pfam Name: PSI_PsaH Pfam Description: Photosystem I reaction centre subunit VI
  misc_feature (108)..(108): Xaa is any aa, unknown, or other
  misc_feature (109)..(109): Xaa is any aa, unknown, or other
  misc_feature (131)..(131): Xaa is any aa, unknown, or other
  misc_feature (135)..(135): Xaa is any aa, unknown, or other
  misc_feature (152)..(152): Xaa is any aa, unknown, or other
MASLAAVSVKPVAIKGLAGSSISGRKLAVARPSARSIRRPRAAAVVAKYGDKSVYFDLDDIGNTTGQWDLYGSDAPSPYNPLQSKFYETFAAPFTKRGLLLKFLLLGXXSLLAYVSASASPDLPAIRRDLXSRRXRARAQDLSSATPFGWPXK

SEQ ID NO: 61904 - DNA, 673 bp, Zea mays
  misc_feature: Ceres CLONE 1525405
  misc_feature: Encodes the peptide sequence at SEQ ID NO. 61905
  misc_feature (371)..(371): n is a, c, t, g, unknown, or other
  misc_feature (372)..(372): n is a, c, t, g, unknown, or other
gcggtggcggccgctctagaactagtggatcccccgggctgcaggaattcgtctcacccctagaaaaaaccattacctcaccactccgcggtagctgaggacggtacagcggcccagaggtgcgacgtacgacgacaactacccagggggcgggcgtggcatcctctgtctccgccgcactgtccttgtatacaagacttccaggtcaaaccacgacgagaccacctctctcgtgcatatccatgggctcaacaccaacgaagatgtcttctgctacgctggcaagcgcatgacatctatcttcctgccgaaacccggacctatgacacccgctatttttttctcccccccaaggggggcacgacggggcnnaaactctttattctttcctcccccccccatgtaaaacctcccaccttagtcctgggcgcgcagggtcaaagttttcctgtcccctagcaccatctaacgttttctcgcattaaagatcgccttaaaaatggccttgtgttcattgcccccattttcactcaaactaaaaatgccttgtggtcgtcacgttagatttttcatgaagcctaccctcggggcaatttgtgtccaaaattttgatggcccaacccctgacactattctccttaaaggtcattcccgccaccccaaactctgagtt

SEQ ID NO: 61905 - protein, 56 aa, Zea mays
  misc_feature: Ceres CLONE 1525405
MALCSLPPFSLKLKMPCGRHVRFFMKPTLGAICVQNFDGPTPDTILLKGHSRHPKL

SEQ ID NO: 61906 - DNA, 673 bp, Zea mays
  misc_feature: Ceres CLONE 1525406
  misc_feature: Encodes the peptide sequence at SEQ ID NO. 61907
  misc_feature (450)..(450): n is a, c, t, g, unknown, or other
ggagctccccgcggtggcggccgctctagaactagtggatcccccgggctgcaggaattcgtctcacccctagaaaaacaccaaaggtatcttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaacggcaagacggtcgcgaccatcgtgggtgccnagaaggacgagctcctggccctgatcgagaagcatgccgcgcctgcgcctgcgactgcgtctgcctaatgagatcagatcagtcgtcgcccgtcataaggggcagcacgtatggctgtaaatgggtgtcgtatcagttctggcttttgtcgttggtgggcgatttgtggactagtagtatgtttgttttcatcgagccgggaggcgaactttacccaaaaaaa

SEQ ID NO: 61907 - protein, 122 aa, Zea mays
  misc_feature: Ceres CLONE 1525406
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (101)..(101): Xaa is any aa, unknown, or other
MASEQGVVIACHSKAEFDAHMTKAQEAGKLVVIDFTAAWCGPCRAIAPLFVEHAKKFTQVVFLKVDVDEVKEVTAAYEVEAMPTFHFVKNGKTVATIVGAXKDELLALIEKHAAPAPATASA

SEQ ID NO: 61908 - DNA, 711 bp, Zea mays
  misc_feature: Ceres CLONE 1525407
  misc_feature: Encodes the peptide sequence at SEQ ID NO. 61909
  misc_feature (466)..(466): n is a, c, t, g, unknown, or other
  misc_feature (487)..(487): n is a, c, t, g, unknown, or other
  misc_feature (520)..(520): n is a, c, t, g, unknown, or other
  misc_feature (521)..(521): n is a, c, t, g, unknown, or other
ggagctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgatttatatctatctagcttgtggtggtggttgaaacataaaatagcgagccgagcntgctgccatacataggaattngtgtgtgtgtgaaaaaaaagagaaaaacagagnntcttcagtttgctatctctctcttctgcatgtttgggcgtcagtctttgtgctcatgtacgtgtggcaacatgcatgtttggttgatcccaatggcccctggctggaaccaaatattaaattgggccaacaaggaatggaatttggaccctttttttttttttttttcccaaaaaaaaaaaaaaaaacca

SEQ ID NO: 61909 - protein, 76 aa, Zea mays; identical to SEQ ID NO: 42649
  misc_feature: Ceres CLONE 1525407
  misc_feature (1)..(76): Pfam Name: Metallothio_2 Pfam Description: Metallothionein

SEQ ID NO: 61910 - DNA, 685 bp, Zea mays
  misc_feature: Ceres CLONE 1525410
  misc_feature: Encodes the peptide sequence at SEQ ID NO. 61911
  misc_feature (626)..(626): n is a, c, t, g, unknown, or other
  misc_feature (648)..(648): n is a, c, t, g, unknown, or other
ggagctccccgcggtggcggccgctctagaactagtggatcccccgggctgcaggaattcgtctcacccctagaaaaaaaaagagcaacacaaggcaaggcagcacacgacccgcggcgacgcaagaagagaagccagcagtcgtctggatccatcgattgacatggccatggcggcggcagcggagggcaagagccggaggttcgcgctggcctgcggggtgctgagccagtacgtgaaggccgagcagcagatggcggccgccggggcccctgccccgcgcgccccggccacgacgctgagcctcatgcccggcgcggacgtcggcgccgagcaggagccggccgccgcgagggggcaggagacggccgggtccgcctccacggcggcgccgctcaccatcttctacggcggcagggtggtcgtgttcgacgacttcccggcggagaaggcagccgaggtcatgcccctcgcagctggcgccgagcgcccggcggccccggccccggcgccggcgccgcgcgacgacctgcctatcgcccggaaggcgtcgctgcagcggttcctggccaagcgcaggacgcctcgtggagcgcgccccctacgcccgcccgtcccatccgaangaggcgagaagcgaagccggcntccctggctcggctcggcggcacgacgcccagcgctc

SEQ ID NO: 61911 - protein, 174 aa, Zea mays
  misc_feature: Ceres CLONE 1525410
  misc_feature (155)..(155): Xaa is any aa, unknown, or other
  misc_feature (162)..(162): Xaa is any aa, unknown, or other
MAMAAAAEGKSRRFALACGVLSQYVKAEQQMAAAGAPAPRAPATTLSLMPGADVGAEQEPAAARGQETAGSASTAAPLTIFYGGRVVVFDDFPAEKAAEVMPLAAGAERPAAPAPAPAPRDDLPIARKASLQRFLAKRRTPRGARPLRPPVPSEXGEKRSRXPWLGSAARRPAL

SEQ ID NO: 61912 - DNA, 668 bp, Zea mays
  misc_feature: Ceres CLONE 1525413
  misc_feature: Encodes the peptide sequence at SEQ ID NO. 61913
ggagctccccgcggtggcggccgctctagaactagtggatcccccgggctgcaggaattcgtctcacccctagaaaaaagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgtaaggttaatccgaattctcaacccatgggtgcgcttccagtcgcagcgtctttagctaacaagctcgcatacatataggcaacttgagtgagctatgtagtacggatatggttgtgtggcaaactgccaatgactattgacatccttgcatatattgacatgggacaggatcaacctgcaaaatgggtgcctgctactcccagaccttataccctaaataacccgggtggggtgtttttccaaacaaaaaaagaaacgggacgcccggggttcccatttc

SEQ ID NO: 61913 - protein, 73 aa, Zea mays; identical to SEQ ID NO: 39404
  misc_feature: Ceres CLONE 1525413

SEQ ID NO: 61914 - DNA, 668 bp, Zea mays
  misc_feature: Ceres CLONE 1525415
  misc_feature: Encodes the peptide sequence at SEQ ID NO. 61915
  misc_feature (479)..(479): n is a, c, t, g, unknown, or other
  misc_feature (508)..(508): n is a, c, t, g, unknown, or other
ctccccgcggtggcggccgctctagaactagtggatcccccgggctgcaggaattcgtctcacccctagaaaaatccaaagcaagcagcagcagccggctccgcctcccgcagcagccacaccccgtccgtcaccagaggaagaggaagaggaggatgtcggggtcgaaggtgtacacccttgaggaggtggccaagcacaacaccaaggatgactgctggctcgtcatcggcggcaaggtgtacaatgtgaccaagtttctggaggaccaccctggaggtgatgatgtcctgctgtcttccactgccaaggatgataccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatncagatcctccagttttttgtccccctggncatactggggctggctgtttgctgtaggatctacaccaagtcggaatctggttagtcatctgaaccaaggtagcgagggttgcatcttgtaccagagtcgcatgtcaaaaacttgagtctttgctggctaccgttatttttaaatgaaacttttatcggg

SEQ ID NO: 61915 - protein, 135 aa, Zea mays
  misc_feature: Ceres CLONE 1525415
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
  misc_feature (108)..(108): Xaa is any aa, unknown, or other
  misc_feature (118)..(118): Xaa is any aa, unknown, or other
MSGSKVYTLEEVAKHNTKDDCWLVIGGKVYNVTKFLEDHPGGDDVLLSSTAKDDTDDFEDVGHSTTARAMMDEYLVGEIDAATIPSKVKYTPPKQPHYNQDKTPEFVXQILQFFVPLXILGLAVCCRIYTKSESG

SEQ ID NO: 61916 - DNA, 610 bp, Zea mays
  misc_feature: Ceres CLONE 1525417
  misc_feature (47)..(47): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
ggagctcaccgcggtggcggccgctctagactagtggatttcttggnctgcaggaattcgtctcacccctagaaaaacggcagctctgaagcgagaaagagatcgatcgtattcgtatccgcggaacaagcagcgaaggatcggagcctatccaatgggccgagggcaaggagccagcttcctggnnntgggcgaccctgttctccagcggaagccgtggcgggggcccccggtcgggtttccacaaaaaccgtggaaaactccccaaccggaaggtccccgggccggcggccgaactccttgaaccgggggtctttccaccccggacaccccccacaaaaaatccggccgggtatttgccccccaagaaatggcccgtaaggaaccccctacaaaaaacttttaacacccggggttttatgttctccacccccccccctgtaaaaaaatttttgttggccgcattaaaccccccactaaaacaacgcccattctccgtgattcctctggcgggaggtatctgatactcccccctccggtttatgggtgcgcccccgggggatgtttgctctccaccctattagttccgacaacgtgttcccatcccccc

SEQ ID NO: 61917 - DNA, 666 bp, Zea mays
  misc_feature: Ceres CLONE 1525418
  misc_feature: Encodes the peptide sequence at SEQ ID NO. 61918
  misc_feature (424)..(424): n is a, c, t, g, unknown, or other
  misc_feature (557)..(557): n is a, c, t, g, unknown, or other
ggagctccccgcggtggcggccgctctagaactagtggatcccccgggctgcaggaattcgtctcacccctagaaaaaattcccaatctcgtcttgtgttgttcggagcgggcagcagcacacagccccatcccaatcctagtcgatcttcttcccctcctcaaggaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatctgtcaggaaaacttcagcacaactgttaatgcactcactgagcctattgatatatatagtgaatggattgatgagtgtgagcgtgtncacactgttgaaggcgacgatgatgcgtgagcttgccccatgtgatgaaaactgtacctaccatcgtaatgtaatgtgctggtattctcggatggcatagcccatagtcagccatggcttgaaataacgtaantggctgactggaattgcccgtaggcccccttatcttgggactttacgaaacttccaaaaaggtttgggcctaatccttttttggggccaccctttaaaagggggggtag

SEQ ID NO: 61918 - protein, 89 aa, Zea mays
  misc_feature: Ceres CLONE 1525418
  misc_feature (8)..(68): Pfam Name: Elf1 Pfam Description: Transcription elongation factor Elf1 like
MGKRKSAAKPPPKKRMDKLDTVFSCPFCNHGSSVECRIDMKNLIGEASCRICQENFSTTVNALTEPIDIYSEWIDECERVHTVEGDDDA

SEQ ID NO: 61919 - DNA, 693 bp, Zea mays
  misc_feature: Ceres CLONE 1525420
  misc_feature: Encodes the peptide sequence at SEQ ID NO. 61920
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
ctggagctccccgcggtggcggccgctctagaactagtggatcccccgggctgcaggaattcgtctcacccctagaaaaaatcctctagagagagagaggaagcccgtcgttctggaagtttccacgctccgcgcctccgccccctggtctccgctccaatggcgccctcactcctcgccgccatgtccacctcgcccttcctagccagcagcggcagcagccgcaggccgctaggcgctgcccacacccgacgggctggactgcgcgtggccgcgcttaagtacgaccctgccaaggtggcgccgcagaacgaccgggttctcgtccgtcttgagcagatccctgagaaatctgctggcggtgtattgctaccaaaatctgctgttaagtttgagagatatctgatgggtgacattctatcgatcggtgctactgataggatctcatataagatgcaaaactgtcgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61920 - protein, 103 aa, Zea mays
  misc_feature: Ceres CLONE 1525420
MAPSLLAAMSTSPFLASSGSSRRPLGAAHTRRAGLRVAALKYDPAKVAPQNDRVLVRLEQIPEKSAGGVLLPKSAVKFERYLMGDILSIGATDRISYKMQNCR

SEQ ID NO: 61921 - DNA, 695 bp, Zea mays
  misc_feature: Ceres CLONE 1525422
  misc_feature: Encodes the peptide sequence at SEQ ID NO. 61922
tccccgcggtggcggccgctctagaactagtggatcccccgggctgcaggaattcgtctcacccctagaaaaaaaacaaaccatcggccaattccgaagaagaagaagcaacaggaatcgtagcagccaaggcaaccgtgagaatgggctccctgggtcctagcgtggtgaccctgcaagaacagcagcaacagcccaagccccgcaaaccggcggcggcgggcggcggctgccacgagctgtagcagcagagcagcaactgcggcgggtcgtcgttccggatgccgctgcactacccgcggtacaagaaggcggactacgaggccatgcctgagtggggcgtcgagtgtctggtccgcaagtacggcctctccgtctccggggaccttccccccaccccggaattcgccatgggcgccttcttctggcccggtcaatactgatgaactgtacgtttgatggagtcctagaatcaaccaccatttgcttaaggagtttaagattctccccccccgattcaccctttttccctaacttagacataagaacccagggatttcggaatagatccggcccgtttagggatctcatcctgaaaataatataaatttactgacgtttcctcccccgccttacggggaatcgtgggggaaacgggaattatcccggcttttttcaaaaacaaggggggcggg

SEQ ID NO: 61922 - protein, 53 aa, Zea mays
  misc_feature: Ceres CLONE 1525422
MPLHYPRYKKADYEAMPEWGVECLVRKYGLSVSGDLPPTPEFAMGAFFWPGQY

SEQ ID NO: 61923 - DNA, 673 bp, Zea mays
  misc_feature: Ceres CLONE 1525423
  misc_feature: Encodes the peptide sequence at SEQ ID NO. 61924
  misc_feature (406)..(406): n is a, c, t, g, unknown, or other
  misc_feature (532)..(532): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (668)..(668): n is a, c, t, g, unknown, or other
  misc_feature (672)..(672): n is a, c, t, g, unknown, or other
ctggagctccccgcggtggcggccgctctagaactagtggatcccccgggctgcaggaattcgtctcacccctagaaaaaatccctcgaaggccaaggtcaaacgcacccatggcgctcctcctctccccgccgatcgtatccttcgtctccccgtctgctcctcgctcccgacctatctccgctgtcgccaacgtctcattctctgcctcaaggctgcaatgcaagaacctgtcatccctacagagccctctgaacgtgactgctacttgcgcttctttcgccgagaagaggtcggctcctgtccatgccacggctgaggggtctgaggctggtgcggcggagcacccagaagaaccgaaacctgcgaccaagatcgaggaaatgccgctcgagtcgaagcaaangatgatcatggagcagagggcgcggatgaagcttgccaagaaactgagacagcggcgcaagcggctcgtctgcaagaggaagcttaggaagaaggcaggtggccatcgtccagatgaagagctcangaatgtatgaacggcaccgccaccctgccttgctttgtgtcgggtggtgccccgttacaattttcgctgtcagaactgagaccgatgctacgaattatattctgtttcatgtaaaaaaannnaaaaaaaaaaaaanaaana

SEQ ID NO: 61924 - protein, 143 aa, Zea mays
  misc_feature: Ceres CLONE 1525423
  misc_feature (99)..(99): Xaa is any aa, unknown, or other
  misc_feature (141)..(141): Xaa is any aa, unknown, or other
MALLLSPPIVSFVSPSAPRSRPISAVANVSFSASRLQCKNLSSLQSPLNVTATCASFAEKRSAPVHATAEGSEAGAAEHPEEPKPATKIEEMPLESKQXMIMEQRARMKLAKKLRQRRKRLVCKRKLRKKAGGHRPDEELXNV

SEQ ID NO: 61925 - DNA, 688 bp, Zea mays
  misc_feature: Ceres CLONE 1525424
  misc_feature: Encodes the peptide sequence at SEQ ID NO. 61926
  misc_feature (549)..(549): n is a, c, t, g, unknown, or other
ctccccgcggtggcggccgctctagaactagtggatcccccgggctgcaggaattcgtctcacccctagaaaagtgcccgcggtgctagtgacggttgctctagatccgttcatcctggtggttttgtgaggtcgaaagcggcgagcgaattagaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgacgccgtcgaccccgacgacgccggtgacgccgtcgtcgtcgacgacgccgcgcggcgccggcaacgtgtggcgcagcgtcttccacccggggagcaacctggccaccaagggcatgggcgccaacctctttcgactggcgcagcccaactccccctacgtctacgactggctctacagcgacgagaccaggagcaaccaccgctagatcgggcgagatggatggacagtgaagaagccatgtttgctggntctttgtggttatctaaaacgcacgcatgctctattatagctagtcatcactataaaaaacctggggttggggaattggtggtcctggtcggccgggggtctccgccgtttatttggacttatgttatggagggattga

SEQ ID NO: 61926 - protein, 115 aa, Zea mays
  misc_feature: Ceres CLONE 1525424
  misc_feature (5)..(115): Pfam Name: Auxin_repressed Pfam Description: Dormancy/auxin associated protein
MLDKLWDDVVAGPRPETGLEKLRKATTARPLVINKDADGGSYKRAQSTPSTPTTPVTPSSSTTPRGAGNVWRSVFHPGSNLATKGMGANLFRLAQPNSPYVYDWLYSDETRSNHR

SEQ ID NO: 61927 - DNA, 694 bp, Zea mays
  misc_feature: Ceres CLONE 1525426
  misc_feature: Encodes the peptide sequence at SEQ ID NO. 61928
  misc_feature (440)..(440): n is a, c, t, g, unknown, or other
  misc_feature (483)..(483): n is a, c, t, g, unknown, or other
  misc_feature (582)..(582): n is a, c, t, g, unknown, or other
tggagctccccgcggtggcggccgctctagaactagtggatcccccgggctgcaggaattcgtctcacccctagaaaaacacggcagctctgaaagggaaagagatcgatcgtatctgcggaacaagcagcgaaggatcggagcctatccaatggccgagggcaacagcagctccggcggcgacctgttctccagcggcaagctggtggcgggggccgccgtgtcggtgttccagcagaaaaacgtggagaacgtcgacaagcaggaggtcgccggcgcggcggccgagctcctgcacgcggcgtccgcgtacggtaagctcgacgacaagccggccgggcagtacgtcgagaaggccgaggggtacttgaaggagttcagcgcgggcgcgggacacgccaccgagcaggagcagccttgctgcgcagcaggcgacgacncggcgcccaagctaccgcgccggaggcgtctaaggagccggcngcggtgcctgcccccgccgcggagaagggcaacagtcctccgaggcttcggcctcggcgacttcatgaaggcccctaaacaacttgtgggaagaaacanccaggccccccggaaagaaaacccccgcccccctttggttttttaaaaaaggcccaggctttcctaaaaaaaatttgcttggccacgtttttcccagtcctatatacttcca

SEQ ID NO: 61928 - protein, 158 aa, Zea mays
  misc_feature: Ceres CLONE 1525426
  misc_feature (97)..(97): Xaa is any aa, unknown, or other
  misc_feature (111)..(111): Xaa is any aa, unknown, or other
  misc_feature (144)..(144): Xaa is any aa, unknown, or other
MAEGNSSSGGDLFSSGKLVAGAAVSVFQQKNVENVDKQEVAGAAAELLHAASAYGKLDDKPAGQYVEKAEGYLKEFSAGAGHATEQEQPCCAAGDDXAPKLPRRRRLRSRXRCLPPPRRRATVLRGFGLGDFMKAPKQLVGRNXQAPRKENPRPPLVF

SEQ ID NO: 61929 - DNA, 658 bp, Zea mays
  misc_feature: Ceres CLONE 1525517
  misc_feature: Encodes the peptide sequence at SEQ ID NO. 61930
aaagctggagctccccgcggtggcggccgctctagaactagtggatcccccgggctgcaggaattcgtctcacccctagaaaaaatgtctccttttcctcccaccattcctgtcacccacacagcacgtcggagtagcagtcgagctcggcatcagctcccttactgctcactttgcagcacctcgccagctccctggtaacgctctgcacctgccgtcgaactctctcaggttcggtcatccctgctcccttccaaatcagcgcccctccactcggctccgctactgtgtcgtgcgcgcgcttcctcccgcttccatcgctggatgtgtttgtgttgagatgccattcgaagttgatgatctgttcgtcgccaccggccgcaagcaccagtttcgatgaacgtgagaacgtcttaatcagttgatatgagttgaaaattgatgtgtcgatctgtggtttgacctagtgttctcggcatgtctatgttctggtcgaggccctagatacgtgattgaagatcttttgtggtgatgaaggtgaaatcagcatagcactccccaagcattctacagaagagcccccaacagaaggagtgaggattcaagatgaagtggtagctgaaaaaggattttgctctagtgcctgttcatccaatgg

SEQ ID NO: 61930 - protein, 66 aa, Zea mays
  misc_feature: Ceres CLONE 1525517
KAGAPRGGGRSRTSGSPGLQEFVSPLEKMSPFPPTIPVTHTARRSSSRARHQLPYCSLCSTSPAPW

SEQ ID NO: 61931 - DNA, 928 bp, Zea mays
  misc_feature: Ceres CLONE 1525527
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (726)..(726): n is a, c, t, g, unknown, or other
  misc_feature (833)..(833): n is a, c, t, g, unknown, or other
ttttttttnnnnttnnntnnnttgggttttttttcccnnttttcttnnnnnnccaagctggggctccccgcggtggcggccgctctagaactagtggatcccccgggctgcaggaattcgtctcacccctagaaaaaaaccctagaagcctccaccctcctgcgcctccaccctcctcgccgcctcactccctgtgaggtcgcagatccgtccggttagacgaagccgcccgcacccgtggcctccggtgaggtcgcctgggcctaggctgttgctcttcctcaccgcccacgggctctctcttcccttctcacatcacttccaccccctcgtgcacgccccgccccccccccgggggcgaccccccccggccacgcccacccatcctgtacggtttccggcgcaagcccgacgggggtaggggatttaaccccccccccccccggggggggggggggggggggcactactctcgcgatcttcccccctccccccccccttctgttttgtgggggtgggcccgagcgaggcggagggccgggcgcactcgggagcgcgcgcgccctcccgcccgccaccccttgctatccccccgcgtggattgtcgtgagttgtgtccgccgtcatcgttcgtgcccgtcccccccaggcaggcggagctcgcagacacgcgcgccccaacgcggcccagcggcccgccgtcccgcgctcccgatatctaagccnctctctccttctctagccgcgagcatcctctgccgccccccgctccccccccttctaggctttacatttgttgtcccttcctctcctctagccgcgcagatgacccntcattagatcgcgagtctaatcacgaccgcaaccaacatcgaaaagagagcgaaaaacgcagcgaacacagctggaccccgcacccacgccgccg

SEQ ID NO: 61932 - DNA, 871 bp, Zea mays
  misc_feature: Ceres CLONE 1525535
  misc_feature: Encodes the peptide sequence at SEQ ID NO. 61933
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (696)..(696): n is a, c, t, g, unknown, or other
  misc_feature (836)..(836): n is a, c, t, g, unknown, or other
  misc_feature (837)..(837): n is a, c, t, g, unknown, or other
  misc_feature (853)..(853): n is a, c, t, g, unknown, or other
  misc_feature (854)..(854): n is a, c, t, g, unknown, or other
nnnnnnnnnnnnnnnnnnnnnnngggggggggnnnnttttttttttttttcatagctggactccaccgcggtggcggccgctctagaactagtggatcccccgggctgcaggaattcgtctcacccctagaaaaatccaacccacacacaggctgaccccaccaacagcaagcgaaaatctcccgatcccctctagtctccgcagaaaatatgtcggggcgcgggaagggcgggaagggcctgggcaaaggcaaacccaaccgccactgggaggtgctccgcgacaacatccaggggatccctaatccggctatccggtggctggcggcgaaggtcctgttttaatcgaatcttcgggcttatttacaaggagaccccccggcgtcctcaagaatcttcctgggagaacggggaatccgcgaccgccggccccctaccaccgaggcgtcgcgccgcccgcaagaaccggtcacaagcctatgggactttcgctcatacacaccttggtggggcccatggggcctgttaaacttttttaacgtggttttgtggggggcttgagagttaaggccccgggttccgcagacctacatattgtgggtgcggcaggggggggtctcatattgcgaatttcctggcgaattccccgagagtgtgggtggggctaaagaagcggaagcaaaaattcttttggcnaaccgcgctccccatctaccttattctcggcggtggttgtgttgcagggtggccttgaagaaaaaaaggcgcccttttttgggaatgcttaccagggtttctgacacacaacaaatgggttttaacaataatgtttggtnntggtggcgcgccatannccatgcacacaactaca

SEQ ID NO: 61933 - protein, 44 aa, Zea mays
  misc_feature: Ceres CLONE 1525535
MSGRGKGGKGLGKGKPNRHWEVLRDNIQGIPNPAIRWLAAKVLF

SEQ ID NO: 61934 - DNA, 704 bp, Zea mays
  misc_feature: Ceres CLONE 1525585
  misc_feature: Encodes the peptide sequence at SEQ ID NO. 61935
  misc_feature (704)..(704): n is a, c, t, g, unknown, or other
ccccgcggtggcggccgctctagaactagtggatcccccgggctgcaggaattcgtctcacccctagaaaaattcccaatctcgtcttgtgtcgttcggagcgggcagcagcacacagccccatcccaatcctagtcgatcttcttcccctcctcaaggaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggggaaaaatcttgtaaaatctgtcaggaaaacttcagcacaactgtccccgccctcgggggggggggggattcatttcgtgaatgggtttgtttagtgttgacccttccacccctgtttgaaggcccaccatgaatgcggtaccgtggactttcgcccatgcctaaaaaaatggttcccttccaccccacaaggccaacgggcgtgggggcccccccaacaggccctatcccactttctgtgtccttagggtcttggaaattaaaattattggggtgtcagagaaggatttcccctgtgtgtccccaccgccttcgatcattcctgcgcgttccgccgctgtgtgtttgtcattttcctctgctgggcgaacccccacctgccagggccgcccn

SEQ ID NO: 61935 - protein, 88 aa, Zea mays
  misc_feature: Ceres CLONE 1525585
  misc_feature (8)..(68): Pfam Name: Elf1 Pfam Description: Transcription elongation factor Elf1 like
MGKRKSAAKPPPKKRMDKLDTVFSCPFCNHGSSVECRIDMKNLIGEKSCKICQENFSTTVPALGGGGDSFREWVCLVLTLPPLFEGPP

SEQ ID NO: 61936 - DNA, 821 bp, Zea mays
  misc_feature: Ceres CLONE 1525593
agacatggaggccgggggcgcccccccgcggccacaggggggggggggggggggggggcaaagcaagaggaccacgaggaagcagccggtctttaactagtggatcccccggggtggaggaattcgtctcacccctagaaaatcgcctccccacgcgagagagcccaacacgcaaacggaacgcttccgcgcccctccgccttatccgatggggtccctcagcaccacaacctcgctcaccgtggcgccctccgcggcggacaccaccggcccccggggggttcgtgcatatcctgccggggggcgggatcgaaacacccaagtgctgcggcggagcagaaaacgcaccgctggcgcgggcacccccgaggcaccgtcccggcggggcaagggaagtgccgaacccagtgcccgcgcggtaaaccgcccgccggccgtgcctcgcgacgtgtgccagagaagggagagaatcccccacccgcacacccccgtcgaaaaatctaagaaaggggggggaacacacaaaacagaacacaacaaagtaaggagcaagaaaaacaccaaaccacagatgggaccgaccgggcaaccgcagcacgcgcgggacacgcaggagcacaccataaaagggggggggcggaaaaggggggcgacaaaacaaacgagggggggggcgcaggggggaagaccaaacagccgaggggggggggggcaaacaaaagaccagggggggggcggcggcggcacacataggcggggaggagcagggagcggagaaccacacagggggagaacaacacaaaaagagcgggggggtgggg

SEQ ID NO: 61937 - DNA, 712 bp, Zea mays
  misc_feature: Ceres CLONE 1525640
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (24)..(24): n is a, c, t, g, unknown, or other
  misc_feature (25)..(25): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (56)..(56): n is a, c, t, g, unknown, or other
nttttttnnnnnnnnnnnnggggnntnnnnnnnnnnnnnnnnncgccncccccccnaaggctgtgtgtgttcaaaactgggactccccgcggtggcggccgctctatcctagtggatcccccgggctgcaggaattcctctcacccctagaaaaaatagtcgtcgcgttagcaggcagatctgagttagccggcggatccgatccgtgcgcgtgcagtgtacgtgtgtcggtggagaggccacagcttcgctccctggcgagcaggtgatgaagagcaggctcgtcgtgcactcaagggccgaggggcttgtcaggcgctgcttgccctcacaagggggccgggggttaccggttaagggcctttccggcccggagaaagggccccctcccccggggggggggcaaacccccatttaaaagggggggaaacccccctcttttttttgggggggagagagcactttggggaaaaaaaaaacacccccccgggtgggcacaaaactcttttttagaggggggggccggcgcgttttttctattcgcgccgcgggggggggggaaacacccgacttgcttactctaaaaaaaaaaaaatccctcccggcggggggtttttttatgcgatgggccacccccccccaggggaaagaaccccccccccattcaatgtagggggggggggggcgcccgcaaaggaaaggggcggctccc

SEQ ID NO: 61938 - DNA, 763 bp, Zea mays
  misc_feature: Ceres CLONE 1525656
  misc_feature: Encodes the peptide sequence at SEQ ID NO. 61939
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
nnnnnnnnnnnnnggggggnnnnnnncnnncnngggccccnnngggtggtnnnnnaaaactggagctccccgcggtggcggccgctctataactagtggatcccccgggctgcaggaattcgtctcacccctagaaaaaaccacaccaccccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgcctgatgctgttctcggggcccccccgggggggggggggggggggaaccgcaaggcgacggcggggctgaagctggaggcgcgcgacttcggcctgcagaagggtgaccccgccggggttcaaccctcgccgaaacgcttgggccttgcggacgcctttaggccaaaatcctcgggtgtcgggcgtcgtggctcggggctccaaaaaccccgggcggccctcggaccaaatcattcgggctaattcccctaaagtcgtcgtttgttgaaaagtctgactcttgccttccttctatcccgttctgccgtgctgggcttggggtcctgggcgtgtgggggaaaatcagggaaatcggggggg

SEQ ID NO: 61939 - protein, 141 aa, Zea mays
  misc_feature: Ceres CLONE 1525656
MASQLSAAVPRFHGLRGYAAPRSAVAALPSVRVGRKRSSSQGIRCDYIGSATNLIMVTTTTPDAVLGAPPGGGGGGNRKATAGLKLEARDFGLQKGDPAGVQPSPKRLGLADAFRPKSSGVGRRGSGLQKPRAALGPNHSG

SEQ ID NO: 61940 - DNA, 843 bp, Zea mays
  misc_feature: Ceres CLONE 1525678
  misc_feature: SWISSPROT Homolog: EC 2.5.1.18 Glutathione transferase
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
ttttttttttnnnnnnnnnnnnnntnnnnnacgnnnnnnnnggccacccnnnnaaccgcaaagctccccgcggtggcggccgctctagactagtggatcccccgggctgcaggaattcgtctcacccctagaaaaaaaggaaactcactcccactttactcctatccactgcggcctggacgcgtgcgagaggcttgaccaagcagcagcagcagcagcagcgatggcgcctctgaagctgtacgggatgccgctgtcccccaacgtggtgcgcgtggccaccgtgctcaacgagaagggcctcgacttccagatcgtccccgtcgacctcaccaccgggtcccacaaggagggggggcttcctcgcccttcaaccctttctgccagatcccgagcgccccctcgacggaaacgtatttttttcccccccccccgggggggaaagaaggggggggctctctctccccactcactcctcccacaagggcgtgggaggctggataacccacagatcccccgccccccccgcgccagtcccccaacctcattcccccggcaaagcgcccactcacccccccacccgctcccccccgccatcgtttattgcccccctcgccgtccactcaagctgcacccgatcagaggcccgaagcccatgagccaaagtaaccgacacccacctcttccacccacactcaacaacaaacatcacgtccgacgctcccgcctcccccaccgtccccgccccctccgcccgggctaccctagccccggaggcctagggcaggacgcggccgccgccccccggcgcggtcctaatcacctccctccgtgtccgagcgg

SEQ ID NO: 61941 - DNA, 842 bp, Zea mays
  misc_feature: Ceres CLONE 1525740
  misc_feature: Encodes the peptide sequence at SEQ ID NO. 61942
  misc_feature (19)..(19): n is a, c, t, g, unknown, or other
  misc_feature (783)..(783): n is a, c, t, g, unknown, or other
ggggtggaggtgcctgttngccgccgcgggggggggaggttaatataaaaatttataaacaaagctggtgctccccgcggtggcggccgctctagaactagtggatcccccgggctgcaggaattcgtctcacccctagaaaaaacccttgctcgctgcgccgccgcctccgacatcgtcccttcgtccccacgagcaaccgataatccgccggcgttgagatgttggtttatcaggatctgctatctggcgacgagctcctggcggattcattcacctacaaggagcccgggaacggggtcctgtgggaggtggggggaaagtgggtccccccagggcgcggggtgatgtggatcattagcttggcaatctcgtcccgcgagtagtgattgggggagtaggggcgctagaggacctcagtcgggggagagtggtttgaggatggtacggacccacaagccgggctggagagggggattagctggtggtgggggctattttatactctctctggcggcgtatccgaggggggagaaaagtgaggagaaaggggggggggggtcggaggtattatgctggtggagtcggggaagggactaatgagaagtgttagggaatagcgggggcgggggtcatctacaggggactcattaaagaggggggtgggggggactaaatcagtcggaataaactggagggggagtgcgtaaattttattaaatagtgggagtgggggggggtattgatatacaacagaaaccggagggtgcttgttgtaacgcncctcgagctactctccgggcctttcaatgagacgggggggggggaagcattaacaaaaa

SEQ ID NO: 61942 - protein, 54 aa, Zea mays
  misc_feature: Ceres CLONE 1525740
MLVYQDLLSGDELLADSFTYKEPGNGVLWEVGGKWVPPGRGVMWIISLAISSRE

SEQ ID NO: 61943 - DNA, 690 bp, Zea mays
  misc_feature: Ceres CLONE 1525750
  misc_feature: Encodes the peptide sequence at SEQ ID NO. 61944
ctccccgcggtggcggccgctctagaactagtggatcccccgggctgcaggaattcgtctcacccctagaaaaataacccaccagcacacccatccgccagccctcctggccccattcctctctctcccctccctcctctccaccgccaccgcttcatccccttcatctccacctcctacgaggcggccgccgcctccatgctcggccgcgaccgcagggcctcagctctagcagcgttcaatactgtaggctagcggagaggtgggggatggcgaagccgacgccggtggcctcggcagaggaggcggcggcgatgcggcgccggctgaggcgcctggtggccgcggtggcggccgggagcgccgacgccgaagccttcgacgaggctgcagaggcgctcgccaagctcagggacgcccgagcttgcgccccgcaaggacaggacccggcgacggccgggagaacaagcgcagcacggaaggccgccgtgccgggagcacttccctttgccccatctcctccagaaatcatgaaggaaccccgtccgccctccccttccggccagggtagcccacaaatcataggccttagaagggtataaattaccaaagtgtcaaaccctttggggtggggcaagatttgccaaaattattccccccccaaatccgcctttccccttgggcccttcc

SEQ ID NO: 61944 - protein, 110 aa, Zea mays
  misc_feature: Ceres CLONE 1525750
MAKPTPVASAEEAAAMRRRLRRLVAAVAAGSADAEAFDEAAEALAKLRDARACAPQGQDPATAGRTSAARKAAVPGALPFAPSPPEIMKEPRPPSPSGQGSPQIIGLRRV

SEQ ID NO: 61945 - DNA, 805 bp, Zea mays
  misc_feature: Ceres CLONE 1525755
  misc_feature: Encodes the peptide sequence at SEQ ID NO. 61946
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
tttttnnnnnnnnnnnnnnnnnntttccggggcntnnnngggcttttttttttttcaaactggtgctccccgcggtggcggccgctctagaactagtggatcccccgggctgcaggaattcgtctcacccctagaaaaaggccagacagactaactgagcacccgctgcaaggagtccgcgcccatggcgagcaccaacatggcgtcggccacctcgcggttcatgctggccgcgggcgtgcccaccggcagcagcggcggccgcgtcaacttcgcctcggcgcccaaccggcttggcaggaggctcgtggcccgggccgacaacgaggccgccgcatctgaggccggcgaaggggagggtgccgtggccaccaagcccatggccgataagcccgccgccgatcgggcccaagagggggcgccaaaggtgaagaatcctttagggaggaatccctactggtacaacggggatcgggcaacgttcctcccctgtcgatcagggatcccaaacacccgcctacccggggtggtttgtcgcggtttcaaccaaggggtgaaacttacgcccgggctgtggcccacacaacaaactttacccccttggaaacaaaggtctcacaaagggcagaaattgggttggggccccgggcccggcttacaaagggccccccccgcctagacctacccctgggtgaattcaatttttgcacacacatttcgtaaaaaaagacaggctccgtaaacaacctcccattgctttgtgacttggaacaacaccccccaccccctctcccaatttttggtg

SEQ ID NO: 61946 - protein, 164 aa, Zea mays
  misc_feature: Ceres CLONE 1525755
MASTNMASATSRFMLAAGVPTGSSGGRVNFASAPNRLGRRLVARADNEAAASEAGEGEGAVATKPMADKPAADRAQEGAPKVKNPLGRNPYWYNGDRATFLPCRSGIPNTRLPGVVCRGFNQGVKLTPGLWPTQQTLPPWKQRSHKGQKLGWGPGPGLQRAPPA

SEQ ID NO: 61947 - DNA, 617 bp, Zea mays
  misc_feature: Ceres CLONE 1525772
  misc_feature: Encodes the peptide sequence at SEQ ID NO. 61948
atagctggagctccccgcggtggcggccgctctagaactagtggatcccccgggctgcaggaattcgtctcacccctagaaaaagtcgtcggccactcccgtccgctccatccaaccacctcatccctctccgacacgggccgcggccgaccgccggctccgtggccttgacaccagttgacgaggagcatctctactctacagcgcaaatcggcagatgcttggtcaatatccggcggcggcatatgtcaactctccccttatgcgatggaactgccaactcgccgtgctggtcggagtgctctgggtcgaggcttgctgctgcgcgccgtgtttggagggaagctgccgtctcctgccgctgggagaagccgaggaccctctgtttgctgagggcaaaatctccttccttgcgcaggcactctaggaaggtgcaatgggctatcagaaccatgtccgacgacagtggtgaccaatcaggcaacagcactcgcctcttcagcgcgatccggtcattctggaaccagttgtctgccgagctgaagaaagcaaggagagggttgccagtgaagatcctattctttctgatcaggttctactgcgctaccgcgttcgct

SEQ ID NO: 61948 - protein, 124 aa, Zea mays
  misc_feature: Ceres CLONE 1525772
MSTLPLCDGTANSPCWSECSGSRLAAARRVWREAAVSCRWEKPRTLCLLRAKSPSLRRHSRKVQWAIRTMSDDSGDQSGNSTRLFSAIRSFWNQLSAELKKARRGLPVKILFFLIRFYCATAFA

SEQ ID NO: 61949 - DNA, 528 bp, Zea mays
  misc_feature: Ceres CLONE 1526125
  misc_feature: Encodes the peptide sequence at SEQ ID NO. 61950
aaagctggagctccccgcggtggcggccgctctagaactagtggatcccccgggctgcaggaattcgtctcacccctagaaaaagggccgattctctgcgtgacttgaggcgtcgtcgccgagttttctccggccgaaggcggcgcgaccggacaccagcgtgagcgcgaccggcgacatgacttcgcggcaccagcgtgaccgccaaccgtaacccccccgggggcccggaaccccaaacgccaaaaaattcccaggaagggggtcccccccgaaaaacccccccgaaaaaggaaaaaaaaacccttcggaaaaaaaaggggcgccaaaaaagggccaaaaaaagggaagggcccggggggtccccggatccctccccgggaaaaaaaccaaaaaaaaagggggggggggaaaaaaaaataaagggcgtggtggtgcccccccacccccttgtaaaaaaaaaaacaaagcccttggggtggggaacaatttccccccccctccttagaagggagaaactttttttgg

SEQ ID NO: 61950 - protein, 35 aa, Zea mays
  misc_feature: Ceres CLONE 1526125
KAGAPRGGGRSRTSGSPGLQEFVSPLEKGPILCVT

SEQ ID NO: 61951 - DNA, 665 bp, Zea mays
  misc_feature: Ceres CLONE 1526126
  misc_feature: SWISSPROT Homolog: EC 3.2.1.23 Beta-galactosidase
  misc_feature (384)..(384): n is a, c, t, g, unknown, or other
  misc_feature (414)..(414): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
caaagctggagctccccgcggtggcggccgctctagaactagtggatcccccgggctgcaggaattcgtctcacccctagaaaaatacggctttcacatgatgtttctaggcagatgtaaaaaacaagtatattgtgtacccaatagtctgtagcctgttccaatcacattggttttgacatgcgtgtatcctatgggtaggcggccgttgtgctctctagtggcgttgactcacatctgtgtaatctaaaaaaaattctttctttccgtggatctctaactatacctttgaactgatatacgggagtggatggattcggccaacgatcattatgccatgttgctaagaaatgattgcgtgagcctgctgcttctacaaaaaanaaaaaaaaaaaaaaaaaaaaaaaaaaaaanaannnnggaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccccaccgatcgcccttccaaacatttgcccaccctgaatgccaaatgaaatttgaagcctcta

SEQ ID NO: 61952 - DNA, 842 bp, Zea mays
  misc_feature: Ceres CLONE 1526151
  misc_feature (57)..(57): n is a, c, t, g, unknown, or other
  misc_feature (58)..(58): n is a, c, t, g, unknown, or other
ttcacgccctcgccctaatttttgcggaaaaggggacaggagattctacctcacccnncaaaaagtggttagtcccgcggtggcggccgctctagactagtggatcccccgggctgcaggaattcgtctcacccctagaaaaaaattcgagaggctggtgaaggtgaggcaccaggtcgtggccgggaccctgcaccacttcaccgtcgaggtgaatgaggccggcggcggcgaaaagaagctgtactaggccaaggtgtgggcagaaggtgtgggagaactttaagcaggctgccgagctttcgtagctcgttcgaatacccccacggtcccgcctgaaaacccaaaggcattcatcacatggtatgcttggatctccaacctattgtaagaaattcgcagtgggtaaatccccaccggggtataaatttactgataccttatcgccctttatctctaccccttcctttttctgatgtaataagcaggcaatgttatttttgtatattttttattgtcccccacccacccctccggcacagttactcgtgattcgtcgctctcctcatgtcgttccacgccgcgttacttctcccacgccgcccatcacctatgttatcccctacctttcccttccaccctcgcatctctcatcctggtactatactacattgtttccgaccttgccttatctgcttttacccctcctatttttcttctcttctacccccccctctcatacttatttatttacttttattttaaactccccacagccttcccctaactcctctcttgtctcctcatctcccatactttattcttcatcccccgccaacttg

SEQ ID NO: 61953 - DNA, 623 bp, Zea mays
  misc_feature: Ceres CLONE 1526159
  misc_feature: Encodes the peptide sequence at SEQ ID NO. 61954
ctccccgcggtggcggccgctctagaactagtggatcccccgggctgcaggaattcgtctcacccctagaaaaaacagcatctcaagccaccttcgaccttcaagtctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtctacaacaacgcttgggcctacgccaccaacttcgtccccggcaagcgagggaggcgccgccggtgacctttaggtgtccggatgcatgtgagcgcacgctggttttcggtttgtaccatgatgtaaactattgttcaaccgacaaggaataattgtgttctttgtcaagattgtcccctgaattctcttaaaatcatcatgataatatatcgttcctgcgccacggaaaaagaactaacctccgggcccctcgaggtacccctttccccccaaggggcccctttttcccccccctcctggggccttcgtttttacaccctcggccctgggtaaaacccctggggtgtccccatatataccg

SEQ ID NO: 61954 - protein, 51 aa, Zea mays
  misc_feature: Ceres CLONE 1526159
MFSMFGFFVQAIVTGKGPLENLADHIADPVYNNAWAYATNFVPGKRGRRRR

SEQ ID NO: 61955 - DNA, 632 bp, Zea mays
  misc_feature: Ceres CLONE 1526181
  misc_feature (68)..(68): n is a, c, t, g, unknown, or other
  misc_feature (77)..(77): n is a, c, t, g, unknown, or other
  misc_feature (85)..(85): n is a, c, t, g, unknown, or other
  misc_feature (86)..(86): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (454)..(454): n is a, c, t, g, unknown, or other
  misc_feature (465)..(465): n is a, c, t, g, unknown, or other
caagctggagctccccgcggtggcggccgctctagaactagtggatcccccgggctgcaggaattcgntctcacccntctagaannaaattttgttcataggcttgtggtattcttttgataccatatctgatatattgcacccatccattttgcagcatttcaaatttagcaaaatcttaacctgcagtggacttgcaagttgcacataactatcatcgcatcggcatgccagggtgtatttcatgtttgataaacgggggaaatgagaagacaacgattgttgtaaagctggtaaaccatccacctaggtttttttctttccttgggtttacatgaaaaaattatagcctccggacccccttttggggtttccgggtaatcaaaaaccaatgtaaaagtttcggacccgaaactttaatttatattaaaaggggccttgtttttttnnnnanaccccaccccnccggcgaacgtgaacatctacccaaaaaaaatcggaaaacccccctcccaaaaaataagtacaaaaacactctttgttttaaaaaaaaaaaaaaaaaaaaaaaaccccgggggggccccaccattctcccccccaaaaaagggggtgtttttttccccccgcccccc

SEQ ID NO: 61956 - DNA, 758 bp, Zea mays
  misc_feature: Ceres CLONE 1526187
  misc_feature: Pfam Name: S1-P1_nuclease Pfam Description: S1/P1 Nuclease
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
acatcttatttgtttgtgcataatcggtaaccggtggtgttgatatnnnacccaaaaaataaaactggagctccccgcggtggcggccgctctagaactagtggatcccccgggctgcaggaattcgtctcacccctagaaaaaagacctctcgtcttgcccaaccaagtacgcgaccgagagcataggcctggcgtgcaaatgggcgtacagcggcgtccgcgaaagggagacactgtccgacgactactttgactcgaggctgccgatcgtgtcgcggcggatcgcgcagggcggggtgcggctggccatgttcctcaaccggatcttcggggcgcacaaccgggacgtgccgccgccgtcttcttgattgaatggatggacccaatcccgatctgcctgtcgcggcacaaaccccaaagcttatcctaatccatgtggcatgaaaaggcctgggttgcttttttaagtaaaaaacgaattccacaattggggagcagatcgggggctgtggctgtccgagacattgagtagaagggggcgtgtaaacccggccccccgggtaaccttgggggaaccgaatggcgttaaccaagactaccggtgtttccaccccggaagtaatgccttcctttaaggtgataattaggctaacagcggagggtggtctcggaggttgcccaccattttcgccccctccccccatcctcctgatatttctgccactggtgctgtaacatgtgtgcggtgcctttaat

SEQ ID NO: 61957 - DNA, 836 bp, Zea mays
  misc_feature: Ceres CLONE 1526190
  misc_feature: Encodes the peptide sequence at SEQ ID NO. 61958
  misc_feature (20)..(20): n is a, c, t, g, unknown, or other
  misc_feature (47)..(47): n is a, c, t, g, unknown, or other
  misc_feature (48)..(48): n is a, c, t, g, unknown, or other
  misc_feature (61)..(61): n is a, c, t, g, unknown, or other
  misc_feature (836)..(836): n is a, c, t, g, unknown, or other
taaaattcctctactccccnaatcttctaaaacccccccccgcaatnnggttcaaactggnactccccgcggtggcggccgctctagaactagtggatcccccgggctgcaggaattcgtctcacccctagaaaaactctcgcccctctctcccaccccgcagccgccctagcacccgcgacgagcaggatctgcccagttgctcttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacctttgctctctctgggtttgtccgtgctcagggtgacgcagacagctccctgggacaggcttgctccaaaaccaaaaaaggccgatatcaaagcaagtacgaatcttaccatcccaaggttcacccaagaatatgggaccacccgcccttcaagcttaatcttttttgcaatatatactgttccaccataacctggccaaacgagtggctgattttttccagccccgcggtccccctaaaacactctgcacacacctctaattaaatccctcgggtttgcggtctctccattgccctcaccccgcgccccaataatatatccggaaagcgcccccgagaggccacccccaaatcctccgcccccctaccaatagaccattcgaaataaaccgcactgcgccgcccccggtaggcgctaccgtcctgccataaaagcccccccctatacccccn

SEQ ID NO: 61958 - protein, 138 aa, Zea mays
  misc_feature: Ceres CLONE 1526190
  misc_feature (1)..(81): Pfam Name: Ribosomal_S21e Pfam Description: Ribosomal protein S21e
MQNEEGKTVDLYVPRKCSATNRIITAKDHASVQINIGHLDANGLYDGHFTTFALSGFVRAQGDADSSLGQACSKTKKGRYQSKYESYHPKVHPRIWDHPPFKLNLFCNIYCSTITWPNEWLIFSSPAVPLKHSAHTSN

SEQ ID NO: 61959 - DNA, 599 bp, Zea mays
  misc_feature: Ceres CLONE 1526191
  misc_feature: Encodes the peptide sequence at SEQ ID NO. 61960
tcccccgggctgcaggaattcgtctcacccctagaaaaaaattccgtctacaggagcaacctccttttgacaagaaatcatttgtctcttacataaaaaaatacatcaagaatctcactgctgtgttggagccagagaaagcggatgagttcaaaaagggtgtcgagggtgcaaccaagtttctccttagcaagctgaaggaccttcaattttttgttggtgagagcatgaaggacgaagcgtccgtggtattcccctattacaaggatggtgccactaatccgacattcctctatttctctcatggtcttaaggagatcaagtgctaaattagttacccatgttgggtactatataatgttctaccgccacacccacaactataactgccctgcctgaactgaactcaggttttttttaaaaaaaaactgtccaagattgggattgctttgttaaagccaaatattggttattggccccgcagcatccccgatgggacgagataacaaaacgagacttacaaaaaaaaataaataaccaacccgcctcgagggtacccaattctccccctataggggaagtgccaaattacccgccgc

SEQ ID NO: 61960 - protein, 108 aa, Zea mays
  misc_feature: Ceres CLONE 1526191
  misc_feature (1)..(105): Pfam Name: TCTP Pfam Description: Translationally controlled tumour protein
PRAAGIRLTPRKKFRLQEQPPFDKKSFVSYIKKYIKNLTAVLEPEKADEFKKGVEGATKFLLSKLKDLQFFVGESMKDEASVVFPYYKDGATNPTFLYFSHGLKEIKC

SEQ ID NO: 61961 - DNA, 663 bp, Zea mays
  misc_feature: Ceres CLONE 1526263
  misc_feature: Encodes the peptide sequence at SEQ ID NO. 61962
caaagctggagctccccgcggtggcggccgctctataactagtggatcccccgggctgcaggaattcgtctcacccctagaaaaaacctccatccagcttgagccagcccgtcgcctgcgcgcatctctctacacttctactgcttcatactctcgtagagagatccccgcggcccaataaaaacccgactcgctagctgcactacacactcgcagatggccggcctcaggatgaagttcgtcgccgtcgccgccatggccgccgcgctcgtggcgtccgccgcagccgccgaggcccccgccccggcccccgcctccgacgccgcggccgccgtgcccctcgccgcggcctccctcgccgccgccgccttcggctacctcttctgctagatccgcgctggacgcgtggtttgtgcttgatttgtgattcgtctggcgcgagtggagtccgtgtcgtgcgcgtgtctgtgtgagttgtttcggcgggcgtgtgtctgtatgtatggagtcggcggcgagcgaagtgtgcgcgtggtggtacgtgcgtcgacgctccattgtttgtggcggcgatcatttgcctggccccgttttctggttatccatgagatgaatttatttgattcaaaaaaaaaaaaaaaaacgaggcccttcaaggtaccc

SEQ ID NO: 61962 - protein, 57 aa, Zea mays; identical to SEQ ID NO: 43282
  misc_feature: Ceres CLONE 1526263

SEQ ID NO: 61963 - DNA, 666 bp, Zea mays
  misc_feature: Ceres CLONE 1526264
  misc_feature: Encodes the peptide sequence at SEQ ID NO. 61964
aagctggagctccccgcggtggcggccgctctagaactagtggatcccccgggctgcaggaattcgtctcacccctagaaaaagccggttccatttgccccagcaccccatttccctctccctctctctcacacgcgcccacacctccgctgccaccgccgttcacgccgtgctgcatctgcagccgcgccatcgcccgtcacttggtgccccgccacgctgagctcgcatcgtcgtccgccgaggagcctgcgtggagccgttgccgagatcgcgatttgtttccgcgctccgaggaatcgacgatcaagcgtcggcgaccaagtgatcaagctctctgagttttatgaggttgaagatcctgagcatctatttggtgaaggttgcctttggtgcaatctatgctcaggtaagagaaaggcgtcgaggcggatctctaggagttacaggacttcggcgagttcgaggattaggctagcgacctcccccagtcagctgcctgtggtgggtttgttcacgttggctacgtttctattctgtgtactttgatttgtattatgtaaatgactctagtctttaatattattactcattctatattgttattcgaagcattgtgctatgatgagtcatttatgtaatcgctgtgtacaaaaaaaaaaaaaa

SEQ ID NO: 61964 - protein, 43 aa, Zea mays
  misc_feature: Ceres CLONE 1526264
MRLKILSIYLVKVAFGAIYAQVRERRRGGSLGVTGLRRVRGLG

SEQ ID NO: 61965 - DNA, 703 bp, Zea mays
  misc_feature: Ceres CLONE 1526266
  misc_feature: Encodes the peptide sequence at SEQ ID NO. 61966
  misc_feature (703)..(703): n is a, c, t, g, unknown, or other
aagctggagctccccgcggtggcggccgctctagaactagtggatcccccgggctgcaggaattcgtctcacccctagaaaaaagtcgtcatcgcttggcgtccgcctcagcccgccgccaggagagttcaggagagtttcgagaagctgaaatggctcctaaagctgctcctgccaagaagggtgatgccaagacccaggccttgaaggttgccaaggctgtgaagtctgggtcagtaaagaagaccaagaagatccgcacgtccgtgacatttcaccgccccaagaccctgaagaaggctagggaccccaagtacccaagaatcagcactaccggaaggaacaagcttgatcagtaccaaattctcacccctcccctcggcgcggggagcggcgatgaaaaagattgaagataacaaccctcttgtctccttgtcgacctcaaggcagaccaagagaaaatcaaggctgctgtccagaagatgtatgacctttcgggcccaagaagggcaacacccctgatcccggccttatggaaaagaacaaggccttccttggagccttattcccgaactaatgatgcctctttggtgggtgcccaacacaaattcggccctcccccttaaagttacccgcccgtccaggacatcaggccgggggcctcctaatttcccttgatcacacaccaaccattttttttgtn

SEQ ID NO: 61966 - protein, 85 aa, Zea mays
  misc_feature: Ceres CLONE 1526266
  misc_feature (11)..(63): Pfam Name: Ribosomal_L23eN Pfam Description: Ribosomal protein L23, N-terminal domain
MAPKAAPAKKGDAKTQALKVAKAVKSGSVKKTKKIRTSVTFHRPKTLKKARDPKYPRISTTGRNKLDQYQILTPPLGAGSGDEKD

SEQ ID NO: 61967 - DNA, 622 bp, Zea mays
  misc_feature: Ceres CLONE 1526267
  misc_feature: Encodes the peptide sequence at SEQ ID NO. 61968
tggagctccccgcggtggcggccgctctagaactagtggatcccccgggctgcaggaattcgtctcacccctagaaaaatctcgttccccatttgctgcgtctccttgcccgcgccgccgctcgccgtttgcccctcgtctccgcaccgcgcgctgttgtccatccttgtgcagcaaaaatgacggctggctacattgttggctcactggtcggatcctttgccattgcatacctgtgtgacacatttatctctgacaagaaggcatttggaggtagcacccccaagactgtttctgagaaggagtggtggcaagccacagacaccaagttccaggcctggcctcgcactgctgggccaccggttgtcatgaaccccatcagccgccagaacttcatcgtcaagtccactgagtaggtttgggctggaagagctggttctgcgacttggtgcgccatgaagcccagagtccttttctaaggtcttaatcaattgtaataaaacgaaatacagtcaggattttttttgtgatttttacttgatctgtgagcgaacactggggcctttcacccttgtcatccaatggggttctgctcctttggggaaattctccccccacccag

SEQ ID NO: 61968 - protein, 78 aa, Zea mays; identical to SEQ ID NO: 58464
  misc_feature: Ceres CLONE 1526267
  misc_feature (3)..(75): Pfam Name: DUF1138 Pfam Description: Protein of unknown function (DUF1138)

SEQ ID NO: 61969 - DNA, 698 bp, Zea mays
  misc_feature: Ceres CLONE 1526274
  misc_feature: Encodes the peptide sequence at SEQ ID NO. 61970
  misc_feature (698)..(698): n is a, c, t, g, unknown, or other
agagctggagctccccgcggtggcggccgctctagaactagtggatcccccgggctgcaggaattcgtctcacccctagaaaaagaatgaatactggctgctactagtactactggtacgacggcgagcagagcacagcacagcacagcacagcagcgctacacgttgggcgtgcatcgattcaggatcatggacgacggcgactggatcacggcgaggtacctcctctcgtcgatcctcgggcggaacccgctggtggtggactacgtcgacgaggagtccttccccgtcgaccttcctccacctcccgcgccgtccccctcttcctccggcggccgccgcgcggagccgccgccgccggtgcgcgcgccctccggggtgggcggggcggtgtgcccggtgtgcacggaggagatcgcggcggcggactccgtggcgcgcctgccctgcgcgccctggtcccaccacggctgcttcgcgccggggcttcgggaatccgcccccacctgccccaattgccgggcccaagcttgcctcttagggaaacccccccccccgggaagaaatggccccctgccgcgccacagccgccccccccggggggaacttatgccccccggtcccgcccgtttctctgtccccaactcccaagggcggggaccccgcctcaaataatcttcccccccccggagtggccn

SEQ ID NO: 61970 - protein, 161 aa, Zea mays
  misc_feature: Ceres CLONE 1526274
MDDGDWITARYLLSSILGRNPLVVDYVDEESFPVDLPPPPAPSPSSSGGRRAEPPPPVRAPSGVGGAVCPVCTEEIAAADSVARLPCAPWSHHGCFAPGLRESAPTCPNCRAQACLLGKPPPPGRNGPLPRHSRPPRGELMPPGPARFSVPNSQGRGPRLK

SEQ ID NO: 61971 - DNA, 663 bp, Zea mays
  misc_feature: Ceres CLONE 1526275
  misc_feature: Encodes the peptide sequence at SEQ ID NO. 61972
  misc_feature (388)..(388): n is a, c, t, g, unknown, or other
  misc_feature (391)..(391): n is a, c, t, g, unknown, or other
  misc_feature (392)..(392): n is a, c, t, g, unknown, or other
  misc_feature (394)..(394): n is a, c, t, g, unknown, or other
  misc_feature (395)..(395): n is a, c, t, g, unknown, or other
  misc_feature (401)..(401): n is a, c, t, g, unknown, or other
  misc_feature (402)..(402): n is a, c, t, g, unknown, or other
tggagctccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggctaggccgcccacggctgcagctgcggtggcaactttttgtcccccccctgcaaggaacggaggggggnatnnannaccatnnatataattattatctatctaacaagaggtggtggttgaacaaaagtgggcgaggcccagctggctgccatacatagggattggggggggtgggtgaaaaaaacaaaaccaaattcctccgtttgctatccccccccgccgggttcggcgtcagtctttggggcccccgtccccccctgtggccaaccccgccctgtgggcgaaccccaatgcgcttggttggaacccaatatatattgggcccacaaagagcagactttaa

SEQ ID NO: 61972 - protein, 57 aa, Zea mays
  misc_feature: Ceres CLONE 1526275
  misc_feature (1)..(56): Pfam Name: Metallothio_2 Pfam Description: Metallothionein
MSCNCGSSCGCGSSCKCGKKYPDLEETSTAAQATVVLGVAPEKKAAPEFVEAAAESG

SEQ ID NO: 61973 - DNA, 667 bp, Zea mays
  misc_feature: Ceres CLONE 1526276
aaagctggagctccccgcggtggcggccgctctagaactagtggatcccccgggctgcaggaattcgtctcacccctagaaaaactttttccgtcggcgtcgttgctggcgagttcatactccgcttgccataaagctgtcatgcgccacctctcctctagtaaccctaaccatccgaatcctctaacctacgaagaaccaagagcctcaccccagctggaggccgccgccattgacttccccgtacaccgccgtagaaacctattggccgtggtctgggcttccccagagacatcgtgtgactacccgtgggaattctagggctggattgccgatccagccgcggcaatttcttgtcggagcaccgtctccgcacctcttcgtgtattgcgccatcatcatcacggactcgggtgaagagtaggtagcccaggaggaggtccacaacgaggagtacgagcttatctaggtggcgtctcgtagtcagcttatggtgccaaggaataattattagttcactttactgttatcacttatttttgtaagactcttccgctatgtaataataatatttgtgacatttatctctatacacttggtcattataggtgttggtcttctttggcgcaaaaaaaaaaaaaaaacgagacgctcgaggtacccaatt

SEQ ID NO: 61974 - DNA, 661 bp, Zea mays
  misc_feature: Ceres CLONE 1526277
  misc_feature: Encodes the peptide sequence at SEQ ID NO. 61975
aagctggagctccccgcggtggcggccgctctagaactagtggatcccccgggctgcaggaattcgtctcacccctagaaaaagccctggtgttctagccaaagcttgcagtggtgtgagggattcatgtgtattgcaagccaaagctcctctcccactgccaccaagttggcactgtccagagctgtgtgcgctgtcttcctgtgtttgtgatgaccacaaccaccaagttcaccccaccatagccagaacattctagggagttgctggcctatatgaagcttgttccgtaatcatctcagaactcctaccagaaggagtgaagattcaagctgaagtggtgactgaagaggaatctactctagtggctgctgatcaagtggaggagccatctaactggggttaatagagggatcgagtacctcttcactgcaataaggtgatgaggagtactctaggtgttcctgtggctggagggcgtttctagttctgaaggaagattagttagtcttgtgtataagctttggagggttcctaccttcctgctaatgtaataagttatgcactttgagtatattaggaacttgtataaatggtaactctttcctatgtaataaacttcaatttttagaaaatgaaaaaaaatgttttataaaaaaaa

SEQ ID NO: 61975 - protein, 31 aa, Zea mays
  misc_feature: Ceres CLONE 1526277
AGAPRGGGRSRTSGSPGLQEFVSPLEKALVF

SEQ ID NO: 61976 - DNA, 696 bp, Zea mays
  misc_feature: Ceres CLONE 1526279
  misc_feature: Encodes the peptide sequence at SEQ ID NO. 61977
  misc_feature (696)..(696): n is a, c, t, g, unknown, or other
acagctggagctccccgcggtggcggccgctctagaactagtggatcccccgggctgcaggaattcgtctcacccctagaaaaaaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgccccgtccctcgccggcagcgcgggaggaccggtgactttcctggggtcccttcaggctgagggcttctgttttcccctgctggtgagctactggaagcatgttaatttgggccgttggttttttacccacaccagcaagaaactggccccgtttaattggccttgtccccccccttcctttgccattatatcaacctcccaacaacagggaggggcatgccatttggtaattcaaaaaactcttttttcaccccgatttaagtacccacattttttttttn

SEQ ID NO: 61977 - protein, 91 aa, Zea mays; identical to SEQ ID NO: 44946
  misc_feature: Ceres CLONE 1526279

SEQ ID NO: 61978 - DNA, 651 bp, Zea mays
  misc_feature: Ceres CLONE 1526280
  misc_feature: Encodes the peptide sequence at SEQ ID NO. 61979
aagctggagctccccgcggtggcggccgctctagaactagtggatcccccgggctgcaggaattcgtctcacccctagaaaaaccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggcggctacggtggcggcggcggctacggtggtggtggcggcggctacggcggtggcaaccgtggcggcggctacggcaactccgacgggaa

SEQ ID NO: 61979 - protein, 152 aa, Zea mays
  misc_feature: Ceres CLONE 1526280
  misc_feature (10)..(81): Pfam Name: RRM_1 Pfam Description: RNA recognition motif. (a.k.a. RRM, RBD, or RNP domain)
  misc_feature (48)..(151): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDG

SEQ ID NO: 61980 - DNA, 678 bp, Zea mays
  misc_feature: Ceres CLONE 1526282
  misc_feature: Encodes the peptide sequence at SEQ ID NO. 61981
aaagctggagctccccgcggtggcggccgctctagaactagtggatcccccgggctgcaggaattcgtctcacccctagaaaaaaactcgcagatggaagcccgaatacatcgaactgcaaccgctcgacgtggggtagaatataatctggtgcgctccccccgcgaacaacttcctgcttgcacgcaagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcaaacggggacgcgccccgagaagatccgcatccagaagtggtacaacatctacaaggaccacatcacgctcaaggactaccagaatcacgaccggatggggctcgagctctactacaactaggcgcccttgaccccaaccgtgccctgatgtaaggttaatcccaattcctgaaatcctggggtgcccttcccagtcccagcgttctttagcttaacaaggtccgcatacaatataaagggcaaactttgagctgggccttttttacctaacggaatattgggtgtttgtgggcaaaacttgccccaaag

SEQ ID NO: 61981 - protein, 73 aa, Zea mays
  misc_feature: Ceres CLONE 1526282
MIEVVLNDRLGKKVRVKCNEDDTIGDLKKLVAAQTGTRPEKIRIQKWYNIYKDHITLKDYQNHDRMGLELYYN

SEQ ID NO: 61982 - DNA, 651 bp, Zea mays
  misc_feature: Ceres CLONE 1526287
  misc_feature: Encodes the peptide sequence at SEQ ID NO. 61983
aaagctggagctccccgcggtggcggccgctctagaactagtggatcccccgggctgcaggaattcgtctcacccctagaaaaaatccgccgccagcaggtgccaccgccatctctgctttctctctctctctctctctctctctctcaagcaacgcccgcctgcccgcccgccatggcgaccatagccacgatggccctgctgaagcccgccaggatcgtggcgcggtcggcgccgccgtccaccagcggcagcgtctcgctgcgcgtcccggcgcgggccaagaaggccgcggtgtccgtgtccgtgtcgtccgcgctggcgggcgccttcttctcggcgctggcgtcgtcggacgcggcgctggcggcgcagcgcgtggcggacgtggcggcggcggccgacgccgggagcgacaaccgagggcagctgctgctcttcgtggtggcgcccgccatcgggtgggtgctctacaacatcctgcagccggcgctgaaccagctcaaccgcatgcgcagccaggccgtggtcgccggcctgggcctcggcgccgccgccgccgggatggcggccgcgcccgaagcctccgccgccgccgcggcgcaggacctcgccgctctcgccgctgctgcggctgcggccgcgcccgcc

SEQ ID NO: 61983 - protein, 159 aa, Zea mays
  misc_feature: Ceres CLONE 1526287
MATIATMALLKPARIVARSAPPSTSGSVSLRVPARAKKAAVSVSVSSALAGAFFSALASSDAALAAQRVADVAAAADAGSDNRGQLLLFVVAPAIGWVLYNILQPALNQLNRMRSQAVVAGLGLGAAAAGMAAAPEASAAAAAQDLAALAAAAAAAAPA

SEQ ID NO: 61984 - DNA, 522 bp, Zea mays
  misc_feature: Ceres CLONE 1526288
  misc_feature: Encodes the peptide sequence at SEQ ID NO. 61985
  misc_feature (286)..(286): n is a, c, t, g, unknown, or other
  misc_feature (324)..(324): n is a, c, t, g, unknown, or other
ctggagctccaccgcggtggcggccgctctagaactagtggatcccccgggctgcaggaattcgtctcacccctgaaaaaaagaccaccgacgcgtagcacagtccattattgccgtctcccttttgcgtgagcaaagaaagagagcgagaagagcagtcgccatgtctggcatcatccacaagatcgaggagaagctccacatggggggcgaccacaagaataaggaggaggagcaccacaagaaggccgaggagcaccacaagaaggaggagggggagcaccancagaaggacggcggggagcacaaggaaggcatcgtggnagaagatcagggacagatcaccggcgagcacggcgacaagtcccggcgacacaagggaaaggaagggccagaaaaaagaaagaagcaccggccgaagggcccacgaacccccaacggcgggccccattaagcagcaaccaccaacaggcaactggaaaactgggtggcccccacccccaagggggccaaccaccattt

SEQ ID NO: 61985 - protein, 96 aa, Zea mays
  misc_feature: Ceres CLONE 1526288
  misc_feature (41)..(41): Xaa is any aa, unknown, or other
  misc_feature (54)..(54): Xaa is any aa, unknown, or other
MSGIIHKIEEKLHMGGDHKNKEEEHHKKAEEHHKKEEGEHXQKDGGEHKEGIVXEDQGQITGEHGDKSRRHKGKEGPEKRKKHRPKGPRTPNGGPH

SEQ ID NO: 61986 - DNA, 667 bp, Zea mays
  misc_feature: Ceres CLONE 1526290
  misc_feature: Encodes the peptide sequence at SEQ ID NO. 61987
atagctggagctccccgcggtggcggccgctctagaactagtggatcccccgggctgcaggaattcgtctcacccctagaaaaaaaacgcacgagacaaagggcctcacgctttccacatcgacacaaaaccaaccgccgccgcctcctcctccctccgctcgcgctagctgtgtgcgttgcttgcctgccacaactccagcacttggagtcttacgacgacgacgaccacgacgacggcaggagaggagaaagagaaacaagcgggcgggtcatccatggagacagaggaggagacgacacccaaggcgaagaagcggtcgcagtcgctgctcgggagcctgcgggaggcgatcaccaaggtccggttcctgctctcctccaggacctccaggtcggccagcctgagcacggcgaccacccggaccctgtcgcgggccagcagcgccgcgtcgccagaggccctgacgaaggcctcgtcatcgcccggaggccgctcacctgcgtcatcggcccgggacgacgacgtcaaccagcgcgacgagctcttcatcgccaacttctaccggcagctgcagatggagcgccagggctcgctgcaactgcggtacgtcagggggaaacagctggggaaagaccactgggcgcaactccttcttcatttttct

SEQ ID NO: 61987 - protein, 130 aa, Zea mays
  misc_feature: Ceres CLONE 1526290
METEEETTPKAKKRSQSLLGSLREAITKVRFLLSSRTSRSASLSTATTRTLSRASSAASPEALTKASSSPGGRSPASSARDDDVNQRDELFIANFYRQLQMERQGSLQLRYVRGKQLGKDHWAQLLLHFS

SEQ ID NO: 61988 - DNA, 867 bp, Zea mays
  misc_feature: Ceres CLONE 1526291
  misc_feature: Encodes the peptide sequence at SEQ ID NO. 61989
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
ggggggagaatgggtatattaaaaatacaaccctccgnnggnctcttttttttccaagctggagctccaccgcggtggcggccgctcttgaactagtggatcccccgggctgcaggaattcgtctcacccctagaaaaaagccgctcctgccatcagaatcagaccaccacacgcccgaggcccgactgcaagcgcctgagcccaagacccatggccatggccgccgccgccgtcgcaacgtcactgcccgtggcgcagggcctgcgggaagcccctctgccccgggagaaacgcgccatctctccgacccgccccataccccccccgcgtttccctctttcatctcccacccgttatcccactatcgtctttacgcattctacgcgttgccccgtttatcggtttttgttgctgttgattgtcttgcgtctgcccgccccattacctgatgcagggcgggtgccacgatcttacgtcgacgcgtcagggtgtggcccccccctcgcgagccaaacaggtcccccacccaaaggtgtaccgcacgagagcgactgccttgcaggggatgtactctagcaactgaatacccaggcgcctggaccgatgcattttttagactccgtaaattcgcgcttcggcgagccgtaggtaatatgatttttgttcgtcgttgtcaacctagtcctcatgttgcacactgtgggacgacttagagtttaaagaggtcacgcctcgcctcaggtcgacccgtctatacgcgcgccgcacctgcgccgccgaaaggggatcgtggagaagagcggatttgaccccgacgctcatgcgcaaagtcgagtgggaggccagagccttcttaataaatagaa

SEQ ID NO: 61989 - protein, 121 aa, Zea mays
  misc_feature: Ceres CLONE 1526291
MAMAAAAVATSLPVAQGLREAPLPREKRAISPTRPIPPPRFPLSSPTRYPTIVFTHSTRCPVYRFLLLLIVLRLPAPLPDAGRVPRSYVDASGCGPPLASQTGPPPKGVPHESDCLAGDVL

SEQ ID NO: 61990 - DNA, 668 bp, Zea mays
  misc_feature: Ceres CLONE 1526293
  misc_feature: Encodes the peptide sequence at SEQ ID NO. 61991
aaagctggagctccccgcggtggcggccgctctagaactagtggatcccccgggctgcaggaattcgtctcacccctagaaaaagtcgctcggtccaccacctcagctccgccgcttgcccgcttttgctctctccctcccggctctcggcttcttctacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggcccagctctatgagaagtacaaggaccaaggctttgaaatcctggctttcccatgcaaccagtttggtgggcaggagcctggtaccaatgaggagattgtccagtttgcctgcacacgcttcaaggctgagtaccccatctttcgacaaggttgatgtcaacggtagcaatgctgcgcccatctacaagttcttggaaatctagcaaaagtgggccttttccggccacggcatccaagtggaaccttttcccaggtcctttggttg

SEQ ID NO: 61991 - protein, 103 aa, Zea mays
  misc_feature: Ceres CLONE 1526293
  misc_feature (10)..(101): Pfam Name: GSHPx Pfam Description: Glutathione peroxidase
  misc_feature: SWISSPROT Homolog: EC 1.11.1.12 Phospholipid-hydroperoxide glutathione peroxidase
MAASSTATSVHDFIVKDASGKDVDLSTYKGKVLLIVNVASQCGLTNSNYTELAQLYEKYKDQGFEILAFPCNQFGGQEPGTNEEIVQFACTRFKAEYPIFRQG

SEQ ID NO: 61992 - DNA, 701 bp, Zea mays
  misc_feature: Ceres CLONE 1526294
  misc_feature: Encodes the peptide sequence at SEQ ID NO. 61993
aagctggagctccccgcggtggcggccgctctagaactagtggatcccccgggctgcaggaattcgtctcacccctagaaaaaaacacgcctcgatctagatccactcttcccccccttctccttccggtcctccccccgagactcttctattcatataggcgggtaggcgtccgaggcctcgtttgttctcggcttctcgtctccaagggtgctactccgtccgcgcttggtctgctctcgtccttccggaggccgcggcgcaacatggcgaagatcaagccgaaggccttgctcgcgcaaagcaaggtgaagaaggtccccggccaaatcagcgtggccacgatcgtcacctacatgatcctcggcgtcctggtcgtgtcctccgtttacgctgcctacaggtactgctgggcaggcacatgagcagcggaggcagtgggcgcccaggggaactgatcccccgccgactgcgtggctgatctcgctgttgatgtatcatcccgtttggggtaaaatttttgggttgttgcctgtctacaaaagggggttcttgggaccttggatagggttgtttgtttgataccggttacccccgtaaccccatgaattgtttgtttgaaatttcttccccttttattaaccctttggaaattaaaaaaacaaaaaaaaaaacctagacgcccctccagggaccccaat

SEQ ID NO: 61993 - protein, 52 aa, Zea mays
  misc_feature: Ceres CLONE 1526294
  misc_feature: SWISSPROT Homolog: EC 5.2.1.8 Peptidylprolyl isomerase
MAKIKPKALLAQSKVKKVPGQISVATIVTYMILGVLVVSSVYAAYRYCWAGT

SEQ ID NO: 61994 - DNA, 658 bp, Zea mays
  misc_feature: Ceres CLONE 1526298
  misc_feature: Encodes the peptide sequence at SEQ ID NO. 61995
  misc_feature (561)..(561): n is a, c, t, g, unknown, or other
  misc_feature (569)..(569): n is a, c, t, g, unknown, or other
  misc_feature (590)..(590): n is a, c, t, g, unknown, or other
ctggagctccccgcggtggcggccgctctagaactagtggatcccccgggctgcaggaattcgtctcacccctagaaaaacaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaacttccacttcgttgagaactgggttaagatcggcttccctgccnagattaangtgaagaaagaccacgcatcngtgccgttcgatgaccagtgctctattctagaggaggaggccgtgaatctgtccctggagatcttcag

SEQ ID NO: 61995 - protein, 168 aa, Zea mays
  misc_feature: Ceres CLONE 1526298
  misc_feature (31)..(168): Pfam Name: Pro_CA Pfam Description: Carbonic anhydrase
  misc_feature: SWISSPROT Homolog: EC 4.2.1.1 Carbonate dehydratase
  misc_feature (137)..(137): Xaa is any aa, unknown, or other
  misc_feature (139)..(139): Xaa is any aa, unknown, or other
MDDPVERLKDGFHKFKTEVYDKKPELFEPLKAGQAPKYVVFACSDSRVCPSVTLGLQPGEAFTVRNIAAMVPAYDKTKYTGIGSAIEYAVCALKVEVLVVIGHSCCGGIRALLSLQDGAPDNFHFVENWVKIGFPAXIXVKKDHASVPFDDQCSILEEEAVNLSLEIF

SEQ ID NO: 61996 - DNA, 673 bp, Zea mays
  misc_feature: Ceres CLONE 1526299
  misc_feature: Encodes the peptide sequence at SEQ ID NO. 61997
aaagctggagctccccgcggtggcggccgctctataactagtggatcccccgggctgcaggaattcgtctcacccctagaaaaaacgttatcgcgcacatctcctgatcctcgttcctctccgccccgcttgcgccgcgcctccgcccccgtctcctgtgagatcagctccggcggcacgcggatatgactacttcaaggcgtcttgctgacaggaagagtgcaaagttccagaagaacatcacaaagaggggttctgtgcctgagaccacggtgaaaaagagcaatgactaccctgttggacctatagttcttggattcttcatttttgtggtcattggatcatccttgttccagataatcaggacagcgacaagcggtgggctggcctgaattcactgagctaaaaccagaaatttatctgttcgtgagctgggaggcagtatctgtgttgtgtagcaaacttgttcatggatatgtagtgcgaatgtcactactgttctgtttgcagtatcaaaagagtttaaactgatgttgtaaccatgcaaaggctgaaaattttaaaaagtatgggaagaacctttaatctaaaaaagagtggctctggcaaaaaaaaaaaaaaaactagaaccctcgagggacccaaattcgcccctaaagggaaggccgtatta

SEQ ID NO: 61997 - protein, 68 aa, Zea mays
  misc_feature: Ceres CLONE 1526299
  misc_feature (1)..(64): Pfam Name: RAMP4 Pfam Description: Ribosome associated membrane protein RAMP4
MTTSRRLADRKSAKFQKNITKRGSVPETTVKKSNDYPVGPIVLGFFIFVVIGSSLFQIIRTATSGGLA

SEQ ID NO: 61998 - DNA, 658 bp, Zea mays
  misc_feature: Ceres CLONE 1526300
  misc_feature (658)..(658): n is a, c, t, g, unknown, or other
acagctggagctccccgcggtggcggccgctctagaactagtggatcccccgggctgcaggaattcgtctcacccctagaaaaaagcagtgaccaactccaattttgcgttcttgtagtagaggtcggcagccagcggtagagtgagaggtccagaagatgaaaagcatgactctgttggtgatcctagttctccaggatccttgtggtctctgccggcgtggacagatgacctgctgggcccacgaccaagaatcgtgctggtgtctcctagtgcaccatctggaccggcgtgtggacctgcgacgacctcctcaccgagtgcgccgccacctgcaacaactgcgtcgccctgtccacggacaatggcaccaccgattacatgtgccgcgacttcctcccctaaaactgcggctgcaagatccgctatactcatccacatgcggcatccgccgaaggatgcttccatgctcctccgtccgtccgccttgctataagaccgcatgcatccacctttaacctagctcttgctgtaggttacatgcttgactgcgtgtcccttcgcactcaagatggaaaaaatacatgtcaagcgctaattatcaattcctaacgagaccctgtatgtacccagtatgccctatagtgagatctattan

SEQ ID NO: 61999 - DNA, 674 bp, Zea mays
  misc_feature: Ceres CLONE 1526303
  misc_feature: Encodes the peptide sequence at SEQ ID NO. 62000
  misc_feature (400)..(400): n is a, c, t, g, unknown, or other
  misc_feature (674)..(674): n is a, c, t, g, unknown, or other
aagctggagctccccgcggtggcggccgctctagaactagtggatcccccgggctgcaggaattcgtctcacccctagaaaaacgtacgtacatgcacaaaactagagcgagctgtgtgtgtgtgtgttcgtcatttcctcgatcatggcgaaggcgcaggcgcaggtggcggcgaggttcatgatggaggcgccgccgccgcaggtggtgtcggtcatgcggcggaggaaggcgccgaggagcctgagcaccatcgccgaggacgacagggagatgctggcgccgtgcgggtcaccgtcggaccacggccacgtacatacacataactagagcgagtagagataccgtctcttactgtgtgtgtgtgtgtgtgtttatgagcggcgtcgatgcatggcnaaggcgcaggcgcaggtggcggcgaggttcacgacggaggtggcgccgccgcaggtggtgtcggtcatgcgacgaaggaaggggccgaggagcctggacaccatcgccgaggacgacagggagcagcagctggcgtgcgggtcgccatcggaccacgggctcgcgacggcgtggtcgtcgctcccgaagataccggacgcacccgcagcccccgcgggaacgccccaggggggtccgtgaacaagggacctccaccaggaacttcttggactcn

SEQ ID NO: 62000 - protein, 81 aa, Zea mays
  misc_feature: Ceres CLONE 1526303
MAKAQAQVAARFTTEVAPPQVVSVMRRRKGPRSLDTIAEDDREQQLACGSPSDHGLATAWSSLPKIPDAPAAPAGTPQGGP

SEQ ID NO: 62001 - DNA, 639 bp, Zea mays
  misc_feature: Ceres CLONE 1526306
  misc_feature: Encodes the peptide sequence at SEQ ID NO. 62002
gcctgcgtcgctttcggctgcatcgctagcactagcagcggggtggggtactggggtgggggtcgtagtcgtgctaagcaagcagcgatccgcaccagaatccatccaatcgcgcggccatgggcgacggcgagacgcggctggtggccgccgtgtcggcgaggaagtggctggaggacccgcgcttggggtacgacggcggcgtcggcagccaggcgctgagctgcgtggcgatcgccggtgcgcgggtctccgtcgccgagcgcggccgcgtcgtctgctcgctccgcgtgcgcgcccccgtcgccgacgcggaggggaggtggcacgccggagcgatcgcggcggcggtggactgcgtgtgctcggcggtggcgtacacggtggaggccgcggccacggccaccgtccactacagcttgtcctacttctcgccggccgattgcgacacggaggtggaggtggaggggcgagtggtgggccggaaggggaagctgacggccgcggtggtggtggtgcgcgataaggagtccggcgagctggtcgccgtagggaggcagtgggtgacccccgcctggccgaccaaggccaataaaaccagcaagctctgaagaagaaggagaaaaaaaaaaaaaaaaa

SEQ ID NO: 62002 - protein, 163 aa, Zea mays
  misc_feature: Ceres CLONE 1526306
  misc_feature (66)..(142): Pfam Name: 4HBT Pfam Description: Thioesterase superfamily
MGDGETRLVAAVSARKWLEDPRLGYDGGVGSQALSCVAIAGARVSVAERGRVVCSLRVRAPVADAEGRWHAGAIAAAVDCVCSAVAYTVEAAATATVHYSLSYFSPADCDTEVEVEGRVVGRKGKLTAAVVVVRDKESGELVAVGRQWVTPAWPTKANKTSKL

SEQ ID NO: 62003 - DNA, 692 bp, Zea mays
  misc_feature: Ceres CLONE 1526307
  misc_feature: Encodes the peptide sequence at SEQ ID NO. 62004
  misc_feature (394)..(394): n is a, c, t, g, unknown, or other
aaagctggagctccccgcggtggcggccgctctatttctcgtggatcccccgggctgcaggaattcctctcacccctagaaaaagcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaaggacggggcgaacgtcnaccgatacagcccaatctacaacgaggatgactggtctcccaccggcgacgtctacgtcggtggaacccctgggcttctgatctgggccgtcaccctcgctgggaatccccggcgggggcggccctcctcgtccacaaacaccagcgcccctctccgggttagagaatccaaatgcccgcctcttcttgcgaattcgcccttgtaaaaacaagggtgtcttttcataaaacctaaccccccctgggggctccagccttctgctatggaaacccaaaattcagttgcgcacctttttca

SEQ ID NO: 62004 - protein, 144 aa, Zea mays
  misc_feature: Ceres CLONE 1526307
  misc_feature (32)..(129): Pfam Name: PsbR Pfam Description: Photosystem II 10 kDa polypeptide PsbR
  misc_feature (77)..(77): Xaa is any aa, unknown, or other
MAASMISSSALAVAPQGLPPLGRRASSFAVVCSKKKIKTDKPYGIGGGLTVDVDANGRKGKGKGVYQFVDKDGANVXRYSPIYNEDDWSPTGDVYVGGTPGLLIWAVTLAGNPRRGRPSSSTNTSAPLRVRESKCPPLLANSPL

SEQ ID NO: 62005 - DNA, 904 bp, Zea mays
  misc_feature: Ceres CLONE 1526308
  misc_feature (32)..(32): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
cctcccttatccaatttttaaacctcataccnggnggggctcnnnnnccaaactggcactccccgcggtggcggccgctctagaactagtggatcccccgggctgcaggaattcgtctcacccctagaaaaatgcaccggagcttgtcgcaaaggggagccgtatcctgtacagtgcggggagcaggagccggcggagccatggggaccactctttcgtgagcctctcccctcttcgtcggagctccggccagagctagagatgtggttccgtacggagtgacttgggttagtgaataattgaggactctaaatgtgctagggaagggttacacgactactcgttccggccccgggagcacccgcatccgaactggctttcgtgtcttattgtttggaaagggaattaataggcttgaggcctctggcttgttcccgagaccctcttcctattgggtcggccccctccccctaaaccttggcgaatttacccggtagcctttttgacatactctccgtgacaaaatccctcttgagttctggcctgccctccccggcgaggcccactcgctccggggggctcttccgtcccgtttgctggcgcctcgcggcacctctacccaagaaagtatggaacgggcaccgcctatctttttcatttcacttgcgcgtccccctttgtggatagtttcatacgctcctcgcgacttagccgcggtctgtaagtaaagctcctacggcgtttaacagtggtgatatttctagtccgaggttgtatttgcgggaccttgttgcgcgcgactatccagctccccttgccaatgcgaacattgcgaggacctatggccggttgttacatcgccgaatgccctatcgcggcgagcgccgttcttcttttttttgtg

SEQ ID NO: 62006 - DNA, 674 bp, Zea mays
  misc_feature: Ceres CLONE 1526309
  misc_feature: Encodes the peptide sequence at SEQ ID NO. 62007
ggcggccgctctagactagtggatcccccgggctgcaggaattcgtctcacccctagaaaaaaccccgaccgactgctccccctcccccgcaccagcctcaaggcatcgccggcgccgcaacatcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatgatccttgggccggcgcagtcgccctatgaaggtggagtttttaagcttgaactctttttacctgaggaatatcccatggctgccccagaggttaggtttctgacaaagatttatcctccccacattcacaagcttggtaagatatgcctcgacattcttcaggacaaagggagcccagcacttcagattcgaacagttccttttgagtttccaggctcccccgagtggcgccaaatccttggacgacccttctttccggataaccattgcccaagcacttggcaacagccacatggcagtattaaacccgtgttgaacccctctttaagggaggtggcaacccctccctgcattgtcccacccgggcttcattgacaaaactctcattttatttttt

SEQ ID NO: 62007 - protein, 164 aa, Zea mays
  misc_feature: Ceres CLONE 1526309
  misc_feature (9)..(131): Pfam Name: UQ_con Pfam Description: Ubiquitin-conjugating enzyme
  misc_feature: SWISSPROT Homolog: EC 6.3.2.19 Ubiquitin--protein ligase
MANSNLPRRIIKETQRLLSEPAPGISASPSEENMRYFNVMILGPAQSPYEGGVFKLELFLPEEYPMAAPEVRFLTKIYPPHIHKLGKICLDILQDKGSPALQIRTVPFEFPGSPEWRQILGRPFFPDNHCPSTWQQPHGSIKPVLNPSLREVATPPCIVPPGLH

SEQ ID NO: 62008 - DNA, 714 bp, Zea mays
  misc_feature: Ceres CLONE 1526310
tggcggccgctctagaactagtggatcccccgggctgcaggaattcgtctcacccctagaaaaaactctcctcattctccacaggctgagcagcagccgccccaatctgcggttcaagaaccgcccacgcagaacccctccgccctccgctccttctagctcgctctctacctgcaccagactcgcccacccttcgctcgccgcctccatggggaggggaaagttcaagggaaagcctaccggtcgccgcagctcctcccccccgcaggacaccggtgacgacgtcgcccccccccccgcggggcccctttcccgtgtcagattcctattgccgtattggtttggttccccccccctccaccgggggggggcggggccgaccccaaatcgctcttcgatatggttccgacttttgtttgtcgcgtccttgtcgcgcttcccatcctgccatccccattcgccctgaaggcacatttcccccttcttttccccccgcggtcctggttgtttttacacggcccttcgcatcatgagctattcgcccctctccgtaatattttatcctagccgccccaatacttccctaacccaccgcacccatgtcacccacccctactgccctctttcgccacacctccatcccccgccctctccgccttctgtcatgagcctccgatttattccccccacttacatgaccacgcatatatcccg

SEQ ID NO: 62009 - DNA, 681 bp, Zea mays
  misc_feature: Ceres CLONE 1526311
  misc_feature: Encodes the peptide sequence at SEQ ID NO. 62010
acagctggagctccccgcggtggcggccgctctagaactagtggatcccccgggctgcaggaattcgtctcacccctagaaaaaaacaacctcctcctcctcctaagaatctctcatctgagatacagacagattaatcaacgcccgcacctcctatgggcacgaccggcgacgctccggctccggcgggggatccgcaggaccgccaccgtacccaccccccggcgacgaagcagcggacgacgctggtgttcacgtacgggacgctgaagcgcggcttctccaaccaccgcctcctggaggagctcttcgcgagcggggacgcgtcgctggtgggccccgcggtgacgtcggcgcggctgccgctggtgtgcgggccgtaccgggtgcctttccttctgaacctccccggcgccggcgccggggcgcaccgcgtgcgcggggaggcgtacgcggtgaccgcccgcgggcttgcgcggctggactagctggagggcgtggagacgggtcactactaagcggcttgcccgtgcccctggaacctctatgggcggccgcccggagggatgccaatcgcctaccttcctggcacccggaacttacgcccaactaccatatggtcggcccccccctggcgaaaaagggccgctccccccaaattttaccccccggccgcggggg

SEQ ID NO: 62010 - protein, 110 aa, Zea mays
  misc_feature: Ceres CLONE 1526311
MGTTGDAPAPAGDPQDRHRTHPPATKQRTTLVFTYGTLKRGFSNHRLLEELFASGDASLVGPAVTSARLPLVCGPYRVPFLLNLPGAGAGAHRVRGEAYAVTARGLARLD

SEQ ID NO: 62011 - DNA, 659 bp, Zea mays
  misc_feature: Ceres CLONE 1526316
  misc_feature: Encodes the peptide sequence at SEQ ID NO. 62012
aaagctggagctccccgcggtggcggccgctctagaactagtggatcccccgggctgcaggaattcgtctcacccctagaaaaagaaatccactcacgagcgaggtagaagagggacagaggtagggatagattctcgggctccacgcctctcgcaagcatccgtcctgacccgaccagctttgagatcgcgatggcggatggccgctgctgcactttcctggagatcctcttcgccatcatcctcccgcccctcggcgtcttcctccgattcggatgctgcaaaatatagatctgcatctgcctgctgctcaccatccttggctacgtcgccggaatcatctacgcgatctatgtccttgttgctctcgactctgaccagcatgagagggaatactacacccttgcttagatcatctggttgtgccaggatggcctgcacagctgagtcgaaatcagtatgttttttctcatgagcatagtctgacatgctataatgggcaatgggttaccaagtgctgtggtctatatctctggtacccaactcgtgagctctctttagtgtgctccagataatcaatctcgaattgtgagactacaagaaagtaacatgggcatgtatctctgacaggcactgtgatttccgaatgttgctacctg

SEQ ID NO: 62012 - protein, 32 aa, Zea mays
  misc_feature: Ceres CLONE 1526316
MADGRCCTFLEILFAIILPPLGVFLRFGCCKI

SEQ ID NO: 62013 - DNA, 707 bp, Zea mays
  misc_feature: Ceres CLONE 1526318
  misc_feature: Encodes the peptide sequence at SEQ ID NO. 62014
  misc_feature (707)..(707): n is a, c, t, g, unknown, or other
acagctggagctccccgcggtggcggccgctctagaactagtggatcccccgggctgcaggaattcgtctcacccctagaaaaactcttccccccactacccaaacccaacaggcggcgcagcagcatcgccaccaccgtccaaagatggtgaagttcctcaagcccggcaaggccgttatcctcctccagggccggttcgccggccggaaggccgtgatcgtgcgcgttttcgaggagggcacccgtgatcgtccctacgggcactgcctcgtcgcgggcctcgccaagtaccccaagaaggtgatccgcaaggactccgccaagaagacggccaagaagtcccgcgtcaagtgcttcatcaagctcgtcaacttcacgcacctgatgcccacccgctacaccctcgacgtcgacttcaaggacgtcgcatcgggcgggcccgacgcgctctccacccgggacaagaaggtcgaagcctgcaaggccgcccaagcgcgcctcgaggagaggttcaagacccggcaaaaacaggtgggttctttaccaaaacttccgctttctagacgttcgggcctcccccccaaagtggcctgaattttaatttgtcaaattttccttggtacctcgaaaacccctttaaacggatttcttcttgtttttggcttattttcccatgaaaaggctttcacgggcctttggaaatgn

SEQ ID NO: 62014 - protein, 149 aa, Zea mays
  misc_feature: Ceres CLONE 1526318
  misc_feature (52)..(127): Pfam Name: Ribosomal_L27e Pfam Description: Ribosomal L27e protein family
  misc_feature (7)..(40): Pfam Name: KOW Pfam Description: KOW motif
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVEACKAAQARLEERFKTRQKQVGSLPKLPLSRRSGLPPKVA

SEQ ID NO: 62015 - DNA, 851 bp, Zea mays
  misc_feature: Ceres CLONE 1526319
  misc_feature: Encodes the peptide sequence at SEQ ID NO. 62016
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
tttggttagtagaatttttatatgctctttttcccnnnncctccaatccccaaaaactggactccccgcggtggcggccgctctagactagtggatcccccgggctgcaggaattcgtctcacccctagaaaacgccgccgccgacagacggaaggagaagagggtacggccgtctccttgtccccatggcccacgagaagaagctgtccaacccgatgcgggagatcaaggtgcagaagctcgtcctcaatatctccgtcggggagagcggcgaccgtctcacccgcgccccaaagtgctcgagcgttttagcggccagacccccgttttttccagggcgaggtacaccggtgaggtccgttctacattcggcgtaaccgagaagatcggcttgctatatcacggtggggcggcgaaaaaggcccatgcagcctgcctatgagatcgggccctccagggtctaaaggccccctctaagcttgtctcccccgaggacaccctctcccccacccccctggggtggctttgagcgcttcccccggtttccccaatgaggcccaccgtccccaacccttctgggtttttaaaagagaccaagattctcggtacccccttcggtctctcttttcccccgccattttaatatgcccttcccgccctgggccctgtgaccccgcagcttagccccaccctgtccgccggggttcaccctcttatttgtgttttgcttccccccccctctctcccgctaactctccgaatgcccgctgcaccccctattccagggcctcccccccccagtttgggttttaagggttcacgctccgcccacgctggttttccccccccc

SEQ ID NO: 62016 - protein, 63 aa, Zea mays
  misc_feature: Ceres CLONE 1526319
MAHEKKLSNPMREIKVQKLVLNISVGESGDRLTRAPKCSSVLAARPPFFPGRGTPVRSVLHSA

SEQ ID NO: 62017 - DNA, 719 bp, Zea mays
  misc_feature: Ceres CLONE 1526320
  misc_feature: Translation starting site: 95
aaagctggagctccccgcggtggcggccgctctagaactagtggatcccccgggctgcaggaattcgtctcacccctagaaaaaattaaagaaaatggagattttcttgggcggtcttcggcttcattgtcaccaggttcgagttcgtcaccgtcaagtacgactgtgcgagggaggaagaggcgatgacaacatgcatatcttcgtgaagaccctgacggggaagaccatcaccctcgaggtggagagcaacgacaccgtcaacgacgttcaaggccaaaatccaggactgggaagggattcccccatatcaccagcgactgatattcgctggcaagcacctggaggatggacccacacttggctcactccccccccgcgggggggggcggctcttccttttgggccttccggtttagggtggaacccatcctccaacgtcgaaactcctccccgcggaaagacattgaccctccatttttaagccccctgcccccgtttgattcgggattcaggacccttggtccacacataaaagcaagggcctttttctccccgacgaccttataaggctttttcccacgccgtggcaatgccaacctcccttaactgccccccccccccacaaggacctcttcccccttccgccgcgggcggatcccccccccctctcccctagtttccccggtcccccccccgcggacgggttagtcccacct

SEQ ID NO: 62018 - DNA, 582 bp, Zea mays
  misc_feature: Ceres CLONE 1526321
  misc_feature: Encodes the peptide sequence at SEQ ID NO. 62019
  misc_feature (280)..(280): n is a, c, t, g, unknown, or other
  misc_feature (456)..(456): n is a, c, t, g, unknown, or other
acactggagctcccgcggtggcggccgctctagaactagtggatcccccgggctgcaggaattcgtctcacccctagaaaaaaggggaggcaacctccgcgccatcgccagctgcgcagtcgtctcccacgtgctagcacaacgagtagagctagcagggtatctgccatccccatggccgtctccatcgccggcagcagcatccgcctccacgttgccccgcccagtcgccgccacgtcagcgtggtctgcgccgtcgtcgctggctggctcgatcggnactcgacggccatgctcctgctgtccacgggcggttcgagtaacattcggcagagacacctcccccagcgagcgcgacgagcatcgactctcggggtgggccagaactgaaaaccctgacgaaggcggcaccaaggcctaaagggaagtggagaagccttcccagagagggcggcnaaaccccccggattcccatggaaaaccccccaggaaggcggagcctaaagcttttttaaaggggaaaaaaacccctgagcctttgccgggaaaaccccctaaagggcgccggtcaacaaaaaaaaa

SEQ ID NO: 62019 - protein, 71 aa, Zea mays
  misc_feature: Ceres CLONE 1526321
  misc_feature (36)..(36): Xaa is any aa, unknown, or other
MAVSIAGSSIRLHVAPPSRRHVSVVCAVVAGWLDRXSTAMLLLSTGGSSNIRQRHLPQRARRASTLGVGQN

SEQ ID NO: 62020 - DNA, 712 bp, Zea mays
  misc_feature: Ceres CLONE 1526322
  misc_feature: Encodes the peptide sequence at SEQ ID NO. 62021
  misc_feature (712)..(712): n is a, c, t, g, unknown, or other
acagctggagctccccgcggtggcggccgctctagatccagtggatcccccgggctgcaggaattcgtctcacccctagaaaaacctagaaaaaagaccagtgccagacgcagacgggcccttatgcctgcgtgcgagcatcacgtcgtcgatctccataggatatgtccgcttcgatgaagaagggaaacggcctcgctcgcctgttggcggtggacctccccgactcctcctcctactcccccgacgtccccaacacgaccagcttcgccagatacgaagaatgacgatgacgacgcggatggagcgagcttccccacggtctactaggttgcatggaacgcgcacacagcttgggaagttttttttgttccgttctagaggggggggaggatgggatttatcatgaggatggccgtgatcactggcgacttcttcgccttcagaattttcttctgtgctcttggggtaccccgtcaacggtctccgatcttgttgggaaagtttttggacccctttaaggtaccctcggggggaatactttttgttccgaaactgccttctttcctggtgttctacttttgggtgccattgggatttgggggatttgggaaatttttaatttccattgggggccttgttttctcaacaaatatagattctcaaattgggcgaggtatttttatttgggctctccgtattctcggagaan

SEQ ID NO: 62021 - protein, 36 aa, Zea mays
  misc_feature: Ceres CLONE 1526322
MKKGNGLARLLAVDLPDSSSYSPDVPNTTSFARYEE

SEQ ID NO: 62022 - DNA, 875 bp, Zea mays
  misc_feature: Ceres CLONE 1526322-R
  misc_feature (740)..(740): n is a, c, t, g, unknown, or other
cctcgagcgtctcgttttttttttttttttttctgggtgaaaagacccggaacttcgtgtattcaggggtgtatggtaaaaatgtcactcggtattaatattacaactagtaaaataagttcaaatggaaatggacattaaattaaggggagccctcctccggtatattctacctcccgagcatgagccagagaagacactccggtctgatggattatctttgatgagggccccatgtattacgcattcatatgcctattcccctggcagccagactgagggaactgacgagcaggtaccgagcatactatcaaaccttgggacgtcagtgggtccaaaactttcccgggcaatctgaaaatttttaacggttttcccggggaaaaaaaaagctattccggaggctcaaaaaaggggcaggaggctcccctgccccccaggggtgttaaaaacccccgggaaaaattgggtgttttttaaaaaaagaccttttgccaaaatttttttcccaagttttttcgcgcccctttaatggggacacatgggaaatcctttggccgggggggccccccccccccgggggtgttccccttttaaagggggggggttttttttaaaaacacccctttttttttggggaaacccgggggggaaaaaaaaaaaaaaacccctctcgggggggtataaaaaaaaaaaaacacccccccccccttctctttttttttttttataaacacccnggtttttttctctcccccttgtttcctaggggggggggggaaaaaaaaattttattccccccccgcccgcgggggggtatgactcttctttcattaacgacagagggaaggcctgcctccatctcgtttggtttc

SEQ ID NO: 62023 - DNA, 753 bp, Zea mays
  misc_feature: Ceres CLONE 1526323
  misc_feature: Encodes the peptide sequence at SEQ ID NO. 62024
  misc_feature (37)..(37): n is a, c, t, g, unknown, or other
cacggggtttttttgttttttttgttctttctttttntagttaattcgcatactggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcttcgcctgggccacggacgaccactccctccacaacgccttcagcacctacggcgaggtcctcgtagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcagcggtgggtacagtggtggccgtggaggcggccggctactgcggtggtgggcgcctttgatggccggtggcggctaccgccggtggcggccggctaccgatgccggctggcaggcttacgggggtggtgggcggccggctaaacggcaggtgggaaacccatgggcttggcgggcttaccggcaaaattccgtaacggggaaaatttgggaaggaaacctttaagcttgctgggggggccc

SEQ ID NO: 62024 - protein, 106 aa, Zea mays
  misc_feature: Ceres CLONE 1526323
MRNAIEGMNGKELDGRNITVNEAQSRGGRGGGSGGYSGGRGGGRLLRWWAPLMAGGGYRRWRPATDAGWQAYGGGGRPAKRQVGNPWAWRAYRQNSVTGKIWEGNL

SEQ ID NO: 62025 - DNA, 657 bp, Zea mays
  misc_feature: Ceres CLONE 1526325
  misc_feature: Encodes the peptide sequence at SEQ ID NO. 62026
aaagctggagctccccgcggtggcggccgctctagaactagtggatcccccgggctgcaggaattcgtctcacccctagaaaaactagaaaaaattcggaggcacgcactcggctaggcgcagaggctttctcctcccccaagccgaaacaccagagggcgagactcgagagagaagagcggcgcggcggaggacagcactggatggagccctcgccggcggcgggagagcttggcgcgatgcttcgtgcggccgctgacttcgcgtcctacccagggttgcatagtgatgatactgtgaggcagttcctggaacgatgtccgctgcctaagctcttaggtgcattgcagagtgaagcagatgtacctgggatggttgaaactgtcacagagtgtctagacaaaatattttcctcaagatatggagcgtcacttctgccaaactacggtgcatttattcaagctgggttgctcacagactcgaagcaaatcagaaaattagcctgcaaagctgtactccatcttcttgacaaggctgaagatggtgctgctgctgtggaaacagttgtgcagcataatctgtatcctcttctgatcaaatgtttgattgagggagatgaagaaattcagcaatcgttttgacactgtaaagcgttga

SEQ ID NO: 62026 - protein, 145 aa, Zea mays
  misc_feature: Ceres CLONE 1526325
MEPSPAAGELGAMLRAAADFASYPGLHSDDTVRQFLERCPLPKLLGALQSEADVPGMVETVTECLDKIFSSRYGASLLPNYGAFIQAGLLTDSKQIRKLACKAVLHLLDKAEDGAAAVETVVQHNLYPLLIKCLIEGDEEIQQSF

SEQ ID NO: 62027 - DNA, 775 bp, Zea mays
  misc_feature: Ceres CLONE 1526334
  misc_feature: Pfam Name: W2 Pfam Description: eIF4-gamma/eIF5/eIF2-epsilon
  misc_feature (1)..(1): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
ntttttttggggtgccctccttgccctcataattnnnnnnnnnggnnnnnnnnccaagctggaactccccgcggtggcggccgctctagaactagtggatcccccgggctgcaggaattcgtctcacccctagaaaaaaatgctttttgcacgagtggcagactcgaactggaacttatatacaaagtacagacacagtgctatgaggatgctaagctgatgaagctgtttcctgaaatcataagaacactgtatgaccaagatgtcctagctgaagatactgtcctgctttggttccgtaaaggttcaaaccagaagggcaggcaatctttcctgaaagctctgggagccgtttgtcaaatggctccaggaggctgacgaggaagaaaaagtttttgatttggacgaacggtccaattgctgcccccccccccctaaggggggggggggccgaaccttcacaagttttctggagggaaattatggcttgtctgcccctctaaaactgcagcaaaaatttttcctccccccgcatggtttcagcccaccattagatccccccgccttgtcctgaggagcccctgttacacgcggctcctcgcgtcccccaccctactgctatcacccgcccatatacccgccaaacacccatgggtgcgtacctagccaaccatcgctaaaaactaatcccatttaaccataccccccctctcccaatccgtcctgactaaccccgtatcgctctcatctcccccatatcagatgacccggcaag

SEQ ID NO: 62028 - DNA, 668 bp, Zea mays
  misc_feature: Ceres CLONE 1526335
  misc_feature: Encodes the peptide sequence at SEQ ID NO. 62029
  misc_feature (459)..(459): n is a, c, t, g, unknown, or other
  misc_feature (488)..(488): n is a, c, t, g, unknown, or other
  misc_feature (550)..(550): n is a, c, t, g, unknown, or other
aaagctggagctccccgcggtggcggccgctctagaactagtggatcccccgggctgcaggaattcgtctcacccctagaaaaaaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaaggttcatgttgttttgttttggtggtcgagcatcgcatgttctgcttctggttccagatctggagaaatttctaagtcgtcgtcgtcgtcgtcgttcggttcngagcggatctgaggcgacgatggctggangcggcgggatctcttggtctgcagtcctgcttcacctcgatggatgatgtctctgcgctgantattattggatcaatttcgaatattattagtagatctatgagatatgcccccctgaaagaggcgaggtaagctgcagcatgtaaaaagtctgcgtgcctccaacagtaaaaaaaaaaa

SEQ ID NO: 62029 - protein, 57 aa, Zea mays
  misc_feature: Ceres CLONE 1526335
  misc_feature (33)..(33): Xaa is any aa, unknown, or other
  misc_feature (43)..(43): Xaa is any aa, unknown, or other
MLFCFGGRASHVLLLVPDLEKFLSRRRRRRSVXSGSEATMAGXGGISWSAVLLHLDG

SEQ ID NO: 62030 - DNA, 667 bp, Zea mays
  misc_feature: Ceres CLONE 1526340
  misc_feature: Encodes the peptide sequence at SEQ ID NO. 62031
atagctggagctccccgcggtggcggccgctctagaactagtggatcccccgggctgcaggaattcgtctcacccctagaaaaagctattcgtgtcctggcatccgcagagagtttgttccgtccaggcaaccaaaaagcgttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccggttccagagccacgccgtgctggcgctccaggaggccgccgaggcctacctcgtcggcctcttcgaggacaccaacctctgcgccatccacgccaagcgcgtcaccatcatgccccaggacatccagctcgcccgccgcatccgtggcgagcgcgcgtagccatcatcttcgaggatctgatgaatgtctagttaccaaacaaataggccgtattagcgtcgttgttctgtattcgt

SEQ ID NO: 62031 - protein, 136 aa, Zea mays
  misc_feature: Ceres CLONE 1526340
  misc_feature (58)..(132): Pfam Name: Histone Pfam Description: Core histone H2A/H2B/H3/H4
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPQDIQLARRIRGERA

SEQ ID NO: 62032 - DNA, 669 bp, Zea mays
  misc_feature: Ceres CLONE 1526342
  misc_feature: Encodes the peptide sequence at SEQ ID NO. 62033
  misc_feature (427)..(427): n is a, c, t, g, unknown, or other
cacagctggagctccccgcggtggcggccgctctagaactagtggatcccccgggctgcaggaattcgtctcacccctagaaaaaaccgagcagcaacaagccaacaactaaaggcaggcgcggcacaccgcgacaccgtaccggcctagacacttggagaaaggagaagcagcgcagcggcatgggcaccagtcctgtcatccctgcgacgatgctcgtcgtcgctctccttgtcgctagtagtactgtctgcttcggcgccaccgccaccgacaccgacaccgacggcgccattcgtctccccagcagctctggtgctgttggtcgaccgtgggagtgctgtgactatgtcaccaaggagccgtttatcacgccgccccggtggcgctgcaacgacgtggtggacaagtgctcccccgactgccnagagtgcgaggagtcgccggccggcgacggcttcgtctgccgtgactggatcttcagcctgctcgagcccccggtctgcacacccaggccgtgggactgctgccactttcgccgtctgcacaagggactacctccccctacttgccaggcggcaacgtggggggaatcctgcccccacaactgcaaaggcgtgcaagcttgtggaagtcggaacctccttcgcttaccgagccctaaacctg

SEQ ID NO: 62033 - protein, 162 aa, Zea mays
  misc_feature: Ceres CLONE 1526342
  misc_feature (82)..(82): Xaa is any aa, unknown, or other
MGTSPVIPATMLVVALLVASSTVCFGATATDTDTDGAIRLPSSSGAVGRPWECCDYVTKEPFITPPRWRCNDVVDKCSPDCXECEESPAGDGFVCRDWIFSLLEPPVCTPRPWDCCHFRRLHKGLPPPTCQAATWGESCPHNCKGVQACGSRNLLRLPSPKP

SEQ ID NO: 62034 - DNA, 882 bp, Zea mays
  misc_feature: Ceres CLONE 1526344
  misc_feature: Translation starting site: 222
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
cccttccctatttnnttnttgaggctctctcttgnttttttnnnnnnncaaactggaactccccgcggtggcggccgctctagaactagtggatcccccgggctgcaggaattcgtctcacccctagaaaaacgtgctctctcggaggtgggctggcttctcctccccctcttaccaagtcctcttcgggttagggttacttagggttttgtggaggggcgatggcggctgctgatgtggagtaccgttgcttcctcggcgggcttgcctggggcaccagaaacgagtcgctggacaatgccttcgcctcctacggggagatcctcgattccaaggtcatcaccgacccgggagacggggaggactcccggtttcgggttccttaccttttcctcccaagaactccatggttcgacgctatccgggaacatggaacgggcaaggtagctcttacggcccgtaaaaatcaaccgcccacacccagggccccaatctccctttgagcgtttggcctgatatctcagccgcctgtgctatatggaccgccctgttttcaccggtcgtgctgttctggccttatcgttccgcgccgggtcccttactccgcaaaccgtcccgttttctttgagcctgcccgcgcctgcgttttgtctctcccgcccattttctcgctccccactaatcctctttggcagcaccacttgcgtcctcaccaccaatacctccccttcgcgcccctctttatttgtgatttatcagccacccctaatgttttggatagattcccgcttcgcttaaccgttccctgcactccgaccagcccctattctggtgagtgtgtaacgtgcaccttgggatcttccccattttttctagttcctt

SEQ ID NO: 62035 - DNA, 665 bp, Zea mays
  misc_feature: Ceres CLONE 1526348
  misc_feature: Encodes the peptide sequence at SEQ ID NO. 62036
aagctggagctccccgcggtggcggccgctctagaactagtggatcccccgggctgcaggaattcgtctcacccctagaaaaaaccgcctcatctgctctcttcccccgtcttcttcccaagctgccacgttgcctccctccgctccagcggcccatggcctccatggcgttcgccctggcgggggccttcaagggcctctccctggcgcccaccaccaccacctcctccttcccgcgctgcgaccgcgcctcgctctccgtcggcggcgcagcgggcgtgccggtgccggtgccggcgcggcggctcaccatccagatggcgcacaagaagggggccgggagcaccaagaacggccgcgactccaagggccagcgcctcggggtcaagatatacggcgaccagctcgccaagcccggggccatcatcatccgccagcgcggcaccagggtctatcctggaaataacgttggaatgggcaaggatcacacactcttttctttgatagatggactcgtcaagtttgagaagtatgggccggacaagaaaaacgttagtgtttacccatatgagaaggagcctgaaaacccaaacagttacagagcaagaagagagagtacttccgcatgcggcgtgaacggaagaaagcgagagcggagggcgccc

SEQ ID NO: 62036 - protein, 170 aa, Zea mays
  misc_feature: Ceres CLONE 1526348
  misc_feature (56)..(136): Pfam Name: Ribosomal_L27 Pfam Description: Ribosomal L27 protein
MASMAFALAGAFKGLSLAPTTTTSSFPRCDRASLSVGGAAGVPVPVPARRLTIQMAHKKGAGSTKNGRDSKGQRLGVKIYGDQLAKPGAIIIRQRGTRVYPGNNVGMGKDHTLFSLIDGLVKFEKYGPDKKNVSVYPYEKEPENPNSYRARRESTSACGVNGRKRERRAP

SEQ ID NO: 62037 - DNA, 667 bp, Zea mays
  misc_feature: Ceres CLONE 1526352
  misc_feature: Encodes the peptide sequence at SEQ ID NO. 62038
aaagctggagctccccgcggtggcggccgctctagaactagtggatcccccgggctgcaggaattcgtctcacccctagaaaaaaagaccaccgacgcgtagcacagtccattattgccgtctcccttttgcgtgagcaaagaaagagagcgagaagagcagtcgccatgtctggcatcatccacaagatcgaggagaagctccacatggggggcgaccacaagaataaggaggaggagcaccacaagaaggccgaggagcaccacaagaaggaggagggggagcaccacaagaatgacggcggggagcacaaggaaggcatcgtggagaagatcaaggacaagatcaccggcgagcacggcgacaagtccggcgaccactaggaaaagaaggacaagaaaaagaagaagcacggcgagggccacgaccacgacggcggccacagtagcagcagcagcgacagcgactgagatctggtgtcgcaacacaggtgctacacatgtatgcttgctggatgggagcatcataccagctgatgctgatgtagtgtttcactggtgtcatgcatgtatcgtgctactatactcaaaaggaaaaaagaataaccgtcagggatgctttgtttggcatgtgatcttgtacactcctactaaattatggctgctgg

SEQ ID NO: 62038 - protein, 71 aa, Zea mays
  misc_feature: Ceres CLONE 1526352
  misc_feature (2)..(71): Pfam Name: Dehydrin Pfam Description: Dehydrin
MSGIIHKIEEKLHMGGDHKNKEEEHHKKAEEHHKKEEGEHHKNDGGEHKEGIVEKIKDKITGEHGDKSGDH

SEQ ID NO: 62039 - DNA, 610 bp, Zea mays
  misc_feature: Ceres CLONE 1526353
caagctggagctccccgcggtggcggccgctctagaactagtggatcccccgggctgcaggaattcgtctcacccctagaaaaaacctccgccagccactccaaacacttgcgccgccgctgcctcacaggtaaggccgccatggtctccggttcgggcgtgtgcgctaagcgcatcttgatcgacgcttgccaccacttggctgggcccttttctccctcgaatcttatcccaaggaattttctttaaagggcccaaatagggggttgttctttttcctttgcaaagaaaaattctctacacctttcgtggggtgggctcccttccatacccccacaaaaaaaaaaaaaattctcccttttttttccccaaggggggtttaaaaaccaggggcgtatctcataggccccctctcccttctctctggggggggggggaagaaaaacttctctgtggttaacacctccttgggccgccaaattttttccaacacaaaaaacaaattttgtggcgatctcctttttttccccccccttttttttagatagtatagtgcctcctccccccccctttcccttacatacaaatccccccccccgttttttcttcc

SEQ ID NO: 62040 - DNA, 670 bp, Zea mays
  misc_feature: Ceres CLONE 1526357
  misc_feature: Encodes the peptide sequence at SEQ ID NO. 62041
acagctggagctccccgcggtggcggccgctctagaactagtggatcccccgggctgcaggaattcgtctcacccctagaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgatttcaaaaagggtgtcgagggtgcaacccagttttccccttagcaagctgaaggacccccaatttttttgtttggggagtcccatgaaaggaagattgctcctgttgcaattccccctattaccaaggagtggtggccccctaattcccaacatttccccctattttcccccccgggggttcttacgggg

SEQ ID NO: 62041 - protein, 121 aa, Zea mays
  misc_feature: Ceres CLONE 1526357
  misc_feature (1)..(121): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLEPEKADDFKKGVEGATQFSP

SEQ ID NO: 62042 - DNA, 818 bp, Zea mays
  misc_feature: Ceres CLONE 1526360
  misc_feature: Encodes the peptide sequence at SEQ ID NO. 62043
  misc_feature (37)..(37): n is a, c, t, g, unknown, or other
atggaagggttatttattaaatcctcgaatcactttntttccctccctaccaagctggagctccccgcggtggcggccgctctagaactagtggatcccccgggctgcaggaattcgtctcacccctagaaaaagctctcaaatatctctcaccacctctcccctcagcttctccccacctttggtcaggcaggctcaggcaaagggggcggccaacaaggacgagcgatggcgaccaaggtcatctgcttccttgtgctcgcatccctgctcctcgccgtcgcctttcccgtgtctgctctgcggcaccaggtgaagaagggcggctgcggcggtggtggcggaggcagttgttagcggaagcggaggcggcaaccctgaatcccctggggagtgcttcgccccaatagcgggtcgcgggtgctcccaaagaccgcagtacaggaaaggccttgccctccaccttaatggaaacaaggtggcttggcgcccaaaggtgccctcctgccgttgccaacccggggggcttcttcccgggcaaaccaaaggggccccccctgggccccctggctaaccaacccaaccttgggaaaaaacccaaggggaagggggagggggccccaaagtggccccctctagaaaataaagaacccaactgggaaggcttcccccggtccgtacaattgggcccccccccttttctcccaaaattttgggacaacttggtttgtttccattttttccgaaccacccccccctaggggcctcgggaaatttttaattacctacgcaccaacggcgcccgtgtaccccccccg

SEQ ID NO: 62043 - protein, 42 aa, Zea mays
  misc_feature: Ceres CLONE 1526360
MATKVICFLVLASLLLAVAFPVSALRHQVKKGGCGGGGGGSC

SEQ ID NO: 62044 - DNA, 618 bp, Zea mays
  misc_feature: Ceres CLONE 1526361
  misc_feature: Translation starting site: 202
  misc_feature: Pfam Name: Sedlin_N Pfam Description: Sedlin, N-terminal conserved region
  misc_feature (454)..(454): n is a, c, t, g, unknown, or other
  misc_feature (461)..(461): n is a, c, t, g, unknown, or other
aaagctggagctccccgcggtggcggccgctctagaactagtggatcccccgggctgcaggaattcgtctcacccctagaaaaaaaagagcccagagcccgggaggttacttcgctgcctgagtccccggcaccggaggtcttgctaccggctggcggcttcttcttccgttccttcccaagtcctcttcccggaggaatcatgatcgtctgcgtcgccgttgtcggccaccagaacaatccgctgtacctgcagagcttcacggaggcggacgacgccctcaagctccaccacatcgtccactgctctctcgacgtcatcgacgagcgagtgagcaatcctaagaggagtgcacctacattgaatgagacatttttgggtcttctatacccaactgagaactacaaagtgtatggctatttgacaaacacaaaggtcagatttatcatggtcnccgactngatcttgatgtcaaagatgcagatgccagaaaattttttcaggagttccatgctgcatatgtagatgccgtctcgaaccccttccatgtcccagggaaagagattccttcaagaacctttggtgcaagagtagcacccttcgtttaaatccttccgt

SEQ ID NO: 62045 - DNA, 708 bp, Zea mays
  misc_feature: Ceres CLONE 1526366
  misc_feature: Encodes the peptide sequence at SEQ ID NO. 62046
acagctggagctccccgcggtggcggccgctctagaactagtggatcccccgggctgcaggaattcgtctcacccctagaaaaagcataccgaccttccttgcattttctcaataccttgaacaactaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcactccagaaaagcacaaccatggaccacccttccatttaaaccccccccccgggcgggggggggggactatatataccttatccttgcctcaaaataggccaataggtcctactttcaagtacccaatgctgccttggaacccctggaaaattttgcggaatcgaaacccccttggtttgataccccaaagcggaaaaaaaaaagtaatgggccaatttccctggggaaaattgtgtaaaattttatcgtggccaactatatcatttggggcgaaagaaatgaatacaagtggggcggtttcttttttgcgtgggcaccataactcgtaccatatcccccctcaccccggagaaatgttcttttgggggggcccacccctct

SEQ ID NO: 62046 - protein, 75 aa, Zea mays
  misc_feature: Ceres CLONE 1526366
MSHAQPLRLQAQWKHVDIQDNQANAMKEPGTSGGYGSPMKDDKNKDVDTIASNFIKLKHRAWALQKSTTMDHPSI

SEQ ID NO: 62047 - DNA, 649 bp, Zea mays
  misc_feature: Ceres CLONE 1526368
  misc_feature: Encodes the peptide sequence at SEQ ID NO. 62048
aagctggagctccccgcggtggcggccgctctagaactagtggatcccccgggctgcaggaattcgtctcacccctagaaaaaatagcacagcacaaggagaggccgagaagcgctttagccgtagccgtagcgataagagtgagctagctggtgcacaccggcatggcggccacggcgtactccgtggcgctcctcggcggcgcgcgccttcccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagctaactcccacgccgttgaggacaagcccaccgtcctcttgtacggcggcggcgccgtcgtcgccctttggctgacgtccgtggtcgtgggcgccatcaacgccgtgccgctgctccccaagatcctggagctcgttgggctcggctacaccggctggttcgtgtaccgctaccttctcttcaaggaaagcaggaaaaagttggccgcctacattgagaccctttgagaaaaaaataactggaacagaataacccctcctggaaagttttaaagcgccctttcctcctg

SEQ ID NO: 62048 - protein, 140 aa, Zea mays
  misc_feature: Ceres CLONE 1526368
  misc_feature: SWISSPROT Homolog: EC 6.1.1.9 Valine--tRNA ligase
MAATAYSVALLGGARLPAAPRSALLPRRSVCQLRFQDAPRLSLLRAKAASEDTSASGDELIEDLKANSHAVEDKPTVLLYGGGAVVALWLTSVVVGAINAVPLLPKILELVGLGYTGWFVYRYLLFKESRKKLAAYIETL

SEQ ID NO: 62049 - DNA, 636 bp, Zea mays
  misc_feature: Ceres CLONE 1526372
  misc_feature: Encodes the peptide sequence at SEQ ID NO. 62050
  misc_feature (576)..(576): n is a, c, t, g, unknown, or other
ccgctctagaactagtggatcccccgggctgcaggaattcgtctcacccctagaaaaaagcagtgacgaactccaagcttgcgttcttgtactagaggtcggcatcaagcggtacagcgagaggtctagaagatgaatatcagcactctgttggcgatcctagttctccaggcccttctggtctctgcggccgtggccaaaggacctgcatggccgatgacgaataatcagtgctggtgcggcgagtgcaccagctggtcgggcgtgtggacctgccacgacctcgtcaccaagtgcgccgccacctgacaagaactgcgtctccgtgtccacggacaaaggcaccacctagtacaggtgccgcgacttcctcccctagaactgcggctgcaagattcactagactcatcctcagcggcacaaccgatggatccttccatgctcctccgaccgtccgccttgctataagcaggctggcctccatcaataagctagctcatgctgttgttttgcatgtttgatagggtgtcactttccattcgagatggaataaagtcaatgtcaggcgctttgacnaccacatcgtggcagatacttcctttggaattttgctgttaacgggctctgtaaactccc

SEQ ID NO: 62050 - protein, 58 aa, Zea mays
  misc_feature: Ceres CLONE 1526372
MNISTLLAILVLQALLVSAAVAKGPAWPMTNNQCWCGECTSWSGVWTCHDLVTKCAAT

SEQ ID NO: 62051 - DNA, 649 bp, Zea mays
  misc_feature: Ceres CLONE 1526379
  misc_feature: Translation starting site: 164
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (422)..(422): n is a, c, t, g, unknown, or other
  misc_feature (474)..(474): n is a, c, t, g, unknown, or other
tccccgcggtggcggccgctctagaactagtggatcccccgggctgcaggaattcgtctcacccctagaaaaattctatgtcgaacagcgccgctagcgagaagcaagcgcagcagcaggccacaggcagcggcccccggcggcgtcggccgcggacgcggagatgcagagggtgttctgccgcatcgacgcggacggcgacggccggatctccgcctcggagctggccgcggtgacgcgcgccatctccccgctagcgagctcctcgcacgggcgccgcgaggtggccgccatgatggacgagctggacacggaccgcgacggcttcgtggacctcggcgagttcagggcgttccacgcgcgcggcggcggcggcgtggacgacgacgccgagctccgcgccgccttcgacgtccnnnaangtcgacggccgcgtcacggcggccgagctgggcaaggtgctcgcgcgcgtcngcgaaggcggatgcagcgccgaagagtgcgagcggatggtcgccggcgtcaacgccgacggcgacggcttgcgtccgggttcgaggacttcaagaagatgatgtggcccccagcgcaagccgagccggcgccggccgggcgggacagggacaaggcgagggccagggagagtgat

SEQ ID NO: 62052 - DNA, 629 bp, Zea mays
  misc_feature: Ceres CLONE 1526382
  misc_feature: Encodes the peptide sequence at SEQ ID NO. 62053
  misc_feature (483)..(483): n is a, c, t, g, unknown, or other
ggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtaccgtggtggccgtggnagcggcggctaccgcggtggcgggcgccgtgatggcgccgcggctaacgccgtggcggcggcggctacggtggcggcggcggctaagggggtggtgggcgcggttacggcggtggcaaccggtggggcggttagggaactcccgag

SEQ ID NO: 62053 - protein, 150 aa, Zea mays
  misc_feature: Ceres CLONE 1526382
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYRGGRGSGGYRGGGRRDGAAANAVAAAATVAAAAKGVVGAVTAVATGGAVRELP

SEQ ID NO: 62054 - DNA, 632 bp, Zea mays
  misc_feature: Ceres CLONE 1526384
  misc_feature (56)..(56): n is a, c, t, g, unknown, or other
tggcggccgctctagaactagtggatcccccgggctgcaggaattcgtctcacccnctagaaaaaaaagaaaaaaaaaaaaaaaaaaaaaaaagagagacggacacgcctcacccacaccacaagaacaccaaagccacatcccatccatctccacggtgaggcttgagcgacccgagcaaaaaaaaatcatccgcgaagcagcgacgcaggtttgttctctgatctctctggttcttcttttagcagcagggacgcacagcacaagaaaaggtccggttcaagaggctcttctgttgggtttttttttttagaatcctcaagagaagagtgttcttgggttaggatttttttctcacctcatcacacctctcctaggaggaacagagatccagagaaccttttttctcttctggatccttgccgccttttggccttcgaaagggggttgttttgcaataccctctctctctgtttttttttttttatcttggcacaaacccacctcgtttctctacttttattgaggaacagagctggttttcaaaaaaaaaatctacttttgattttcataaagaaaacctctcagcctctttctttctagcttcatccaagctttagaacctaagggcc

SEQ ID NO: 62055 - DNA, 494 bp, Zea mays
  misc_feature: Ceres CLONE 1526386
  misc_feature: Encodes the peptide sequence at SEQ ID NO. 62056
  misc_feature (243)..(243): n is a, c, t, g, unknown, or other
gcggtggcggccgctctgactagtggatcccccgggctgcaggattcgtctcacccctagaaaaaatccaactcacacacaggctcaccccaccaacagcaagcgaaatctcccgatcccctctggtctccgcggcgaaatgtcggggcgcggcaagggcgggaagggcctgtgcaagggcggcgcgaagcgccactggaagtgctccgcgataacatcccaggggatcacgaaacccccggnctatcccgcgctgcgccgaaggcggctgaaacgctctcggccctctcaagaaaccccgggcctcaaacttctgaaaatgatccggaccctcctttaccgacccgcgcccaaaaaacctcagcctggggctcttccccgtttaaggccgggcccccccctttggttttgggggtaaaaaaaacgggccccccccaggtggcccccggggggtttttttgttttttccccccccaaaaggggggccggggggg

SEQ ID NO: 62056 - protein, 92 aa, Zea mays
  misc_feature: Ceres CLONE 1526386
  misc_feature (35)..(35): Xaa is any aa, unknown, or other
MSGRGKGGKGLCKGGAKRHWKCSAITSQGITKPPXYPALRRRRLKRSRPSQETPGLKLLKMIRTLLYRPAPKKPQPGALPRLRPGPPLWFWG

SEQ ID NO: 62057 - DNA, 653 bp, Zea mays
  misc_feature: Ceres CLONE 1526389
  misc_feature: Encodes the peptide sequence at SEQ ID NO. 62058
  misc_feature (541)..(541): n is a, c, t, g, unknown, or other
tggagctccccgcggtggcggccgctctagaactagtggatcccccgggctgcaggaattcgtctcacccctagaaaaactccactgacaagccgccgtccgctcttccaactacttctccccgggctcgcacccatggccacggctttgatggttgcagccaccacctcctgctccccgggccgcgccgcgccgcggctgaagacggtggccctactccacctcgagcagcagcagcatcaactcgacgcgtccgcagaggcccgtgtgtcaacagctccctcgtgtgctggctacttcgacgactgtgactgcagcatccgagctattcgctgctgtgtgctattcaggtagaaggccatgctgttcgacttcaacgtagatgtcccggtgatcgacaccgactgcctaatgatacgtggtacttatggacacgctctacttcacggcactaggcgactgcatgaatgatcgttatgccaatatgcgcgcggatcttgtctatgtctggggcacgctcctatgatttgaaacggctggnagaccagtcgacgtccctcgggaagatgacctcgactattgtgcggtcgcctttacaagatgaaaaaggaaccccgcggagctgaagccaaactggacagggacccaaccgg

SEQ ID NO: 62058 - protein, 72 aa, Zea mays
  misc_feature: Ceres CLONE 1526389
MATALMVAATTSCSPGRAAPRLKTVALLHLEQQQHQLDASAEARVSTAPSCAGYFDDCDCSIRAIRCCVLFR

SEQ ID NO: 62059 - DNA, 652 bp, Zea mays
  misc_feature: Ceres CLONE 1526392
  misc_feature: Encodes the peptide sequence at SEQ ID NO. 62060
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
tccccgcggtggcggccgctctagaatagtggatcccccgggctgcaggaattcgtctcacccctagaaaaaatctctagtcgactctcccgccttacgacgactcctcgtcgggcgtgccgcgccgagatcttctgattctctttcttgtttccatcctgttctacgatggtgacgctgcggatgatgccgtcggagcgccagacatcagaactgtcccgactcaccgctttctacgaggccatgttgatgcttcttatgcatctgcttcggcgaccaactcgggcttctatttcgcatgggtccgcgtcacggtttccgcagaggtctgactacgactcctctggcgctcatccgacctgccctgtnnncgagatggaatgcttcatgctggtgagaaacatagctggtcaagacacatctccgtaacatgatcattgtcgctgagatgattggaagcattgttggtgtctacaacggcaagaccttcgaccgagttgagatcaagcctgagatgatcggccactaccttgctgagttctccatctcctatgagccggtcaagcatggcaggccctggtatcggtgccacccactcctcgaggtttattcctctgaaatgagctgttactcggctctgtagtctcccaag

SEQ ID NO: 62060 - protein, 70 aa, Zea mays
  misc_feature: Ceres CLONE 1526392
  misc_feature (1)..(46): Pfam Name: Ribosomal_S19 Pfam Description: Ribosomal protein S19
MIIVAEMIGSIVGVYNGKTFDRVEIKPEMIGHYLAEFSISYEPVKHGRPWYRCHPLLEVYSSEMSCYSAL

SEQ ID NO: 62061 - DNA, 613 bp, Zea mays
  misc_feature: Ceres CLONE 1526393
  misc_feature: Translation starting site: 140
  misc_feature (358)..(358): n is a, c, t, g, unknown, or other
  misc_feature (462)..(462): n is a, c, t, g, unknown, or other
  misc_feature (483)..(483): n is a, c, t, g, unknown, or other
  misc_feature (503)..(503): n is a, c, t, g, unknown, or other
  misc_feature (559)..(559): n is a, c, t, g, unknown, or other
  misc_feature (597)..(597): n is a, c, t, g, unknown, or other
ggcggccgctctagaactagtggatcccccgggctgcaggaattcgtctcacccctagaaaaaagccgtcatcgtttcgcgtctgcctcagcccgccgcaaggagaggtaagttcaggagacatcttcgagaagctgaaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctncagtacccccttaccacagaatcagcgatgaagaagattgagatacaacactctggtcctcatttgtgacctcaggcagaacagaaaagatcaaggctgccgtncagaagatgtatgacatccangcaaagaaggtcaacacttngatcagggctgatggggaagaaaaaagcttacgtgaagctgactcccgactatgantgctctttgatggtgccaccaaatcggcatcatctaantgctgcattaggctcc

SEQ ID NO: 62062 - DNA, 634 bp, Zea mays
  misc_feature: Ceres CLONE 1526395
  misc_feature: Encodes the peptide sequence at SEQ ID NO. 62063
ctccccgcggtggcggccgctctagaactagtggatcccccgggctgcaggaattcgtctcacccctagaaaaaatcaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaataagacgttgtgactgtgccatcgtcgccaaaaaaaaaaaaaaaaaaaaaaaaaaagaaacagtcacgtctcccagatctaactcccccctaaaaaaaaaaaaaaacgagacgctcgaggtacccattcgcccta

SEQ ID NO: 62063 - protein, 63 aa, Zea mays; identical to SEQ ID NO: 8705
  misc_feature: Ceres CLONE 1526395

SEQ ID NO: 62064 - DNA, 656 bp, Zea mays
  misc_feature: Ceres CLONE 1526399
  misc_feature: Encodes the peptide sequence at SEQ ID NO. 62065
tagctggagctccccgcggtggcggccgctctagaactagtggatcccccgggctgcaggaattcgtctcacccctagaaaaagtggtctctcagaggtgggctggcttctcctccccctcttacgaagtcctcttctggttacggttacttagggatttgtggaggggcgatggcggcgtgtgatgtggagaaacgtgtgcttcctcggctgtcttgcctgggccccaccagcgattcgctggagaatgccttcccctcctacggggagatcctcgactccaaggtcatcaccgaccgggagaccgggaggtcacgcggcttcggcttcgttaccttctccgccgagaactccatgctcgacgctatccagaacatgaacggcaaggagctcgacggccgtaacatcaccgttaagcacgcccagacacgtggcgctggctgtggcgccggtgactaccgcggcagtcagcgctgcgactgctatggtggcgggcgtcctgacggctgttatgcccgcagtggctgctacgggggtcggctcgagggtggtggcggagtctatgcatgcgctgtcttgtacggggatcggacccagcgtggtttgagcgcctactctcccggcctgttctgctgcctggcacttatttagcgccc

SEQ ID NO: 62065 - protein, 159 aa, Zea mays
  misc_feature: Ceres CLONE 1526399
  misc_feature (20)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAACDVEKRVLPRLSCLGPTSDSLENAFPSYGEILDSKVITDRETGRSRGFGFVTFSAENSMLDAIQNMNGKELDGRNITVKHAQTRGAGCGAGDYRGSQRCDCYGGGRPDGCYARSGCYGGRLEGGGGVYACAVLYGDRTQRGLSAYSPGLFCCLALI

SEQ ID NO: 62066 - DNA, 660 bp, Zea mays
  misc_feature: Ceres CLONE 1526400
  misc_feature: Translation starting site: 224
  misc_feature (387)..(387): n is a, c, t, g, unknown, or other
  misc_feature (391)..(391): n is a, c, t, g, unknown, or other
  misc_feature (557)..(557): n is a, c, t, g, unknown, or other
ctccccgcggtggcggccgctctagaactagtggatcccccgggctgcaggaattcgtctcacccctagaaaaatcgaccgtggcgccctgcgcaccggctggggataatccgcgcggcatgcaatttgaggccattgcacccttggctcctactcactctctctccccatccgcgccagtccaaccaagtcagcacccgcgcgcggcaaggagttcacgcccatggcgagcaccaacatggcgtcggccacctcgcggttcatgctggccgcgggcgtgcccaccgccagtagcggcagcggccgcgtcagcttcgcctcggcgcccaaccggcttggcaggaggcttgtggtccgggccgatgaggagtccccggcagagccggncccnaacggcggaaaggggagggcgccgtggccaccaagcccaaggccgagaagccgccgccgatcgggcccaagagaggcgccaaggtgaagatcctgaggcgggagtcctactggtacaacgggatcggcaacgtcgtcaccgtcgatcaggatcctacacccgttanccggtgggtggtgcggttcaacaaggtgaactacggccggcgtgtctaccaacaactacgcccttggacgagatccctcgagtgaaatgagtggaggcagtct

SEQ ID NO: 62067 - DNA, 623 bp, Zea mays
  misc_feature: Ceres CLONE 1526405
  misc_feature: Translation starting site: 124
  misc_feature (343)..(343): n is a, c, t, g, unknown, or other
  misc_feature (511)..(511): n is a, c, t, g, unknown, or other
  misc_feature (514)..(514): n is a, c, t, g, unknown, or other
  misc_feature (544)..(544): n is a, c, t, g, unknown, or other
  misc_feature (582)..(582): n is a, c, t, g, unknown, or other
  misc_feature (583)..(583): n is a, c, t, g, unknown, or other
tctagaactagtggatcccccgggctgcaggaattcgtctcacccctagaaaaaaaaccctagtctcagagcagccgcatccacaacctgcctctctcgtcccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcnggtgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaagggtggacgcctcatcaccaaccanggnaaggcgtgatctgggaccagtggctgaaanggtcgctgttgaagcgtgagcagtgtcatctttgggtnntcatggtgtcatggttgatgggttgagaaggctgcgctct

SEQ ID NO: 62068 - DNA, 630 bp, Zea mays
  misc_feature: Ceres CLONE 1526407
  misc_feature: Encodes the peptide sequence at SEQ ID NO. 62069
  misc_feature (551)..(551): n is a, c, t, g, unknown, or other
  misc_feature (606)..(606): n is a, c, t, g, unknown, or other
tggcggccgctctagaactagtggatcccccgggctgcaggaattcgtctcacccctagaaaaaaaatcctccaatttcttgtcttctccgcgaaatcttcctctgtctgtcgtgtctttgttctggtcgtttcccgattcggtagttggcttggggatttcactgcaagtctagggattttctgtagggaagttgatcgagaagtcttggtagacatggagcagatccagtactccgagaagtacttcgacgacacctatgaatacaggcacgtcgtcctcccgcccgaggtcgccaagctcctccccaggaacatccttctctccgagaagcagtggcggttggtgggtgtgcagcacagccgcgggtgggtgcactacgcgatccaccggccggagccgcacatcatgctgttccgccgcccgatcaactaccagcagcagcaggaggaagcggctgccgcgcatgtgctgcccaagtgaagcctctgctggcgaccaggaatgttaacaacccctagccctcttttcatctctaacaggggcgtccnctgtttgtgatgattaatccctctgggctgctggatggaaaaacttggatctaantcggtcaacttggtgtgtgcgtgg

SEQ ID NO: 62069 - protein, 88 aa, Zea mays
  misc_feature: Ceres CLONE 1526407
  misc_feature (1)..(72): Pfam Name: CKS Pfam Description: Cyclin-dependent kinase regulatory subunit
MEQIQYSEKYFDDTYEYRHVVLPPEVAKLLPRNILLSEKQWRLVGVQHSRGWVHYAIHRPEPHIMLFRRPINYQQQQEEAAAAHVLPK

SEQ ID NO: 62070 - DNA, 573 bp, Zea mays
  misc_feature: Ceres CLONE 1526408
  misc_feature: Encodes the peptide sequence at SEQ ID NO. 62071
  misc_feature (277)..(277): n is a, c, t, g, unknown, or other
  misc_feature (313)..(313): n is a, c, t, g, unknown, or other
  misc_feature (386)..(386): n is a, c, t, g, unknown, or other
  misc_feature (422)..(422): n is a, c, t, g, unknown, or other
  misc_feature (459)..(459): n is a, c, t, g, unknown, or other
aagctgggactccccgcggtggcggccgctctagaactagtggatcccccgggctgcaggaattcgtctcacccctagaaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcangatcacctgcatgacgtttccccgggactggctgcngaaggacctgagcgtcatcggcttcgggctcacggctggaattgggccgtccagcgtcccggccatcaacggncacagcctcacgggggctcctcttctccagcatcgnccaagagcttgggccattcccccagcccccgcccgtnacttccaaatttctggtgtgggtaaagaaactgcaccctggggccgggttcaccggggctacttcgggcccaatttgaattcaaagccaggggacgaggactacttcgagaaaa

SEQ ID NO: 62071 - protein, 146 aa, Zea mays
  misc_feature: Ceres CLONE 1526408
  misc_feature (48)..(48): Xaa is any aa, unknown, or other
  misc_feature (60)..(60): Xaa is any aa, unknown, or other
  misc_feature (109)..(109): Xaa is any aa, unknown, or other
MAASASTVSGLAGASLASRPAFSTSFTRGSRVSARNPLMSRNLERNGXITCMTFPRDWLXKDLSVIGFGLTAGIGPSSVPAINGHSLTGAPLLQHRPRAWAIPPAPARXFQISGVGKETAPWGRVHRGYFGPNLNSKPGDEDYFEK

SEQ ID NO: 62072 - DNA, 601 bp, Zea mays
  misc_feature: Ceres CLONE 1526413
  misc_feature: Encodes the peptide sequence at SEQ ID NO. 62073
  misc_feature (432)..(432): n is a, c, t, g, unknown, or other
gctctagaactagtggatcccccgggctgcaggaattcgtctcacccctagaaaaaatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaaccctcagggggctgcaggaattcaagcctgttngaagagggtgctagcgccctaaggatgtctcctttctccatgtgcgagccctgaagctcaaagcaaagttgccgaataaggggccatgctcccttgggggaatttcataagactaacaccctataaagggctgggtttggtttgggcctgggttcaaaagggaaattga

SEQ ID NO: 62073 - protein, 104 aa, Zea mays
  misc_feature: Ceres CLONE 1526413
  misc_feature (10)..(98): Pfam Name: Cystatin Pfam Description: Cystatin domain
  misc_feature (98)..(98): Xaa is any aa, unknown, or other
MANNTGTLVGGIQDVPGSENDLHLQELARFAVDEHNKKANALLGFEKLVKAKTQVVAGTMYYLTIEVKDGEVKKLYEAKVWEKPWENPQGAAGIQACXKRVLAP

SEQ ID NO: 62074 - DNA, 580 bp, Zea mays
  misc_feature: Ceres CLONE 1526415
  misc_feature: Encodes the peptide sequence at SEQ ID NO. 62075
gcggtggcggccgctctagaactagtggatcccccgggctgcaggaattcgtctcacccctagaaaaaacgtacgcacgcaccgggacaccagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgcgacctctacggctctgacgcgccctcgccctacaacccgctacagagcaagttcttcgagacgttcgcggctccgttcaccaagagaggtctgctgctcaagttcctgctgctgggcgggcggctcacttctgggctaagtcaagggcgtcggcgttcaccggaacttcctgccgatcaaaaagggacctcggaaccgccgcaacccggcccgggcgggaagaatt

SEQ ID NO: 62075 - protein, 143 aa, Zea mays
  misc_feature: Ceres CLONE 1526415
  misc_feature (5)..(143): Pfam Name: PSI_PsaH Pfam Description: Photosystem I reaction centre subunit VI
MASLAAVSVKPVAIKGLAGSSISGRKLAVARPSARSIRRPRAAAVVAKYGDKSVYFDLDDIGNTTGQCDLYGSDAPSPYNPLQSKFFETFAAPFTKRGLLLKFLLLGGRLTSGLSQGRRRSPELPADQKGTSEPPQPGPGGKN

SEQ ID NO: 62076 - DNA, 662 bp, Zea mays
  misc_feature: Ceres CLONE 1526538
  misc_feature: Encodes the peptide sequence at SEQ ID NO. 62077
  misc_feature (660)..(660): n is a, c, t, g, unknown, or other
aagctggagctccccgcggtggcggccgctctagaactagtggatcccccgggctgcaggaattcgtctcacccctagaaaaagagattctccaaatcctagtagccggccgcgcagaaccctccctgctcagactcgtcggctgcagctcctcctccgccgccgtatcaaacgcactctcctccgacgccgcccgaggcaagatggttctccaaaacgacatctaccttctcaacccgccggcagagctcgagaagctcaagcacaacaagaagcgcctcgtccagtcccacaactccttcttcatggatgtcaagtgccacggatgcttcagcataaccacggttttcagccactcccagactgttgttgtgtgcccaggctgccaaactgttctctgccagcccacggggaggaaaggcgaggctcacggagggatgctctttccgccggaagggagactagagctgagtctgttattagtactggatcggttgtcaatctccaatatgtgggtcttcaagttttgctctgtgccccagacgttagggtcatgaacttccttagctaaggctttccgcatgctgttctgtgctgcgatgtatcgcacgttggttcttgctgaactatagcttgtttggttcggaatatgataaaccnat

SEQ ID NO: 62077 - protein, 117 aa, Zea mays
  misc_feature: Ceres CLONE 1526538
  misc_feature (30)..(84): Pfam Name: Ribosomal_S27e Pfam Description: Ribosomal protein S27
MVLQNDIYLLNPPAELEKLKHNKKRLVQSHNSFFMDVKCHGCFSITTVFSHSQTVVVCPGCQTVLCQPTGRKGEAHGGMLFPPEGRLELSLLLVLDRLSISNMWVFKFCSVPQTLGS

SEQ ID NO: 62078 - DNA, 678 bp, Zea mays
  misc_feature: Ceres CLONE 1526539
ccccgcggtggcggccgctctagaactagtggatcccccgggctgcaggaattcgtctcacccctagaaaaatacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcagatcttctcggagggcgggctggactacctggggaaccccaacctggtgcacgcgcagagcatcctggccatctgggcgtgccaggtggtgcctcatgggcttcgtccagggctaccgcgtcggcggcggcccgctcggggaagggctcgacaaggtgtaccccggcggcgccttcgacccgctgggcctcgccgacgacccggacaccgccgccgagcttcaggtggagggagctcaaaaacggcccgccttgccatggttctccatggttcgggttccttcgggcaaggccatcgtccaccgggaaaggggccccatccaagaaccctcttttgaaacaccgttcgcctaacccccgtcggcccaacaaaggccctggggcattaccccccccgaaag

SEQ ID NO: 62079 - DNA, 755 bp, Zea mays
  misc_feature: Ceres CLONE 1526540
  misc_feature: Encodes the peptide sequence at SEQ ID NO. 62080
  misc_feature (1)..(1): n is a, c, t, g, unknown, or other
  misc_feature (20)..(20): n is a, c, t, g, unknown, or other
  misc_feature (21)..(21): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
nttttttttttccttttttnnaaactcacaccccaaacccttnngnnggggaaaactggagctccccgcggtggcggccgctctagaactagtggatcccccgggctgcaggaattcgtctcacccctagaaaaagcatcagaatcagaccaccacacgcccgaggcccgactgcaagcgcctgagcccaagacccatggccatggccgccgccaccgtcgcagcgtcactgcccgtggcgcaagggctcgggaagcccctctgcgccggcagcaacgcgccgtcgctccgggccgtcgcgggcgcgccccgtcgtcggtcggccaggaccaggatggccgtcgtccgggcgtccgcgcaaaagcagcactcggccaaggagtgggcggccgcggctgccgtggcggcggcgctggtgctgccggaggtcgcggaagccgcgccggggatctccccgtcgctccaaaacttcctcctcagcatcgtctccggtggggccgtgctcgtcgccatcgtcggcgccgacgtcgccgtctctaacttcgaaccccctcagggggggttgagcatgcatgcttccattgtgcgtcgattgaatggtacctaagaatctgaagaactcctcccccccgtgtgctgtccccaatgacaaaccgttggttaaatgccctgaatagtgagaatatttcatttccatggccgatctggcatacggatggagaacgggaattcaacacgccccaatttccggtttt

SEQ ID NO: 62080 - protein, 134 aa, Zea mays
  misc_feature: Ceres CLONE 1526540
MAAATVAASLPVAQGLGKPLCAGSNAPSLRAVAGAPRRRSARTRMAVVRASAQKQHSAKEWAAAAAVAAALVLPEVAEAAPGISPSLQNFLLSIVSGGAVLVAIVGADVAVSNFEPPQGGLSMHASIVRRLNGT

SEQ ID NO: 62081 - DNA, 643 bp, Zea mays
  misc_feature: Ceres CLONE 1526555
  misc_feature: Encodes the peptide sequence at SEQ ID NO. 62082
  misc_feature (643)..(643): n is a, c, t, g, unknown, or other
tccccgcggtggcggccgctctagaactagtggatcccccgggctgcaggaattcgtctcacccctagaaaaataccactcctgcagtccttctccacctagctcccccgcgccaagaacacgccagctagcaagcgcgctcgatcgaataccgttaccgtgtcgccatggccgccaccgcgtctctatcagccgtcggggagccgctgtcggtgcccgggctcaggaagccgctcggcgtgtcgtcgctccggcccctgcagccgagggcggcgaggatgacgactacggccgtgcgggcgtcggcgtcgccctcgtccacgtccatcaaggagaaagctgcggccgggctgaccgcggcagccctggcggccgcgctggtgctgccggacgtcgcggaggccgcgcagtccggcgggctcacgccgtcgctcaagaacttcctcctcagcatcgtgtccggtggggtcgtgctcgttggtattgtcggcgccgtcatcgccgtctccaacttccaccccgtcaagagggcctgatcggaatccatcgtatcgatcgtatcgcctgtgtcctgtcctgtacctgtgctgtctgtatccactggtgatgctatatcccctgtgtgttaattgatttatgacan

SEQ ID NO: 62082 - protein, 122 aa, Zea mays
  misc_feature: Ceres CLONE 1526555
  misc_feature (85)..(122): Pfam Name: PsbX Pfam Description: Photosystem II reaction centre X protein (PsbX)
MAATASLSAVGEPLSVPGLRKPLGVSSLRPLQPRAARMTTTAVRASASPSSTSIKEKAAAGLTAAALAAALVLPDVAEAAQSGGLTPSLKNFLLSIVSGGVVLVGIVGAVIAVSNFHPVKRA

SEQ ID NO: 62083 - DNA, 656 bp, Zea mays
  misc_feature: Ceres CLONE 1526559
  misc_feature: Translation starting site: 176
  misc_feature: SWISSPROT Homolog: EC 2.5.1.18 Glutathione transferase
  misc_feature (647)..(647): n is a, c, t, g, unknown, or other
ctggagctccccgcggtggcggccgctctagaactagtggatcccccgggctgcaggaattcgtctcacccctagaaaaattttgctgtcgtgatgaaggctgtacatctgctacttctgcccgttcgctcagcgcgcctgggtcaccaggaacttgaagggtttgcaggacaagatggagctggtggccatcgatctgcaggacaaaccggcttggtacaaggacaaggtttacgcacagggcacggtgccttccctggagcacgacagcgaggtcaggggcgagagcttggacctgatcaggtacatcgacagcaactttgacggccccgcgctgctcccagaggatgctgcgaagaggcagtttgctgacgaactgttcgcgtctgccaacgcgttcaccaaagccctctactcgccgttgctgtcccacgcggccgtgtcagacgaagttgttgcggctggataaactcgaagctgacctatccaagttcgacgacgggcccttcttcctaggccaattcagcttggcggatgtagcgtacgttacgattctggaaagggttcagatatactattcccatcttaggaactacgacatcgcccaaggcaggcctagcctcgaggaattcatcgacgagatgaancagatcgaa

SEQ ID NO: 62084 - DNA, 551 bp, Zea mays
  misc_feature: Ceres CLONE 1526565
atagctggagctccccgcggtggcggccgctctagaactagtggatcccccgggctgcaggaattcgtctcacccctagaaaaaggataaaagttactctaaggataacaggctgatcttccccaagagtccacatcaaccggaaggtttggcacctcgatgtcggctcttcaccacctggagctgtaggtggttccaagggttgggctgttcgcccattaatgcggtacgtgagctgggttcagaacgtcgtgagacagttcggtccatatccggtgtgggcgttatagcattgagaggacctttccctagtacgagaggaccgggaaggacgcacctctggtgtaccagttatcgtgcctacggtaaacgctgggtagccaagtgtggacaggataactgctgaaagcatataagtagtaagcccaccccaagatgattgctctctcatgaagagcaacactctgctggcgatcctagttctccaggcactatctgtctctgccgccgtggccaaaggaccctgcaggcctacgacaatgaagcagtgc

SEQ ID NO: 62085 - DNA, 642 bp, Zea mays
  misc_feature: Ceres CLONE 1526566
  misc_feature: Translation starting site: 188
atagctggagctccccgcggtggcggccgctctagaactagtggatcccccgggctgcaggaattcgtctcacccctagaaaaaatcctctcccaatgccccacaacagctctactgaacattaccggtgcatcatacaagtgatacaggagagatcgaagaaagagagagagagacctatacagagatggcctccggcgggggctccaagcagctgaaggctagtcttctcgtggtgggagcagctctgctcctcctcatctgcacctgcactaccagggggcaagcggccaggcccgagccaggatccgagggccacacgccacagcagctgcgcgatgatgtacccatctccgccgttgctggtcatgacaagaagagtgactcatcagtggccgtggtgcatatgcgtcgagaaatccggatcatgcggcgagagaatgtgaggactacgacggataccacgaacaggagtgcctgatgaggacgacgttgctcgctcacaccgacgacatctacacccaggcgaagcacaactagctagtcactgatcactaacctgtgctgctggctcacgctcttgtcatgtcgaggagacaagttcatgggactaaaacgaatcagaaaagctcgcatggttct

SEQ ID NO: 62086 - DNA, 648 bp, Zea mays
  misc_feature: Ceres CLONE 1526567
  misc_feature: Encodes the peptide sequence at SEQ ID NO. 62087
atagctggagctccccgcggtggcggccgctctagaactagtggatcccccgggctgcaggaattcgtctcacccctagaaaaaaccacctccttctctcatccgtctgttcatgggtcaagcctgggatattctcctatatatgctccaatggcagaggctgatcgatcacctggtgatgtatatcaccgtcaaggcgttcgacctcctcacggaagacgcccagaagagcgacgaggacgccctctaattcgacgagatctacctcgccttcctctacgtctaccttgacatcaatcaattacttgtcggggcctctccacgaccccccgtccaacgataagctcaggaccatgatggaagaatacgacgtgtacctgaacaggctcctggaacgcgaggagttcacagagttcatccagatactgacctcgcactccctgtgttcgataagcatgaagctgctgataacgctggtggctgctcccgcactggaaatggtgaccaacccggctactggaatgagcccccgacatgctcaatgactgacgctaggtgcccaacactgtctatgcctccgacatgaacattgtgcgttgtgctgctacacagatctaccgagggcactccagtgactcgaactaataa

SEQ ID NO: 62087 - protein, 63 aa, Zea mays
  misc_feature: Ceres CLONE 1526567
MMEEYDVYLNRLLEREEFTEFIQILTSHSLCSISMKLLITLVAAPALEMVTNPATGMSPRHAQ

SEQ ID NO: 62088 - DNA, 638 bp, Zea mays
  misc_feature: Ceres CLONE 1526570
  misc_feature: Translation starting site: 141
atagctggagctccccgcggtggcggccgctctagaactagtggatcccccgggctgcaggaattcgtctcacccctagaaaaaacgaggcggaccacgtaagcagcagcaggtaccctagcaccgccgcatccgcagccatgggtatcgacctcgttgccggtgggaggaacaagaagaccatgcgcacagcgccgaagtccgaccatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcctgcaacgaaaggaaaacaacattgctgtgattgttggcacagtcactcatgacaagaggatccaagaggttccagcaatgatggttactgccctgacgttcaccgagacggctaaggccaggattgtcaatgctgcgtggggagtgcctcacatttgaccagcttgctctccgtgctccacttggcgagaacacagtcctcttgaggggccccatcaatgcccgtgaggcggtgaggcacttcggcaaggctcctggagttccgcacagccacaccaaggcatatgt

SEQ ID NO: 62089 - DNA, 438 bp, Zea mays
  misc_feature: Ceres CLONE 1526574
  misc_feature: Encodes the peptide sequence at SEQ ID NO. 62090
catagctggagctccccgcggtggcggccgctctagaactagtggatcccccgggctgcaggaattcgtctcacccctagaaaaaaagaagcagcttgttgctgcttttaggtggcgctttggcctttttcatggttttgacagaatatgtccttgtttctgtgactagtgctgtaacagtgactgtagcaggaattgtgaaggaagctgtcactattctggttgctgtgctattcttcaacgatccattttacatggttggaagcccctggggctagcaataataataattgggtggcaagccttattccaatttttttccaaagttttaaaaaaggggtcccaaaaaaaagggggcgttttccccctttaaaaaaatgggggggggaaaaaaaaaaccccccatttttttttccaaaatttgtgggggggccccct

SEQ ID NO: 62090 - protein, 48 aa, Zea mays
  misc_feature: Ceres CLONE 1526574
MVLTEYVLVSVTSAVTVTVAGIVKEAVTILVAVLFFNDPFYMVGSPWG

SEQ ID NO: 62091 - DNA, 681 bp, Zea mays
  misc_feature: Ceres CLONE 1526576
  misc_feature: Encodes the peptide sequence at SEQ ID NO. 62092
tggagctccccgcggtggcggccgctctagaactagtggatcccccgggctgcaggaattcgtctcacccctagaaaaaggcgatgaagaagaccggttcccctctcctgatcgtcctgttcctcacggcttgcgccatggtggccgatccggagaagcaggtggaccccgcggcacaggagacggccgcgcacgtcgtgtacgttgaccgccccgaggacgccgaccctgaggagttccacatccgcaccctcacccccgttctcgagcagcgaacagaaggttagggacgcattgctctaccactacaagaacagctgccagtggcttctccgctaagctcaccccccaggatgtcaatgcatctcaaggagccaccaggtgttctccaagttgagccgagccagacttaccagctacatggacctgtctctggcactcaccatggcacgactcacaccttgggacttaggtgaatgggtatgagaatcaaggacactgtgtttagtctggctgtaccgctccaggctgaccaatgtggatatgtcactactatgtaagagtaaggggcgtattctcttttatactgctttgacgcatgttccccctcttatacaaacgctgtgcaagcctagcaaaagcttcctgttttgcccttcaaaagaccagggttagctttca

SEQ ID NO: 62092 - protein, 67 aa, Zea mays
  misc_feature: Ceres CLONE 1526576
MKKTGSPLLIVLFLTACAMVADPEKQVDPAAQETAAHVVYVDRPEDADPEEFHIRTLTPVLEQRTEG

SEQ ID NO: 62093 - DNA, 632 bp, Zea mays
  misc_feature: Ceres CLONE 1526577
  misc_feature (338)..(338): n is a, c, t, g, unknown, or other
  misc_feature (342)..(342): n is a, c, t, g, unknown, or other
  misc_feature (378)..(378): n is a, c, t, g, unknown, or other
aaagctggagctccccgcggtggcggccgctctagaactagtggatcccccgggctgcaggaattcgtctcacccctagaaaaaagccatgggatgggagcactccacatgcgtgaagaagctttaaaattttgtcctccctccctccttccgatcatccttcctgatgctgttgatcgatcaaccacttgaatcatgcttgtcatcatcggtccatgcctccatggtctagtaggttctgtaaattgttgtgagtttgcttgtgtgctagctagctaggtggcccggcccggccgttgaaaagtgccaaaaaaaaatacatgtgtattttccctgcntgcnaaaaaaaaaaaaaaaaaaaaaaaaaaaaagttcttnttggttgccattcgcctgcagacttcttgtcgtttgctacttattaagcgagtgctagctctgcatgcatgactacgtcctttgcatgttgatgagcaactttcgatacttttgggtgtttgttttatgtaagtgcttcgtcctttacatcgacagtgtcccagaactatttgtactgttattcttttatttgtacccagcaatctgctcgatgaaataaagcttattatatttattgaaaaaaaaaaaaaaaa

SEQ ID NO: 62094 - DNA, 746 bp, Zea mays
  misc_feature: Ceres CLONE 1526596
  misc_feature (207)..(207): n is a, c, t, g, unknown, or other
  misc_feature (215)..(215): n is a, c, t, g, unknown, or other
  misc_feature (221)..(221): n is a, c, t, g, unknown, or other
  misc_feature (746)..(746): n is a, c, t, g, unknown, or other
atagctggagctccccgcggtggcggccgctctagaactagtggatcccccgggctgcaggaattcgtctcacccctagaaaaaaccgtgcatggttcgcagcgccaccgccagggtcgcaagcttatagcagtcaagcaaatactagtgcccattaccggatcggtcggaagccggccggcggcaaggaaggagtatcccagacgncaatgtcntttttntttttgtccccccggcgagtgggtgtgtgttatgaggctctggcacggcaaaaagccggtcctagatcgcacacccgcccgttcattcttgtataccgcggacaacaaagaaacccattttctttgttttgggggggaagggctccccgcaaatacgacccctctcattggattttgcgacccccaaccccgattaaaattagtaggaaacgggccgccacataaagaaaaaatctagtaccccacacacgcccccctatccgccgcaggaaccaaaagatcacctcagcttacatctcgctacccagttgcattgtcttatttgtgaacctgctctattacagagagagctgatgacggataaaataaatataacagcacagtacgcttgacgcatagggagtagcgttgtctttataatctactgacaaaaacaattatagaggaccaccacgctaacaccttctgtagtgtctgtgcagagttgcgctaggaggacaatcatacccacgaccgacagacccn

SEQ ID NO: 62095 - DNA, 670 bp, Zea mays
  misc_feature: Ceres CLONE 1526609
  misc_feature: Translation starting site: 127
tggagctccccgcggtggcggccgctctagaactagtggatcccccgggctgcaggaattcgtctcacccctagaaaaaattgctcacttctgagtcccgacgtcacgagctcccaagagctagccatggcgtccaccacactctcctccgccttcaccctcctatcccgcacctccacctccccgtgccccgccgcctcgctcccgaggacctcccacgacgcgcccaacatccgccagggccgccgcgacatcgccgtcgcgtgcaccgccaccgagtcccccaagatccaggagatcggggacgccatcaccaggctcaagctcgatgaggcccgcatcctcctcaacaacctacagaagcggctcggcgtcaccaccgcgtgcttcacatctgccgcagccgtcgcggagcctagagcttgaggatctgccccagtctatcaaaatgcccacgtcgagaagcactgactcaacgtgatgatcgaacaagtgcacagcagctcgcgtatcggcacataaaaagtggtgcgcgcgctgactactctgcgcgctcaaggagatcgacgtacattatatagggtctctccgagaaccgtcaactatgacgtcaaccaagacgacgcaccatgatgctgacatgcatcttcgaggaagtctgctgcaaggg

SEQ ID NO: 62096 - DNA, 649 bp, Zea mays
  misc_feature: Ceres CLONE 1526610
  misc_feature: Encodes the peptide sequence at SEQ ID NO. 62097
  misc_feature (476)..(476): n is a, c, t, g, unknown, or other
  misc_feature (544)..(544): n is a, c, t, g, unknown, or other
tccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtggtggtggttgaacaataataagcgaggccgagctggctgccatacatangtattgtgtagtgtgtgagagagagagagaaacagagttcctcagtttgctatctctctctctgcatngttggcgtcagtccttgtgctcatgtacgtgtgtctacatgcatgttggttgatccaattgcctctgctgaaacattaaattaatttgccccccaaagaatgaat

SEQ ID NO: 62097 - protein, 76 aa, Zea mays; identical to SEQ ID NO: 42649
  misc_feature: Ceres CLONE 1526610
  misc_feature (1)..(76): Pfam Name: Metallothio_2 Pfam Description: Metallothionein

SEQ ID NO: 62098 - DNA, 637 bp, Zea mays
  misc_feature: Ceres CLONE 1526611
  misc_feature: Encodes the peptide sequence at SEQ ID NO. 62099
agtggatcccccgggctgcaggaattcgtctcacccctagaaaaagttgctcacttctgagtcccgacgcacgagctcccaagagctagccatggcgtccaccaccctctcctccgccttcaccctcctctcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcacgctcgaggaggcccgcagcctcgtcgaccacctccaggagcggctcggcgtcaccgccgcggccttcgcgccggccgccgtcgcccccgcgcccggggcgggcggcggggccgcggccgaggaggaggcccccgtcgagaagacggagttcgacgtgatgatcgaagaggtgcccagcagcgcgcgtatcgccactatcaaggtggtgcgcgcgctcaccagcctcgcgctctaggaggcccaagaccttatcgaggggctccccaaaaaagtcaaagatggccgttcacaagggacaaggcccgagaacgcccaagaagccgctccaggaaagtcgggcgccctaagg

SEQ ID NO: 62099 - protein, 143 aa, Zea mays
  misc_feature: Ceres CLONE 1526611
MASTTLSSAFTLLSRPSTSPCPAASLPRSSHAAPHIRRGRRAVAVACTATESPKILELGDAIAGLTLEEARSLVDHLQERLGVTAAAFAPAAVAPAPGAGGGAAAEEEAPVEKTEFDVMIEEVPSSARIATIKVVRALTSLAL

SEQ ID NO: 62100 - DNA, 617 bp, Zea mays
  misc_feature: Ceres CLONE 1526617
tagctggagctccccgcggtggcggccgctctagaactagtggatcccccgggctgcaggaattcgtctcacccctagaaaaagcccgctgcagatcatggaggaggaagcatggcaggagtgtctgcatgggtcctgagagtcgcgtgagcagcgaagcagttcacggatggttggatggagggcaatgaccagctgctgagctgctgctgctcctcctggtcgaccatcagtttgtatttgtccatgcctcgtgtagccggccgtcttcttgccctggcttgtccagttccggaaggcgggcaagcccggtgaagcgtggacagagaccggcaagtcagagatcggcaatagtgagctccagcaggagcctacttgtactccttatttacccgttttaaggttcccttcttcgtgctgttcctcgtcttccttcgtttcttcttgtctgttccctcctgccccagagctgtaccggtgagagcagaagatttcagtagaaagtcctgctttctggagacagtttcagtgtttggttttggaatacgctactgtgatttgctcgtgggtatctcccctcctacagataaacaatagcttgtggctttttatttaaa

SEQ ID NO: 62101 - DNA, 676 bp, Zea mays
  misc_feature: Ceres CLONE 1526622
  misc_feature: Encodes the peptide sequence at SEQ ID NO. 62102
ggactccccgcggtggcggccgctctagaactagtggatcccccgggctgcaggaattcgtctcacccctagaaaaactctcgctccgttgctcgcctcgggtcaaaccctaagcagggagttgatttatccgctagcatccatgacctaacttgcacccctgactctcgtccactgatcccatcctcccgaccattgtctgcggatgtcccaggaagaacaataacgaagttcactgcacactgtgcgagacttcagcattggtcctcaacaattatgtatccacaccaacgacaagcgtcttcaatggctctgttaagttaccccatatccctcgtcccaagatgaaagtgtgcatgcttggtgaagcccatcatgtagaggatgccgataacatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggactcaacgaaggaggcaagttcccgaccctggttactcaccaggaatccctcgaatccagggtgaacgagactaaggcaaccatcaagttccagctcacgaaggtcctttgcatgggcgtcgccctcggcaacttgcc

SEQ ID NO: 62102 - protein, 110 aa, Zea mays
  misc_feature: Ceres CLONE 1526622
  misc_feature (1)..(109): Pfam Name: Ribosomal_L1 Pfam Description: Ribosomal protein L1p/L10e family
MKVCMLGEAHHVEDADNMGLDYMDVEALKKMNKNKKLVKRLAKKYHAFLASEAIIKQIPRLLGPGLNEGGKFPTLVTHQESLESRVNETKATIKFQLTKVLCMGVALGNL

SEQ ID NO: 62103 - DNA, 378 bp, Zea mays
  misc_feature: Ceres CLONE 1526628
  misc_feature: Encodes the peptide sequence at SEQ ID NO. 62104
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
atagctggagctccccgcggtggcggccgctctagaactagtggatcccccgggctgcaggaattcgtctcacccctagaaaaaatctatccaagcaacaaacttggcattcttgcctgttcttaattattgccaggacaggagaaacaaagatgaggcctcagctgatactcgtcggcactctggctgttctcgccatcctcgcagctctcggcgaaagctcgtcgtcctggccctgctgcaacaactgcggtgcttgcaacaaaaacaaccgcccgagtgccagtgcaatgacttgtccggtcaacggtgccatccggaatgcatgaactgcctcaagggcccgtggccaggaaattcnnnnccccccaccagccc

SEQ ID NO: 62104 - protein, 58 aa, Zea mays
  misc_feature: Ceres CLONE 1526628
MRPQLILVGTLAVLAILAALGESSSSWPCCNNCGACNKNNRPSASAMTCPVNGAIRNA

SEQ ID NO: 62105 - DNA, 517 bp, Zea mays
  misc_feature: Ceres CLONE 1526633
  misc_feature: Encodes the peptide sequence at SEQ ID NO. 62106
  misc_feature (397)..(397): n is a, c, t, g, unknown, or other
aaagctggagctccccgcggtggcggccgctctagaactagtggatcccccgggctgcaggaattcgtctcacccctagaaaaacaattcgcttcgatccccagaggcacagacgagacgacagagatgaaggacggaacgtcgtcggggggaggggcgttcgctgcgggcagcgatccaaggcagccgtcgacggcgaagccatacgcgccgccgaagctgtcgccccaggacctacccatcgactatgcaggcttcctcgccgtcgccttcggcgtcctcggcgtcatgctccgctaccaggtgtgctcgtggatcgcaatcctctttctgcccccagccgttgggcaaacttgatgaaactttccacaaccaatctgggagggaggcgtttctnttggcccttcctggttttggcctcttacggggcccgggtgaacaaaacttatttttggccccccgccccgtccccgggccggaaccaaaaagccgcttaaaccggccgcgaaaaaaccca

SEQ ID NO: 62106 - protein, 76 aa, Zea mays
  misc_feature: Ceres CLONE 1526633
  misc_feature (12)..(77): Pfam Name: UPF0139 Pfam Description: Uncharacterised protein family (UPF0139)
MKDGTSSGGGAFAAGSDPRQPSTAKPYAPPKLSPQDLPIDYAGFLAVAFGVLGVMLRYQVCSWIAILFLPPAVGQT

SEQ ID NO: 62107 - DNA, 629 bp, Zea mays
  misc_feature: Ceres CLONE 1526634
ggagctccccgcggtggcggccgctctagaactagtggatcccccgggctgcaggaattcgtctcacccctagaaaaagcaaaggcttatccttccgagtttccaccctttacaatggcgagcgctcccgccggctttgcccccaccgtcgctgcttccacaagcttcggcttcagccgcttcactatcgtggcatgccccttcccctcgcgcacgcatcttccagcggcctcctccgttggggttcgcaatcagcagcgcgcgtccactgccaccgcctgcctgccgccgccgaatacctcccatggcgccgccaccaggctgtacgtcagcggtctttcgttccgcacaaccgaacggagcctccgggacgcgttcgagaagtttggtgaccttacggaaggtgacagagcccgagatgagcgaatgtctgtgttttaaattcggaattattcaaatttgctccgtgcttgctactccagtttgtctcgtgatggatagagtagcgaagcgaccgagaggtttcgctttcctttcttacaccggggaggaggaagccaggggcgccatggaagggatgcacgggaaggtgaaagatgtccagatcgtcggatgctcgtgtgatagat

SEQ ID NO: 62108 - DNA, 778 bp, Zea mays
  misc_feature: Ceres CLONE 1526636
  misc_feature: Encodes the peptide sequence at SEQ ID NO. 62109
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (615)..(615): n is a, c, t, g, unknown, or other
gaaaaaaaagaattacaaaaaaaaaannnnnnncnnnnnnnntttcctatccnnnnnccaaagtggagctccaccgcggtggcggccgctctagaactagtggatcccccgggctgcaggaattcgtctcacccctagaaaaaactgacgagctcgccatggcctccctctcctctgccgccgtcaccgccccttccttcgccgcaccagcgccagcccgcgccgtggtcagaaggaggtccttcacagtgcgcgcctctctccgcaaggccaccggcaccgccgccgtggcaatggctgccagcgcacctgcttgccgggcggtgccatggccccaagaaggtagcttgcttagacacaaaaaagaacggaagggcccccgtccttacgaaaacccccagccccagttttcccaacgataaaggggctcggggacaccaccgaataaaattttcataaaataaaaatctgtaaggtaatatccctaaaaaaaaaccaacccccctccccaaaaaaaagaaataaagaaaccccccgaccggcctttcctcacaccccccccaacaaaaactcctccccacccgcatcaagccaacatcttttgaaaacttcgcnaacgctcgaagaacccactctgacgcttcaaccaccaatcaccccccccccccaccctggcgccggggggggacctcctacactctccgcgccccccaataaccaaccgtgagaaaaaacgaacagatacccagaaaaaggaagacagcccctcgtgagtgtg

SEQ ID NO: 62109 - protein, 87 aa, Zea mays
  misc_feature: Ceres CLONE 1526636
MASLSSAAVTAPSFAAPAPARAVVRRRSFTVRASLRKATGTAAVAMAASAPACRAVPWPQEGSLLRHKKERKGPRPYENPQPQFSQR

SEQ ID NO: 62110 - DNA, 652 bp, Zea mays
  misc_feature: Ceres CLONE 1526638
  misc_feature: Encodes the peptide sequence at SEQ ID NO. 62111
  misc_feature (288)..(288): n is a, c, t, g, unknown, or other
  misc_feature (454)..(454): n is a, c, t, g, unknown, or other
ggagctccccgcggtggcggccgctctagaactagtggatcccccgggctgcaggaattcgtctcacccctagaaaaaaggttggctagggattgccgccccagctggctggttatatattaggctgtcgccgccaaagaaagaaaggcctgcttcttcacctcgcgctccaggttcatgttttgagcgtgtacagtgcatgtggtttcagaaatggggacgctggcgtgcccatggagatctggccacctctttgctttcatcaccttcgccgtgctgttcttctcngacttcagttttgggccccccggggggggggaaaaaaaaacaaaggtttaaacaaaaatttttcccttttggaatggggaaatccaaaagaaaatgggccccccctaaaaacgggttcccaaaacccaaaaaaaaaaaaaagggggaaaaaataaggggggtgcgnggagctggctaattagaaaacacacatatgatatgaaagaaagagaaggatatcagatggtttgccaaatattactcactcacactctaccacatccctttgcgtcaaacgtgggataagaaaaaagaataaataaatattacctaacccccttgccatcaagttaatcctagttattttttgtttgttccgataaag

SEQ ID NO: 62111 - protein, 41 aa, Zea mays
  misc_feature: Ceres CLONE 1526638
MGTLACPWRSGHLFAFITFAVLFFSDFSFGPPGGGEKKTKV

SEQ ID NO: 62112 - DNA, 704 bp, Zea mays
  misc_feature: Ceres CLONE 1526643
  misc_feature (704)..(704): n is a, c, t, g, unknown, or other
aagctggagctccccgcggtggcggccgctctagaactagtggatcccccgggctgcaggaattcgtctcacccctagaaaaaatccaccatcacacacagcaatccacacaagcacttctacgtctcacgggcgctgcacacagacacaccaagcgtcggcaccaatggctgactaccaccaggtggactactgctcgtaggaggtgaggtcggtggccccggtcggcttcggccgccacggcggcggcgtctagcagcacgtcgtcaaggagaagttcaaggaggtcgacacggccgcacgcaccggggccaaccaccaccaccgccatggtcaccacggcggccacggcttcttggtgcccaagaccgctgtccaggaggacatcatcacctgcatcggcgaggtccaccaccgcatggagagcttcctcgccagggctaaatgagcagcccgggcggccggcatccacgcccgttcatgcctgcctgcgtgcctaatcgatgtctggaattgggcagggacaccaaacttggcaagcgtaaggaggatgcgagcacgacacattcctggtagaaatttataaccattagccctgctgacctgaaataaaaaccttctcccgtgattgccttaccacaccaaaaaaataaaaatcgaggacccccccgggagagtaccccaatattccgcccctcataaan

SEQ ID NO: 62113 - DNA, 897 bp, Zea mays
  misc_feature: Ceres CLONE 1526644-R2
  misc_feature (1)..(1): n is a, c, t, g, unknown, or other
ngcggtatgcgtctcttattttcgtacagtagtgtatccggccggctgatagagatctacgcaactcttgaaagtatgctcggatgagatttcatatgagatacgatgttgccacagtgctggacatcatgcagttttgcttctggatacggcctaggaaggcaaaatgtgcatagagaactagtcttcttgatacaggccaacgagagcacctaccgctgagttcggctttgccattttctttttttggtatgcaatggacggactattggcgcagtgagcatcttcgcatcacagcgacgacgcaacacacggcatcatcagtcagccgtccagactctgctccacgaccttcccgaactttgcggttgtacctctcgctttgttcttggctgaaacatgcgggagcggcttttcaaagttaacggggcgcaatttcggggttttgggatcgcccccaaaaatggacttgaaattgaagggggagggtttccccttccctggcatttccgtttttttccgggaaacttctccctgggaattttttgggcgggggaaatttttttttaaaggcccattttggggtcttcccccattttaagcggaaaaaaaaactgtttttttgagaatattgggaaaaacaatttccctttaaaaaaaaaaacaaaaatttttttcaaccaaattttttgggggagggagatattttgtattttggggagaaaaagaatcctcccccccctctttaaacagcggggcggaaaaaagagcttcccccccctttttttgaagagggggggggaaatcttcttttttgttcgtctaggagggggggtgtgtgtttgttattataaaaaggggggccccccacagaatttttttacgcgaagccgctcc

SEQ ID NO: 62114 - DNA, 852 bp, Zea mays
  misc_feature: Ceres CLONE 1526644-R
  misc_feature: SWISSPROT Homolog: EC 6.3.2.19 Ubiquitin--protein ligase
tcctcgagcgtctcgtttttttttttttttttcaatccaatcctgctctgatggtagatccggaacttctctaatgtaggttgtattggccctgcaacagtgtcttcgtctggtgactttctttggtcccgtacttggttcctgttggacaagttcttcctgcgcatctcggattattctcctttgggttcgtaatacgccccctgaaggatccttgtccttcggttcccagatctcttgccgccggcgcctccggcgaagctcgactgtatttgcggtggacgggtcctgtgatcggaataaaatcaagaggaaaccggaggacaggtgagcagctggccgacgctggcatggacgctccacagggtatcatcagtccgccgtccagctctgctcctcgacctcccgaactttgcggttgtactctcgcttgttctcgctgaacatgcgggcggcttcagagttagcgggcgaattcgggtttggatcgcacaacaatgactggattgacatgagtatcgcagctacatcatatatcggactccactgattctgcaggatatctaagcatatgcttccatcagcataaatgttaggatggaacatcctagaaacaaatcgcacagttggtggtttgattttggatattcttcagtaaactggagagtcagcttaaacgtacctccatcccacggggtatcatcaggtccaaatatgacagcattccacagcagtatgttgttatcctgcggggcgccacttatgccggccggagggtcctgcatcaaccgcttgaaattcctcatcggctctttcctgcaggagtccacatcccccggatgttcctaggta

SEQ ID NO: 62115 - DNA, 690 bp, Zea mays
  misc_feature: Ceres CLONE 1526646
  misc_feature: Encodes the peptide sequence at SEQ ID NO. 62116
  misc_feature (690)..(690): n is a, c, t, g, unknown, or other
tccccgcggtggcggccgctctagaactagtggatcccccgggctgcaggaattcgtctcacccctagaaaaagacgagcgctctcgacgtttttccacgtcctcaatccagaccgctgccgcttccagctccgatcgatctgatccctccctaccgctacgggcatgggggaccaactcaccgacgaccagatcgccgagctcaaggaggccttcagcctcttcgacaaggacggggatggttgcatcgcgaccgaagagctgggaactgacctgcgtttactggggcaaaaccagatagacggggaagtccgaggagtggtcagtgagggcgatgccgatggggtgggaccgttcggtttgccggaggtgggggacctcctggctccccagatgaacgacagcccatgctgaggaagagctcaaggaggcttttcgggtgcttggccagcatcacaaaggcattcgtcgctcgcgggcgagggtccgctctgattctgcccacatcgacgggttacaattcttcccgaaagaaggggtgttctcagaacaggtaactcctcgcagagcagaccgatcaccgggcacattgtccaaaatttaccctccccaacgatgttccgctctggtggctcttaattgggtctccaactgtaggccctctatatacggtcttatgctttcccgcgn

SEQ ID NO: 62116 - protein, 82 aa, Zea mays
  misc_feature: Ceres CLONE 1526646
  misc_feature (12)..(40): Pfam Name: efhand Pfam Description: EF hand
  misc_feature: SWISSPROT Homolog: EC 2.7.11.1 Non-specific serine/threonine protein kinase
MGDQLTDDQIAELKEAFSLFDKDGDGCIATEELGTDLRLLGQNQIDGEVRGVVSEGDADGVGPFGLPEVGDLLAPQMNDSPC

SEQ ID NO: 62117 - DNA, 623 bp, Zea mays
  misc_feature: Ceres CLONE 1526653
  misc_feature: Encodes the peptide sequence at SEQ ID NO. 62118
ggagctccccgcggtggcggccgctctagaactagtggatcccccgggctgcaggaattcgtctcacccctagaaaaaaaaccctagaagcctccaccctcctgcgcctccaccctcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagtgttgaggatctaatcctctccgttggatctggtggtggcgctgctccagttgctgctgccgccccagctggaggtgctgcagctgctgctgcccctgctgcagaggagaagaaggaagagcccaaggaggagtctgatgacgacatgggcttcagcctgttcgactgaggaggccctcgctacccagccattaagcaaaattcccttatgcttgtcccagaactttatcttacccctctttccctggtaccccttttggtttttcccccaccaccctccagg

SEQ ID NO: 62118 - protein, 109 aa, Zea mays
  misc_feature: Ceres CLONE 1526653
  misc_feature (21)..(108): Pfam Name: Ribosomal_60s Pfam Description: 60s Acidic ribosomal protein
MASGELACTYAALILSDDGIAITAEKIATIVKAANIKVESYWPALFAKLLEKRSVEDLILSVGSGGGAAPVAAAAPAGGAAAAAAPAAEEKKEEPKEESDDDMGFSLFD

SEQ ID NO: 62119 - DNA, 672 bp, Zea mays
  misc_feature: Ceres CLONE 1526656
  misc_feature: Encodes the peptide sequence at SEQ ID NO. 62120
tggagctccccgcggtggcggccgctctagaactagtggatcccccgggctgcaggaattcgtctcacccctagaaaaaactcggcacgcacgcataggcagcacagcatcagccagatccatccatcctctttctcctgctcgcttcgcttcctcggcggattcctcctccctcggccgtccccgtcccctttttcggcgggcgagctcgcccgagatggcaaacgcgagatcgggtgtcgctgtgaatgacgagtgcatgctcaagttcggcgagctgcagtcgaacaggctgaaccgcttctctaactttcgagatggacgacacgctcactgacatcgttgcgcagcagattcgggatcgcgctacctgctactagtacttctcaatgagcctccccgagaatgactgccgatacgcgatctatgatttcaactttgtcactgccgaaaatgtccagaggagcacgatcttctatatcctatggtccccgtcctccgcccgagtgaacagcaagatgcttatatggagctcacaccaaaaattcaagagccggcctcaatgtcattcccgcgggaactgcaggcttctggtgccaatgaaatacgcctttgatgaagattaaggatcgggcctccctaagggattcttgattatgcattaatggactt

SEQ ID NO: 62120 - protein, 78 aa, Zea mays
  misc_feature: Ceres CLONE 1526656
MSLPENDCRYAIYDFNFVTAENVQRSTIFYILWSPSSARVNSKMLIWSSHQKFKSRPQCHSRGNCRLLVPMKYAFDED

SEQ ID NO: 62121 - DNA, 692 bp, Zea mays
  misc_feature: Ceres CLONE 1526659
  misc_feature: Encodes the peptide sequence at SEQ ID NO. 62122
tccccgcggtggcggccgctctagaactagtggatcccccgggctgcaggaattcgtctcacccctagaaaatcccatctccactcgctagcactagcatagccgtctctttcttttctgcttccagacattgtccacgagctggtgcactggtgtcgctcgcaaccaaattaaggactgagccatggcatccaagggcgtcctcttcttggctctcaacctcctgttcttcacagtggccaacgcctgcggcagctgcccgaccccaacgcccccggtcgagccaccgccgccgcctcctgcataccccacccccttcatcctccatagggaagtgcccgctgaacactctcaactccgccccgggcgggggggggggtgcggccccatccaatgccacccttccaaaggtaccacttgagcccatgctgcaccctcatcaaaaggcaagccaaacatcaaagccaacccatttgccccttcaatgtattataaaaaacagagatcctcgggcattgcacttcagagtgccccttttcaggtcctatgcccctaccttcacctccccctacaccagtaccccgcctccccactataccagtccacgcatatactcaaacaagacaaaaccaacccccacccagcaacgaaccgacaaactaacccttcaccatcgtcacaaccacaacccg

SEQ ID NO: 62122 - protein, 78 aa, Zea mays
  misc_feature: Ceres CLONE 1526659
MASKGVLFLALNLLFFTVANACGSCPTPTPPVEPPPPPPAYPTPFILHREVPAEHSQLRPGRGGGCGPIQCHPSKGTT

SEQ ID NO: 62123 - DNA, 655 bp, Zea mays
  misc_feature: Ceres CLONE 1526664
  misc_feature: Translation starting site: 172
gatagctggagctccccgcggtggcggccgctctagaactagtggatcccccgggctgcaggaattcgtctcacccctagaaaaactagccgcctgcctctcctcctccagagctcgtcgccaccggccaccgccaccctcgatcacgccgtccgtcgaggtaaagtcaacatggtgagggtcattgtgctcaacgatgcgctcaagtccatgtacaacgctgataagatcggcaagaggcaggtcatgatcacgccgtcgtccaatgtcatcatcaacttactgacggtcatgcaacgccacggctacattggagagttccagtacgtatgatgaccaccgatcgggcaagatcgaggtcgaactcaaccggaggctgaacaagtgcggcgtcatcagccctcgctttgatatccgcgtgaaagacattgagggatggactgcaaggctgctcccgtccatgcagttcggatacatagtcctcacaacttcggcaggcatcatggaccacgaggaagcccgccggaagagcgtaggaagcaaagttctacgtttcttctattgaagaagctgataatctttgttatggcctgcctgcctgtcttactctctcagactagagcacctggtatgttacttgaagatgtctctctca

SEQ ID NO: 62124 - DNA, 681 bp, Zea mays
  misc_feature: Ceres CLONE 1526670
  misc_feature: Encodes the peptide sequence at SEQ ID NO. 62125
  misc_feature (681)..(681): n is a, c, t, g, unknown, or other
tccccgcggtggcggccgctctagaactagtggatcccccgggctgcaggaattcgtctcacccctagaaaaaattattatccacaacactcatcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggaaatctccggggacacgggcccagcctacaacattgacaatctggtcaagtctctcaaattcgtcaccaacaaacccgcttacggaccgtacggcagggacgagggcaccccgttccgtgtcaagggtgatgaaaaacggccaccgtccctgggcttcttttggccccctctggagaatggcctgggaccccaatctgggcttttccgtggaacccccccctcaataaccataaaacgaagggaatcgggaatcctctcggctggccgtggcattatgcccggaattgcctggcctgn

SEQ ID NO: 62125 - protein, 180 aa, Zea mays
  misc_feature: Ceres CLONE 1526670
  misc_feature (15)..(138): Pfam Name: Jacalin Pfam Description: Jacalin-like lectin domain
MGKPAKIGEWGGYAGDRRDLRATPDRLIEVKVTADNSSCIRSISFIYIGADGKPYEEGPWGFGHAGTEYKIDLCRFDESLTEISGDTGPAYNIDNLVKSLKFVTNKPAYGPYGRDEGTPFRVKGDEKRPPSLGFFWPPLENGLGPQSGLFRGTPPSITIKRRESGILSAGRGIMPGIAWP

SEQ ID NO: 62126 - DNA, 834 bp, Zea mays
  misc_feature: Ceres CLONE 1526671
  misc_feature (1)..(1): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (638)..(638): n is a, c, t, g, unknown, or other
  misc_feature (763)..(763): n is a, c, t, g, unknown, or other
  misc_feature (834)..(834): n is a, c, t, g, unknown, or other
nccttttttcctgttgttattatctttnnnnnnnnnngggctannnnnnngaaactggagctccccgcggtggcggccgctctagactagtggatcccccgggctgcaggaattcgtctcacccctagaaaaaactcggcccgcaggcagaggcagtatatcagcaggcagctccatccatcctctttcccctcctcgcttcgcttcctcggcggattccgcctccctcgaccgtccccgtccccggcccctttccggcgcgccagctcgcccgaagatggcctacgcgggatcgggtgtcgctgtgaatgacgaggggctgctcaagttccccccagcctcacccggagagggtggaccggattcccgacttttagtatgggaccacaagttttggggaagtggggagggggattttttttttccccccccccttgggggggggggggggggggctttctatcccttctttgtttggtcccccccccccggctggtagccccgaacctgtcgagcctggtccccatgggttgagcggggcgcaaaaggggcccctgggatacataccaggcgaacgcgttcgggccctagtgtcgggggtcattgtgatatggtgcgtccagacgccagttaatcgnaagcaaacgggcggtctagggtttacctcgccgtgggtccgtccggacataactaattaagggagcgaagagctccgcgggtgtttcggccagggatttgcttgtcggaccactagacggtacgncggtgcgcttcgcgttggtggttctcgccatcctgattgcgggtttatggctcggcggtccctacggcgcn

SEQ ID NO: 62127 - DNA, 614 bp, Zea mays
  misc_feature: Ceres CLONE 1526672
  misc_feature: Encodes the peptide sequence at SEQ ID NO. 62128
tggcggccgctctagaactagtggatcccccgggctgcaggaattcgtctcacccctagaaaaaggttcccctcctgtctccgtcttctcaccaccgctgcctccgcggtttcgcttccccccgtcttcccaagcctttgcttcgctcttcgcttcggattccctctgctcatggccgggagagggaaggcgatcggctcaggggccgccaagaaggccatgtccaggagctccaaggccgggctccagttcccagtgggaaggatcgccaggttcctcaaggccgggcaagtacgccggagaggggtcggccgccgggcgccccccgtctacctcggctgccctggctccaaataatcctgggctggctgaagggtttctccgagctttggccggggaaaacccgggctttcgtggacaaaacaaaaaaaagacccccaaaattcgttcccccgcgccccccatattcacaggttttgggccggctcccgctaaccggaaatagaggggaaagccttctcccccccccctttttggctgggggggccacccccggggggaaccccctttcccccccccacaggggcgcggggggggggggcctctacaagccc

SEQ ID NO: 62128 - protein, 61 aa, Zea mays
  misc_feature: Ceres CLONE 1526672
MAGRGKAIGSGAAKKAMSRSSKAGLQFPVGRIARFLKAGQVRRRGVGRRAPPVYLGCPGSK

SEQ ID NO: 62129 - DNA, 630 bp, Zea mays
  misc_feature: Ceres CLONE 1526681
  misc_feature: Encodes the peptide sequence at SEQ ID NO. 62130
ctggagctccccgcggtggcggccgctctagaactagtggatcccccgggctgcaggaattcgtctcacccctagaaaaagaacgaaatctatccaagcaacaaacttggcattcttgcctgttctcaattattgccaggacaggagaaacaaagatgaagcctcatctgatactcgtcggcactctgggtgttctcggcatcctcgcagctctcggcgaaggctcgtcgtcctgaccctgctgcaacaactgcggtgcttgcaacaagaaccagccgccagaatgcctgtgcaatgacctgccggtcaacgggcgccatccggagtgcataatctgcgtcaaggtcggcgcaggaattcatcccggcatgggccatgaccccgtcctcacctaccgctgtgacgactttctcacaaacttctgccagatcagctgcccggacgcgccggcgccatatgcgggtggacagtgtcttcttctgacgtacggcatgggacgccaagtcgagtttgcttctctccagtttcctcagagaacacaaataaaccagctaattaatgtagccggccgctctgctcgatgcttgctcttgttaaaagaaaaatcacaccagaccctcgaagacccaa

SEQ ID NO: 62130 - protein, 87 aa, Zea mays
  misc_feature: Ceres CLONE 1526681
MGHDPVLTYRCDDFLTNFCQISCPDAPAPYAGGQCLLLTYGMGRQVEFASLQFPQRTQINQLINVAGRSARCLLLLKEKSHQTLEDP

SEQ ID NO: 62131 - DNA, 657 bp, Zea mays
  misc_feature: Ceres CLONE 1526682
  misc_feature: Encodes the peptide sequence at SEQ ID NO. 62132
ggagctccccgcggtggcggccgctctagaactagtggatcccccgggctgcaggaattcgtctcacccctagaaaaacttcctcccttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgttatttttgaacgctatccaaataaatttgaaaccagattgccgaaaaaaaaaaaaaaaaacgagacgctcgaggtacccaattcgccctatagtgagtcgtatt

SEQ ID NO: 62132 - protein, 62 aa, Zea mays; identical to SEQ ID NO: 6893
  misc_feature: Ceres CLONE 1526682
  misc_feature (3)..(61): Pfam Name: Ribosomal_S30 Pfam Description: Ribosomal protein S30

SEQ ID NO: 62133 - DNA, 637 bp, Zea mays
  misc_feature: Ceres CLONE 1526685
  misc_feature: Encodes the peptide sequence at SEQ ID NO. 62134
tagctggagctccccgcggtggcggccgctctagaactagtggatcccccgggctgcaggaattcgtctcacccctagaaaaaattcttctcccccaactccacaagaccagtccccaattatttgggctccgtcggagaggggacatggacccgttcgaggcggtggccatgtcccgaggtcgcgtcaaggcgcggctagggtctgaacatacggtgtgagcctagcgccacctggacggtgctcggcgacaacatccagggcatcaccaatcccgagatccagatgctggctcccaaggacgacctgatccgcctctccgggctcctccacaagaagacccgcggcgcgctcgagatctccatcgtgaacgtcttccgctacgacgtccccttgtccgatcacgccctccacaagaccgtcaccgcatgcaggtctcctattcactcatgcgccatggcctctccctctactggttcagacgcctggcgcctcttcctaactggcgcatgctaacggtgatacgactgcctcgctgtgcgtggtaatggggatcgcacttcgtggatcttctacattggtggtttccgctacgaagagctgctagagggtctccctcatgcttacgtggagcctg

SEQ ID NO: 62134 - protein, 76 aa, Zea mays
  misc_feature: Ceres CLONE 1526685
MLAPKDDLIRLSGLLHKKTRGALEISIVNVFRYDVPLSDHALHKTVTACRSPIHSCAMASPSTGSDAWRLFLTGAC

SEQ ID NO: 62135 - DNA, 630 bp, Zea mays
  misc_feature: Ceres CLONE 1526686
  misc_feature (355)..(355): n is a, c, t, g, unknown, or other
aagctggagctccccgcggtggcggccgctctagaactagtggatcccccgggctgcaggaattcgtctcacccctagaaaaaggaccaaatagatcccttcccccgccctccctcgacttcaccttcgcctgttggaggattccaccaccgccggcgaaccggcccgaccctcctcccctctcgcgctatgggccaaactgttgtgctcacggctggcgtgaaccgtcaaggctgtgttccacttgacccgccgctcccccgccagatgcagcgtctccagtcccactacccccacctccgcaacaaagggacccgcgcagggtctgtgacacctgaagccatcctgccactgnttccaggactgcctggaagacttctctctgggcggctgagacctcgacacctcaatccgccacaccagccggtgcctccgcctgacaggtgcgatgatctggtagtgccctgaaacgcagcgaacaaataaaatggcaatagctttagctcggatccgaatgaataatgtgcaacagctcgctctgtctgtactgttacagacgctattcgagttctctgatcgactcgaaagtttgggaagatgaaaaaccgatacgtgcaaggaaacctgtgc

SEQ ID NO: 62136 - DNA, 643 bp, Zea mays
  misc_feature: Ceres CLONE 1526687
  misc_feature: Pfam Name: FMO-like Pfam Description: Flavin-binding monooxygenase-like
  misc_feature: SWISSPROT Homolog: EC 1.14.13.8 Flavin-containing monooxygenase
ctggagctccccgcggtggcggccgctctagaactagtggatcccccgggctgcaggaattcgtctcacccctagaaaaagcccgtaaccctaaccctaaatcctatcgcgccgcacacccgctcctcggctccctgctctctccgtccacgggaagtcggagaagcggtacccggcggccgacgactgcagccgggtggacgcgagcgtgcgcgtccacaggccgcccacggtggcgcccgcctcgaagaccaccggccggaagcccctcgccaggaggtgcttgcacgcggcgagcccggtcgtgccggcgcccacgatggccacccgcttcgccgcgccctgcggtccacgatatgcaaatgcggcttgcaggttttcagatggaagttgttaaaactactcatgcactgtttgtattatagtttagacgattcatattatattttcgttaggaataattatgttatttgctagctcactatttatagctctacaggtgctcaatggtcttctcattaagagtgatagagcagaagctgtatcaattccagttggaataattcctgcaggtggtggttgttgagaaatggcttgctgtgccgcctcaaggtttcgtgtcactcacagcttcctgggggga

SEQ ID NO: 62137 - DNA, 670 bp, Zea mays
  misc_feature: Ceres CLONE 1526691
  misc_feature: Encodes the peptide sequence at SEQ ID NO. 62138
  misc_feature (58)..(58): n is a, c, t, g, unknown, or other
  misc_feature (137)..(137): n is a, c, t, g, unknown, or other
  misc_feature (211)..(211): n is a, c, t, g, unknown, or other
  misc_feature (221)..(221): n is a, c, t, g, unknown, or other
  misc_feature (229)..(229): n is a, c, t, g, unknown, or other
  misc_feature (235)..(235): n is a, c, t, g, unknown, or other
  misc_feature (237)..(237): n is a, c, t, g, unknown, or other
  misc_feature (292)..(292): n is a, c, t, g, unknown, or other
  misc_feature (335)..(335): n is a, c, t, g, unknown, or other
  misc_feature (353)..(353): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (428)..(428): n is a, c, t, g, unknown, or other
  misc_feature (429)..(429): n is a, c, t, g, unknown, or other
  misc_feature (431)..(431): n is a, c, t, g, unknown, or other
  misc_feature (432)..(432): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (466)..(466): n is a, c, t, g, unknown, or other
  misc_feature (477)..(477): n is a, c, t, g, unknown, or other
  misc_feature (518)..(518): n is a, c, t, g, unknown, or other
  misc_feature (613)..(613): n is a, c, t, g, unknown, or other
  misc_feature (625)..(625): n is a, c, t, g, unknown, or other
tggcggccgctctagaactagtggatcccccgggctgcaggaattcgtctcacccctnagaaactagccgcatcccttctttcattcgccgccgccgcctgctctctgctgccgtcgccatggggagaaggcctgcnatatgctatcgccagatcaagaacaagccataccccaagtccaggtactgccgtggtgtccctgacccaagatnaggatctacnatgttggnatgaananaaagggtgttgatgaattcccctactgtttgcaccttgacggcggggagaaaganaatgtctcttttttttttcttgaggctgcccctattttgctgnattttttttttcccccancccgggggaaagaaaaaggggnnnnnnnnnnnnnnnnnnnnnnnnnnnnnaaaaaaaaaaaaaaaaaaaaaaaanntnnggggggggggggggaaannnnnnaaaaaaaaaanaaagggggganaaaggaaaaagaaaagagaaaagagaggaaaaagaagaaangaggaaaaaaaaaaagagaaggcgggccaggaaaccaaaacgaaagcccgcccccgcccccggacaaaccgggcgccgggagagggagaaacccnacccgaccagcnacacgaagaccccccacccacggccccccgagcccacgccggacc

SEQ ID NO: 62138 - protein, 36 aa, Zea mays
  misc_feature: Ceres CLONE 1526691
  misc_feature (31)..(31): Xaa is any aa, unknown, or other
MGRRPAICYRQIKNKPYPKSRYCRGVPDPRXGSTML

SEQ ID NO: 62139 - DNA, 653 bp, Zea mays
  misc_feature: Ceres CLONE 1526697
  misc_feature (630)..(630): n is a, c, t, g, unknown, or other
tccccgcggtggcggccgctctagaactagtggatcccccgggctgcaggaattcgtctcacccctagaaaaaggtcttggtagcctcgtcgaccccttcgcctggtcttcgtcgggcccttcgccggcgacaaacacccattagtagtcctcccgtggcaggccagacattcagattgaactcgtcggctctcgtcctccgtcctctggtcctctctgagcgagacagcaagagagatgctgctggaaggaagcttgcgaattcgaaggacggtaaatgagttctttgcgcgcgcgaaaggatgggctcctgtgtccagaaggatcgtgggttgacaaaaagtctttggccctgtcttgcttattgatgtgtggttgcagtttggtagttctctgctggctcttggctgctggtttgtaatatatcgttatgttagctgatgaatggtcggcttttgatactttccatcgttaggtctttatctcgtgtgtgagtttcgctaagtcgaactcaataaaatcgctagtgacttcacagtctgtagtaaggctgtccagtagttgatcgtcggttaggcgtttgaagtctatggtaccttaagttcgccgcctggatgtaattgcactcgnttttgttatgtttcctatttctt

SEQ ID NO: 62140 - DNA, 680 bp, Zea mays
  misc_feature: Ceres CLONE 1526701
tggcggccgctctagaactagtggatcccccgggctgcaggaattcgtctcacccctagaaaaaatcctactgtcagacacacaacagaaagagacaagtggtttccaaagccaagtgtgtactagcagatctagataccagttagctcgggcggcagcaggcagccatcatgtcggaggagaagcaccagcacttcttcaaccaccactagaaggacgaggagcagcccgccggcgagtacgggtactccgagaccgaggtggtcaccgccaccggcgagggcgagtacgagaggtacaagaaggaggagaacgagcacaagcacaagcagcacctcggcgaggccggcgccatcgccgccggcgccttcgcactctacgagaagcacgaggcgaagaaggaccccgagcacgcgcacaggcacaagatcaccgaggaggtcgctgccgcggcggccgtcggcgccggcggctacgtattccccgagccccccgagaagaaaaaggaccacagggacgccgaggaagctaagcggcgagaaaaaaaaaccaccaccttcttcggctggaccgtaataaccggccggccgcgcgaccgaaactaacttaggctccgggcgcacaacaaaccacacaaccttgtttaaattcttgtaccggcatggcgagcgtgtaaattg

SEQ ID NO: 62141 - DNA, 724 bp, Zea mays
  misc_feature: Ceres CLONE 1526705
  misc_feature: Encodes the peptide sequence at SEQ ID NO. 62142
  misc_feature (94)..(94): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
tggcggccgctctagaactagtggatcccccgggctgcaggaattcgtctcacccctagaaaaaacgcttctccgccgccacttctcctccggnatcgacgaggcgaagccccagcgcccgagtccctctccctgctcccacgacccatggggggggatatggcgtacccgccgcccatgaaggcggccaaagcccgtttcaaagctggcacgatgcatccccaccacacgatccccatcccgctctcctccacaacgctatgattctcccgaaagggggagggggattcggtgaagctcttttttgtaaacgagtttcaaggccaaaggcccccaacttttttttttcccccccccaccgaggaaaagaaaaggggaaannncccccattttcttctcacccccattcccctcaataataacaaaaaaaaaaacctaatggggggggagggggggccgcccccaatccctacccacaccaacaaattgcgcataccggttccaactcccccccccgcaactctcccccaatcgttgcacaacttccccccccctcccccagaattttaccccctcttaccgcctccgactaatataatacctcctcctcaaaacactcccccccacacaatccctaccctctcccaacccccggtggaccactactccaagcttcttggagatccacccacctcgataaaaccccccctttcctcccgccatg

SEQ ID NO: 62142 - protein, 38 aa, Zea mays
  misc_feature: Ceres CLONE 1526705
MGGDMAYPPPMKAAKARFKAGTMHPHHTIPIPLSSTTL

SEQ ID NO: 62143 - DNA, 628 bp, Zea mays
  misc_feature: Ceres CLONE 1526706
  misc_feature: Encodes the peptide sequence at SEQ ID NO. 62144
  misc_feature (408)..(408): n is a, c, t, g, unknown, or other
atagctggagctccccgcggtggcggccgctctagaactagtggatcccccgggctgcaggaattcgtctcacccctagaaaaaatgcaaaatttcccgacccctctagaacgaccgcccctgccgaggagccgaccgacgggcgaagcgggagggaggcgatggcggcggcttgggggcagaaggccctgggggctctgccgcagctggtgaagtcgctgcggagtgatcccgtctccggcagcgcacgacacaggcgccttccgtctctcaggaggaccttctcgttgtacgatcagatcaacctcatcgacagcgtcccggaagacgagctccgattccagtcgtatgatgacactggattcaccattaacaatgtgggatgtgaaggcagtgtattgattgtanagaacaagataatgacatggggcccccaaaacgttctcagagataactccctgaaagtttatcaatcttccaagttgtgccaccctatcccagagatctttattcttgggtgcggaagacccgtccagctggtcagtcctgaactgcggatgttcattcggggcactgggatggaacctgaaagcgttgattccaggaatgcggcttccaccttatattt

SEQ ID NO: 62144 - protein, 155 aa, Zea mays
  misc_feature: Ceres CLONE 1526706
  misc_feature (60)..(155): Pfam Name: DUF498 Pfam Description: Protein of unknown function (DUF498/DUF598)
  misc_feature (83)..(83): Xaa is any aa, unknown, or other
MAAAWGQKALGALPQLVKSLRSDPVSGSARHRRLPSLRRTFSLYDQINLIDSVPEDELRFQSYDDTGFTINNVGCEGSVLIVXNKIMTWGPQNVLRDNSLKVYQSSKLCHPIPEIFILGCGRPVQLVSPELRMFIRGTGMEPESVDSRNAASTLY

SEQ ID NO: 62145 - DNA, 651 bp, Zea mays
  misc_feature: Ceres CLONE 1526708
cgcggtggcggccgctctagaactagtggatcccccgggctgcaggaattcgtctcacccctagaaaaagtagtcctcgtctcttctccatcacgtaccttatctcccaagttgtttcctctctggccatgccgtggagcattagccaacctcctccacaggtccgcgttccagctccctcctgctcctgctcaacccgtccctctacttgctagcctcggcgaatttacctgcacgctccactgcgccatcgctcctgccagccatggacgtgcgttcctcgagcttgtccagcaagtcgcgcccagaccacatcaagctcctcctcggatcgctgtcttcgagcccgaccacaatctgcagcgcgcccagcgactctgacccaacgcgcgctctttgctggagttcaccggtgttctccacagctcggctttccatagcgccgctcgccctcagacatggcgccctcgcctccatggtgctcaactggggcggatcttgtgcccctgctcttctccgcggataggccgccgtacgaacagtacgcacagtacgtttaagccgccatactcacagtaccggtcataaagatagtcattatatgttatttttatttataaaatacgttattaatatttatgtaagtgttgg

SEQ ID NO: 62146 - DNA, 668 bp, Zea mays
  misc_feature: Ceres CLONE 1526711
  misc_feature: Encodes the peptide sequence at SEQ ID NO. 62147
  misc_feature (235)..(235): n is a, c, t, g, unknown, or other
  misc_feature (392)..(392): n is a, c, t, g, unknown, or other
  misc_feature (473)..(473): n is a, c, t, g, unknown, or other
  misc_feature (507)..(507): n is a, c, t, g, unknown, or other
  misc_feature (509)..(509): n is a, c, t, g, unknown, or other
  misc_feature (553)..(553): n is a, c, t, g, unknown, or other
  misc_feature (554)..(554): n is a, c, t, g, unknown, or other
  misc_feature (609)..(609): n is a, c, t, g, unknown, or other
  misc_feature (643)..(643): n is a, c, t, g, unknown, or other
  misc_feature (654)..(654): n is a, c, t, g, unknown, or other
ggagctccccgcggtggcggccgctctagaactagtggatcccccgggctgcaggaattcgtctcacccctagaaaaaaacccaaccgcgcaaaacaccttcacgacaccggcagggtctaggagatcacacgcacatgccagctgaacctgaactcagatcgatcgccgccgtcttggctcctcgacgtctgccatcggctgttgggtgagtctgggaaggcggtgtgtgtgcnttcatcggatgcgggtttgcagctggtcaaactcgtcggtaagaaaccacttcggactcgcctttcgtcccttcatcatcgatgcgtgcatggaccgaggtagaaattgttagcctgctctgcggcccttgggcggcgcggggagcgcgaggctacnagtcatttgaagatcatcctggtacctggaatctcaagtcccaggtccagaacaggtaccaccaggatgaaggcgcatggnaggattgctgtgatgaattttgtgacggggtctnangcccgtccgcctccccggtcaaactttggggttggctgggaccnnttgtccaccctatgaatggaaaattattttatttttggaaaaagaaacctcccanttattttaactgaaaaaatggggaacaattccgnttcctaaaagnaggaaaccaagaac

SEQ ID NO: 62147 - protein, 101 aa, Zea mays
  misc_feature: Ceres CLONE 1526711
  misc_feature (26)..(26): Xaa is any aa, unknown, or other
  misc_feature (53)..(53): Xaa is any aa, unknown, or other
  misc_feature (64)..(64): Xaa is any aa, unknown, or other
  misc_feature (65)..(65): Xaa is any aa, unknown, or other
  misc_feature (80)..(80): Xaa is any aa, unknown, or other
  misc_feature (98)..(98): Xaa is any aa, unknown, or other
MRAWTEVEIVSLLCGPWAARGARGYXSFEDHPGTWNLKSQVQNRYHQDEGAWXDCCDEFCDGVXXPSASPVKLWGWLGPXVHPMNGKLFYFWKKKPPXYFN

SEQ ID NO: 62148 - DNA, 665 bp, Zea mays
  misc_feature: Ceres CLONE 1526714
  misc_feature: Encodes the peptide sequence at SEQ ID NO. 62149
  misc_feature (1)..(1): n is a, c, t, g, unknown, or other
naaagctggagctcaccgcggtggcggccgctctagaactagtggatccccccgggctgcaggaattcgtctcacccctagaaaaagacgttcattccgcttgcttgattgttccaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtccctgttgcgggaggtggggggtggtgctggcggaactgctcctgcagctgaggcaaaaaaagaagaaaaagtggaagagaaggaagaaagcggtgatgatatgggcttcagcctcttccaataggctgcacagtcatcacagttttggtttgggcagtggaaccccaaggaaaccccgagtcctgtgttaaatttttaagcttggtttaagttggaaaagatcctggaaaaaaccgccccttgccttttattttgggaaattccacccccaaattggctttgccggttggggatattccg

SEQ ID NO: 62149 - protein, 88 aa, Zea mays
  misc_feature: Ceres CLONE 1526714
  misc_feature (17)..(80): Pfam Name: Ribosomal_60s Pfam Description: 60s Acidic ribosomal protein
MKFVAAYLLAVLAGNASPSADDLTAILESVGCEVDNEKMELLLSQLSGKDITELIAAGREKFASVPCGGGGVPVAGGGGWCWRNCSCS

SEQ ID NO: 62150 - DNA, 643 bp, Zea mays
  misc_feature: Ceres CLONE 1526717
  misc_feature: Encodes the peptide sequence at SEQ ID NO. 62151
aaagctggagctccccgcggtggcggccgctctagaactagtggatcccccgggctgcaggaattcgtctcacccctagaaaaacccactcctgcagtccttctccacctagctcccccgcgccaagaacacgccagctagcaagcgcgctcgatcgaataccgttaccgtgtcgccatggccgccaccgcgtctctatcagccgtcggggcgccgctgtcggtgcccgggctcaggaagccgctcggcgtgtcgtcgctccggcccctgcagccgagggcggcgaggatgacgacgacggccgtgcgggcgtcggcgtcgccctcgtccacgtccatcaaggagaaggctgcggccgggctgaccgcggcggccctggcggccgcgctggtgctgccggacgtcgcggaggccgcgcagtccggcgggctcacgccgtcgctcaagaacttcctcctcagcatcgtgtcccggtggggtcgtgctcgtttggtattgtcggggcccgtcgtcgccgtctccaacttcgaccccgtgcagaaggcctgatcggaatccatcgtatcgatcgtctcgcccgtggtctgtcctgtgcctgtgctgtctgtatcgactggtggtgctaatccccctgtgtgttatt

SEQ ID NO: 62151 - protein, 123 aa, Zea mays
  misc_feature: Ceres CLONE 1526717
MAATASLSAVGAPLSVPGLRKPLGVSSLRPLQPRAARMTTTAVRASASPSSTSIKEKAAAGLTAAALAAALVLPDVAEAAQSGGLTPSLKNFLLSIVSRWGRARLVLSGPVVAVSNFDPVQKA

SEQ ID NO: 62152 - DNA, 591 bp, Zea mays
  misc_feature: Ceres CLONE 1526719
  misc_feature: Encodes the peptide sequence at SEQ ID NO. 62153
  misc_feature (433)..(433): n is a, c, t, g, unknown, or other
  misc_feature (465)..(465): n is a, c, t, g, unknown, or other
gctctagaactagtggatcccccgggctgcaggaattcgtctcacccctagaaaaaagtcgcccacaaaaacccagtaactcgcatcttcctccgtgatccaagttctagcagcgcagcgctcggtttcggcaatgtcggggcgcggcaagggcggcaagggtctgggcaagggcggcgccaagcgccaccgcaaggtcctgcgcgacaacatccagggcatcaccaagccggcgatccggaggctggctaggaggggcggcgtcaagcgcatctccgggctcatctacgaggagacccgcggtgtgctcaagatctttctggagaacgtcatccgtgacgccgtcacctacaccgagcacgcccgccgcaagaccgtcaccgccatggatgtcgtctacgcgctcaagcgacagggccgcaccctctacggncttcggcggctaggtcgctttcctcatctggntggcgaacttgcatctgttgtcggccggtggttcgtgttgtgtgcctaaactagtgtagtcccgtctctaaacgtccctgtgttctggggggctttggacccatttcctggcaaacaaacttgcat

SEQ ID NO: 62153 - protein, 126 aa, Zea mays
  misc_feature: Ceres CLONE 1526719
  misc_feature (25)..(94): Pfam Name: Histone Pfam Description: Core histone H2A/H2B/H3/H4
  misc_feature (111)..(111): Xaa is any aa, unknown, or other
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGLRRLGRFPHLXGELASVVGRWFVLCA

SEQ ID NO: 62154 - DNA, 581 bp, Zea mays
  misc_feature: Ceres CLONE 1526721
  misc_feature: Encodes the peptide sequence at SEQ ID NO. 62155
gctccttcctgtttctggagataccaagcacgagtgcagcaatggcgcatcccatgcctcccctctcagcatcacagagcacaatcaccaccgttctgaagatccttccaaaacctcctgctgctccggagagcagaagcaataattgtgcttttggggccaaattcgacagtaggagggcacttctatgcggcttggtcgctgctgctgctgctgctggcaccatgctgggcgctgacatcgctggtgctgcttcgaagaggcggcctccaccgccagcgccggcagaggcgaagaaagacccgaacgtcagcggagtgcaggctaaagtgcttgctagcaggaagaggaaggaggccatgaaggaagctgtggccaagctgagggagaaaggtaagccggttgataagtgaaggccagaaccagtgacccttgatcaagaaatgtaacttattgttaaataatatactccctctattcttctaaagtaataagccattaatttgaatagtctactcactttatgtgtacagatgagaataaaaatacaactattttgcttgtaaaaaaaaaaaaaaaaa

SEQ ID NO: 62155 - protein, 123 aa, Zea mays
  misc_feature: Ceres CLONE 1526721
MAHPMPPLSASQSTITTVLKILPKPPAAPESRSNNCAFGAKFDSRRALLCGLVAAAAAAGTMLGADIAGAASKRRPPPPAPAEAKKDPNVSGVQAKVLASRKRKEAMKEAVAKLREKGKPVDK

SEQ ID NO: 62156 - DNA, 590 bp, Zea mays
  misc_feature: Ceres CLONE 1526722
  misc_feature: Encodes the peptide sequence at SEQ ID NO. 62157
ccgcggtggcggccgctctagaactagtggatcccccgggctgcaggaattcgtctcacccctagaaaaagccaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcggcggcagcgggcggcgccgacgtgctgatcgtcgtcccgaggagggcgggcgctgggcgcgtctggttccccgcggcggcgcgccgcggcggcggcagcgggcggttggtcgccgtgcggtccagcgggccggccacgccgccggagatctccgacaaggtgtcgggagagcatcaagcaaggcgggaggaaaaccttgcgccggaaacaaaccaaaaaagggggccaacccccccaaaatggcccccccgccccccctttgggaaaaaaaagggggggggagaaaaattgtttaaggcccccccgggggataaaaaaaacccccccc

SEQ ID NO: 62157 - protein, 130 aa, Zea mays
  misc_feature: Ceres CLONE 1526722
MAASTVASLSVPVTTTTFAAAAAAGGADVLIVVPRRAGAGRVWFPAAARRGGGSGRLVAVRSSGPATPPEISDKVSGEHQARREENLAPETNQKRGPTPPKWPPRPPFGKKKGGGEKLFKAPPGDKKNPP

SEQ ID NO: 62158 - DNA, 659 bp, Zea mays
  misc_feature: Ceres CLONE 1526729
  misc_feature: Encodes the peptide sequence at SEQ ID NO. 62159
  misc_feature (388)..(388): n is a, c, t, g, unknown, or other
ggagctccccgcggtggcggccgctctagaactagtggatcccccgggctgcaggaattcgtctcacccctagaaaaaccccagagattcgcatattctcgcgatgggagcggaggaagcagagggtactcccccgccgctgcccgccaccggcgagcccgcaaccacggcaagggcgcagccaatatctgcagcacaattcctctcctggaagcagcgcaaggatgcagaggtagccgtaaggaaagctgaagcagctcagaagcgagctgatgatatcgcttcgggagcggtgcagatgaacggccgcgagctgttccaacaagagccctgggtgtttgacaaccacatttactgagatcgtgtcgggctactgttcctgcattantccaagctccagcggtggtttcattttgtactgctatatcagctttgcggaactgtggattttatttcaccgtttataagattattctctcaataggtattttgaacttgtttcaaatacgttttgccaaaaaaaaaaagagaaattaatggaagaaagcaaatcggaggaaaaataaaagtaaaaaatgagccccttgggggaccccaattcccccctaatgtgagggccaattccgcggcgctaattgggcgtgcttttaaaaacatcc

SEQ ID NO: 62159 - protein, 84 aa, Zea mays
  misc_feature: Ceres CLONE 1526729
MGAEEAEGTPPPLPATGEPATTARAQPISAAQFLSWKQRKDAEVAVRKAEAAQKRADDIASGAVQMNGRELFQQEPWVFDNHIY

SEQ ID NO: 62160 - DNA, 656 bp, Zea mays
  misc_feature: Ceres CLONE 1526730
  misc_feature: Encodes the peptide sequence at SEQ ID NO. 62161
  misc_feature (391)..(391): n is a, c, t, g, unknown, or other
  misc_feature (394)..(394): n is a, c, t, g, unknown, or other
  misc_feature (410)..(410): n is a, c, t, g, unknown, or other
  misc_feature (411)..(411): n is a, c, t, g, unknown, or other
  misc_feature (468)..(468): n is a, c, t, g, unknown, or other
  misc_feature (469)..(469): n is a, c, t, g, unknown, or other
  misc_feature (482)..(482): n is a, c, t, g, unknown, or other
  misc_feature (514)..(514): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (629)..(629): n is a, c, t, g, unknown, or other
  misc_feature (630)..(630): n is a, c, t, g, unknown, or other
  misc_feature (632)..(632): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
gctctagaactagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgagttccacgagcgcanggnagagcttcctcgccannggctactgagctcgcccgggcggcccggccatccacgccccggttcgtgctttgccnntgcgtgccttaangtatggtctgtgggttgactgggtgtgcaggntcatcgtacttgggctatcggacgtgcccgcactccagcttcttgtacgaattaccgaaaataagcctggggaccctgaataaaactttcttcgaatttnnnnnnnnnnnnnnannanannnannnnaaagggaaaaaaaaa

SEQ ID NO: 62161 - protein, 120 aa, Zea mays
  misc_feature: Ceres CLONE 1526730
  misc_feature (85)..(85): Xaa is any aa, unknown, or other
  misc_feature (86)..(86): Xaa is any aa, unknown, or other
  misc_feature (91)..(91): Xaa is any aa, unknown, or other
  misc_feature (92)..(92): Xaa is any aa, unknown, or other
  misc_feature (111)..(111): Xaa is any aa, unknown, or other
  misc_feature (115)..(115): Xaa is any aa, unknown, or other
MAYYQEVDYCSEEVRSVAPAGFGRHGGGVQQHVVKEKFEEVDTVSRAGANHHHHHGHHGGHGFVVRETRVEEDINTCTGEFHERXXELPRXXLLSSPGRPGHPRPGSCFAXACLXVWSVG

SEQ ID NO: 62162 - DNA, 658 bp, Zea mays
  misc_feature: Ceres CLONE 1526736
  misc_feature: Encodes the peptide sequence at SEQ ID NO. 62163
tagctggagctccccgcggtggcggccgctctagaactagtggatcccccgggctgcaggaattcgtctcacccctagaaaaaagcctccgcccatacacacactgccccatcccgccggcgcacgagagaaccagcgccaccttatgttaaggcggtcgccgccgaacaactgcacggttgccaagatgcagatcttcgtgaagaccctgaccgggaacaccatcacgctggaagtggacgcctcggacaccgtcgtgaacgtgcacgccaacatcctcgacaaggacggtatcccgtcggaccagcagggcctcatcttctacggcaagcagctccaggatggacgcaccctcgccgactacaacatccagaacgactcgacgctgcacctggtgctccgcctcacggaaggcgccgggaaccgcgagaagaagacgtacaccacgccctagaagatcatgcacaagcccaagaaagtgaagctcgccgtgctccacttctacacggctgacgacgcgcccggcaaggtcccccgactccacaatgagagccccaacacccaagtgtcgtgcgcaggtcttacatggccaacccctgtccaccgcccactactgcggtatactgtaggcctaaccgtaaatcctacacccagcaag

SEQ ID NO: 62163 - protein, 88 aa, Zea mays
  misc_feature: Ceres CLONE 1526736
  misc_feature (6)..(74): Pfam Name: ubiquitin Pfam Description: Ubiquitin family
MQIFVKTLTGNTITLEVDASDTVVNVHANILDKDGIPSDQQGLIFYGKQLQDGRTLADYNIQNDSTLHLVLRLTEGAGNREKKTYTTP

SEQ ID NO: 62164 - DNA, 638 bp, Zea mays
  misc_feature: Ceres CLONE 1526738
  misc_feature: Encodes the peptide sequence at SEQ ID NO. 62165
  misc_feature (478)..(478): n is a, c, t, g, unknown, or other
  misc_feature (566)..(566): n is a, c, t, g, unknown, or other
aagctggagctccccgcggtggcggccgctctagaactagtggatcccccgggctgcaggaattcgtctcacccctagaaaaaattattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggccaggaaccccctgatgagcaggaacctggagaggaatggcaggatcacctgcatgacgtttccccggaactggctgcggagggacctgaacgtcatcggcttcgggctcatcggctggatggggccgtccagcgtcccggccatcaacgggaacagcctcacgggagctcttcttctccagcatcgcccaagagctggcccacttccccacgcccccgcccgtcacctcccagttctggntgtgtgctagtgacatgacacctgggcctgttcatcatgctcaccttcggccagatcggattcaagggcaggacctaggactatttcntagaagtgaagcggttatgaatcgtatcatcatcgctggtgctgcgttgcctgcctgcctgacgcaatccaa

SEQ ID NO: 62165 - protein, 116 aa, Zea mays
  misc_feature: Ceres CLONE 1526738
  misc_feature (114)..(114): Xaa is any aa, unknown, or other
MAASASTVSGLAGASLASRPAFSTSFTRGSRVSARNPLMSRNLERNGRITCMTFPRNWLRRDLNVIGFGLIGWMGPSSVPAINGNSLTGALLLQHRPRAGPLPHAPARHLPVLXVC

SEQ ID NO: 62166 - DNA, 668 bp, Zea mays
  misc_feature: Ceres CLONE 1526739
  misc_feature: Encodes the peptide sequence at SEQ ID NO. 62167
  misc_feature (309)..(309): n is a, c, t, g, unknown, or other
  misc_feature (391)..(391): n is a, c, t, g, unknown, or other
  misc_feature (397)..(397): n is a, c, t, g, unknown, or other
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
  misc_feature (565)..(565): n is a, c, t, g, unknown, or other
gaatagtggaggtcaccgcggtggcggccgctctagaactagtggatcccccgggctgcaggaattcgtctcacccctagaaaaacccctcctacgccccggccattcactcacccacctagctagtcatcactagtcacgttcgtccaccagagacaacaatggccatggagacgtgcttcaaagcgtgggcgctgcacgcccccgctggcagcaaggacaggctcctcgtcggcaacctggtgctgccgtcaaaacgggcgctcgcgccgctgtccgtgggccgcgtccccacgcgccgggccgggnacgtctgccattccaaaaacgcagtggacgaagttgtggtggcggtttttttcccccccccacggggggggggggggggggngaaaanncnnttcttttttaaatttctgggcgccaaaaaaaaaaacccctcccggaagatcggggcccggggatccaaaaagcttggccaaagaactaccgccgggaaaaatccccgggcttccaagacggaacaccgaacaaacgcgcccccaccgggccgcgctacccatangaagtccccctcgatcccccccccgggctcaccgtgggagggacggcaaataaaaacgaaaaccgccccctccgcccccgtcggaaaaatcccggggcacccc

SEQ ID NO: 62167 - protein, 169 aa, Zea mays
  misc_feature: Ceres CLONE 1526739
  misc_feature (50)..(50): Xaa is any aa, unknown, or other
  misc_feature (77)..(77): Xaa is any aa, unknown, or other
  misc_feature (79)..(79): Xaa is any aa, unknown, or other
  misc_feature (80)..(80): Xaa is any aa, unknown, or other
  misc_feature (135)..(135): Xaa is any aa, unknown, or other
MAMETCFKAWALHAPAGSKDRLLVGNLVLPSKRALAPLSVGRVPTRRAGXVCHSKNAVDEVVVAVFFPPPRGGGGGXKXXFFFKFLGAKKKNPSRKIGARGSKKLGQRTTAGKNPRASKTEHRTNAPPPGRATHXKSPSIPPPGSPWEGRQIKTKTAPSAPVGKIPGHP

SEQ ID NO: 62168 - DNA, 635 bp, Zea mays
  misc_feature: Ceres CLONE 1526740
  misc_feature (568)..(568): n is a, c, t, g, unknown, or other
aagctggagctccccgcggtggcggccgctctatttctagtggatcccccgggctgcaggaattcgtctcacccctagaaaaaacacggaaattccctggcgcctatgtgaaccatacttccctaagcactcttgcaatccagtgagttcagttagttgacacccaaagagctagctgctaacatctagaatgtctctcctgatgcgaaacaacctgttcgaccccttctagatggacctctgggatcccttcgacaccatgtgccggtacttcgtcccgtcggcgacctcctccaactcctagactgacgccttcaccaactcccagatcgactggaaagacacgcccaaggcgcacatcttcaaggcctacctccgcggcgtctagaacgaggacgcaaggtcgaggtcggacacggccacgtgctggtcatcagcgagcagcgcagccagctagaagaggacaaggacgacatgtggctcctcgtccagcgcagaactggccagtttatcaagcgctaccgcctgccgtagaactcccatgtggatcacgtcatggctggcctcnacaactgcgtgctcacggtcacagtacctaaagcggaagagaagaagcctgacgtgaaagctattga

SEQ ID NO: 62169 - DNA, 612 bp, Zea mays
  misc_feature: Ceres CLONE 1526742
  misc_feature: Translation starting site: 208
tggcggccgctctagaactagtggatcccccgggctgcaggaattcgtctcacccctagaaaaaaagcaagaacagctgtctatcccattgtcaattgatctctctccaacaatctaattaacgtcggtcgtcatccctcttctacctcgttttattatccgtggcggaggacaagcatcccctccaccacctgttccaccatagtaatgatcagggagcaggatgaccagctcgccggcggcgggaactgccagtccgccgagtacacagatgccacggtgacagacgtggtgtccacagtcgagaacgagtacgacgagtacaaggaggataagcagcatagacaccatcatgacctctgcgaggccgagcgccatcgccgacctgcgccttcgcactctacgagaatcacgagggaaacaacgacccggagcacgcgcaccgccatgagatctagaagaacgtcacgtcggcagcagacgatcgctcctgcggcttctccgtcctcgagcaccacataagaaatggtacctcagacgcccatgatgccggcggcatatataaacactacttcttcggctgattgatccctcccgtatcgtcgtccctcc

SEQ ID NO: 62170 - DNA, 653 bp, Zea mays
  misc_feature: Ceres CLONE 1526745
  misc_feature: Encodes the peptide sequence at SEQ ID NO. 62171
tacccgcggtggcggccgctctagaactagtggatcccccgggctgcaggaattcgtctcacccctagaaaaatgggccacgtctacaacatcggcaccaagaaggagcgcacggtgatggacgtggccagggacatcagcggcctcttcggcgtgcgcccggaggaggccatccagttcgtcgacaacaggcccttcaacgaccagaggtacttcctcgacgacgagaagctcaaggggctcggctggcgcgagaggacgcgctgggaggatggcctcaggaagaccatggagtggtacgtggccaaccccgactactggggggacgtgtccggggcgctgctgccgcatcccaaggcgggcggcgtcagcgtcatgaccaccacgacggaccacggcgcccggagatcgtcgtcggagatgctcgacgatcgtttcatttccatcccctcttctccgggagcggcgacggttgcaggaaacgacgatgacggcgcaccagctgcaatgccgtacagcaatggcggcgccccccatggaaccaccaccgtgcatttgatgcatgcctgcctggggtcgtcctttcgtcatatcacatcacatccacacctggacaaattaaatttgttttttcaggctattattttgtatta

SEQ ID NO: 62171 - protein, 193 aa, Zea mays
  misc_feature: Ceres CLONE 1526745
  misc_feature: SWISSPROT Homolog: EC 4.2.1.46 dTDP-glucose 4,6-dehydratase
MGHVYNIGTKKERTVMDVARDISGLFGVRPEEAIQFVDNRPFNDQRYFLDDEKLKGLGWRERTRWEDGLRKTMEWYVANPDYWGDVSGALLPHPKAGGVSVMTTTTDHGARRSSSEMLDDRFISIPSSPGAATVAGNDDDGAPAAMPYSNGGAPHGTTTVHLMHACLGSSFRHITSHPHLDKLNLFFQAIILY

SEQ ID NO: 62172 - DNA, 608 bp, Zea mays
  misc_feature: Ceres CLONE 1526746
  misc_feature: Encodes the peptide sequence at SEQ ID NO. 62173
tcagaactagtggatcccccgggctgcaggaattcgtctcacccctagaaaaaaccacgctgtgagtgactcggtcgcatcttccccattctccatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcccgcgagaaggttcatttctccatttccaagtggacggatggcaagcaggagaagccaactgtccgcacagaatcggatgactaagggctggcgccatggcgacatagtccttcctacagatgatttgaagcgtcgttgcaagtttctgggacttgttatttagttggcttgatttgtaatcaatgctgaagaataaatactttttgcgacaatggtctttttacaatgtcgtgttgttttcgttgctaattgcacttgccctaccctaatcaagcatgtgaactaatggaatgcttcagttttggtgcagtttggtaaaaaaaaaaaaaaaa

SEQ ID NO: 62173 - protein, 70 aa, Zea mays; identical to SEQ ID NO: 4918
  misc_feature: Ceres CLONE 1526746
  misc_feature (9)..(57): Pfam Name: ATP-synt_Eps Pfam Description: Mitochondrial ATP synthase epsilon chain

SEQ ID NO: 62174 - DNA, 657 bp, Zea mays
  misc_feature: Ceres CLONE 1526749
  misc_feature: Encodes the peptide sequence at SEQ ID NO. 62175
ctccccgcggtggcggccgctctagaactagtggatcccccgggctgcaggaattcgtctcacccctagaaaaaatcacatctcgacgcctactccgctagagcacatcttcaacagattcctagactgggcatatacatcgatagagatagacgcgaagaaagagcgaggagactagctgcggattatttatcacaacccggaccgcttccatgagagagagttgcatcaggctgctgcggccgcctcctagcgcgaaggacggcctactctatggccgccgccatggctaatacgggagccacctcacggacggtcaacaacaagaaggcggcagccgcgctgaccaaccgcgtgatggactagaaggaagtgaacacagctgccgctgcttcgactgaggagaaggcgtgagtgccggaccctgtcactggctactatcgcccagcaagtatcgccaaggaggtgtgacgcggctgagctacgctcctagctgctgacggaggctgccgccaactgattcatcgagcagtcactttgtccacctacagcatgagttggctctgtacacctatcttctcctgcttgaggatccgcgctcgttgatccccgagctccttggactaaagccttttagatgctcactgatacataggt

SEQ ID NO: 62175 - protein, 30 aa, Zea mays
  misc_feature: Ceres CLONE 1526749
MAAAMANTGATSRTVNNKKAAAALTNRVMD

SEQ ID NO: 62176 - DNA, 551 bp, Zea mays
  misc_feature: Ceres CLONE 1526755
  misc_feature: Encodes the peptide sequence at SEQ ID NO. 62177
ccccgcggtggcggccgctctagaactagtggatcccccgggctgcaggaattcgtctcacccctagaaaaaagccgctcactccagccattacccgcagctagcaaacaaatggccaccgtcctgagcagcccccgcgcgccggccttctccttctccctccgcgccgcgccagcgcccactaccgtggccatgacccgtggcggtggcgccagcagcaggctgcgcgcgcaggccacctacaacgtgaagctcatcacgccggaaggggaggtggagctgcaggtgcccgacgacgtctacatcctggactacgcccgagaggaaggcatcgacctgccctactcctgccgcgcggggtcctgctcctcctgcgccgggaagggcgtctccggggtcccgtggacccattccgaacaaaagtttccttcaaaaaagggccaaaaatccccccccggcgggggggcttccccgggggggggggaaccccaccccccaaaagtgtgtttttgggaaacgcccaaggggggaagaacccttttttcccccaa

SEQ ID NO: 62177 - protein, 146 aa, Zea mays
  misc_feature: Ceres CLONE 1526755
  misc_feature (49)..(117): Pfam Name: Fer2 Pfam Description: 2Fe-2S iron-sulfur cluster binding domain
MATVLSSPRAPAFSFSLRAAPAPTTVAMTRGGGASSRLRAQATYNVKLITPEGEVELQVPDDVYILDYAREEGIDLPYSCRAGSCSSCAGKGVSGVPWTHSEQKFPSKKGQKSPPGGGASPGGGEPHPPKVCFWETPKGGRTLFSP

SEQ ID NO: 62178 - DNA, 643 bp, Zea mays
  misc_feature: Ceres CLONE 1526757
  misc_feature: Encodes the peptide sequence at SEQ ID NO. 62179
  misc_feature (401)..(401): n is a, c, t, g, unknown, or other
  misc_feature (490)..(490): n is a, c, t, g, unknown, or other
tccccgcggtggcggccgctctagaactagtggatcccccgggctgcaggaattcgtctcacccctagaaaaactctcgcgccgccgcggaacacaacaccgcaccacactacccagcggaatccgcccacccgcacccgcacccggagcagaggagatatgtcgcaggggaagggaggagcggcgaggaaggaggaggtggtcaccagggagtacaccatcaacctccacaagcgcctccacggctgcacattcaagaagaaggcacccaacgccatcaaggagatcaggaagtttgcgcagaaggccatgggcaccacggacattaggatcgatgtgaagctcaacaagcacatctggagcagcgggatcaggagcgtgccgcggagggttcgtgtgangatcgccccgcaagaggaacgacgaggaggatcccaaggaggagctctactcccttgtcaccgtcgcagagatccccgccgagagcttngaagggctggggaccaaagtcgttgacaaaaccgattaagctgtcgcgttatctacatctttagagagttcctagtttgtatttgcaacaacaaaacctttttgtttcacaaagttgtctatttcccgaacaaaattgcatggctaaaataaa

SEQ ID NO: 62179 - protein, 118 aa, Zea mays
  misc_feature: Ceres CLONE 1526757
  misc_feature (10)..(87): Pfam Name: Ribosomal_L31e Pfam Description: Ribosomal protein L31e
  misc_feature (81)..(81): Xaa is any aa, unknown, or other
  misc_feature (111)..(111): Xaa is any aa, unknown, or other
MSQGKGGAARKEEVVTREYTINLHKRLHGCTFKKKAPNAIKEIRKFAQKAMGTTDIRIDVKLNKHIWSSGIRSVPRRVRVXIAPQEERRGGSQGGALLPCHRRRDPRRELXRAGDQSR

SEQ ID NO: 62180 - DNA, 619 bp, Zea mays
  misc_feature: Ceres CLONE 1526759
  misc_feature: Encodes the peptide sequence at SEQ ID NO. 62181
ctagaactagtggatcccccgggctgcaggaattcgtctcacccctagaaaaaaagccagacagaagacaacccgtcagcccctctcgtttttcatccgaccttcgcctccaaccgcgtgcgctccaagcctcctccaggaaagcgagagcttctgcataagaacaacaaatcaaaagcgtgatcagctcggtgccaacaaaacctcgacaaccaagtttcatgtctgatctcgacgtccagcttccatctgcctttgatccgattgctgaggcaaatgctgatgactctggtgctggtcctggaacgaaggattatgtgcatgtgcgcatccagcaacgcaacggcagaaagagtctgactacaatccagggtctgaagaaggagttcagctataacaagatcctcaaggatctgaagaaggaattctgctgcaatggtactgtagatcaggacccacagctaggccaggtcattcggctccaacgtgaccagcgcaggaatgttgctacattcctagatcacgctgggattgctaagaaagagaacatcgagattcacggcttcgtacggatctgtaaatgactgagccctatattgtgtgcctacacatattagga

SEQ ID NO: 62181 - protein, 120 aa, Zea mays
  misc_feature: Ceres CLONE 1526759
  misc_feature (27)..(108): Pfam Name: SUI1 Pfam Description: Translation initiation factor SUI1
MSDLDVQLPSAFDPIAEANADDSGAGPGTKDYVHVRIQQRNGRKSLTTIQGLKKEFSYNKILKDLKKEFCCNGTVDQDPQLGQVIRLQRDQRRNVATFLDHAGIAKKENIEIHGFVRICK

SEQ ID NO: 62182 - DNA, 639 bp, Zea mays
  misc_feature: Ceres CLONE 1526762
  misc_feature (523)..(523): n is a, c, t, g, unknown, or other
aaagctggagctccccgcggtggcggccgctctagaactagtggatcccccgggctgcaggaattcgtctcacccctagaaaaagaacaggcaacaaggcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccacaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaaatagatccctgtcactgcacccgccattatcgatccatngtccgctcctgggggttcatgttccatctgtaacgtgctccgcggtcatgtcccgtctccgtgccgaattttaatattaaaatgcagggattttgtgtttttttcggcgttattac

SEQ ID NO: 62183 - DNA, 663 bp, Zea mays
  misc_feature: Ceres CLONE 1526764
  misc_feature: Encodes the peptide sequence at SEQ ID NO. 62184
  misc_feature (663)..(663): n is a, c, t, g, unknown, or other
ggagctccccgcggtggcggccgctctagaactagtggatcccccgggctgcaggaattcgtctcacccctagaaaaagctccaaaccaaagccatcggaggagcaactggacgaccatggcctcgccgctgctcaagtcacactctcagctcgccgccgccgccgccctgcactccgtgaggagagccgaccgctgccctgcgacactacacctgggcaagttccatgaccacgggctcaggtccggccgttctaagagatccggttcagcgagggtgggcgccttcccgtcgctggacgtggtgccgctgatggtgacgatggtggagcacgtggacatgtcgcgggactacgtcgtgaccaagtccatctggcatctcagcgacgtagccctcaagagcgtctataccttctacgccatgttcacccgtctgggagtctgcttcttcccgtccatgaaagatccctcctacgacagcgagacgtacaggaacccagggtggcgacgggaccgtgcactggtactacaacaggcaagaggacctgaaggcgtctgcaagggaagaactgctgccggaaggacctgctctaggaaaatggatcaaaggggtggggggcccccgggaaccttggcggaaaccagccaaggaggaactcttccn

SEQ ID NO: 62184 - protein, 182 aa, Zea mays
  misc_feature: Ceres CLONE 1526764
MASPLLKSHSQLAAAAALHSVRRADRCPATLHLGKFHDHGLRSGRSKRSGSARVGAFPSLDVVPLMVTMVEHVDMSRDYVVTKSIWHLSDVALKSVYTFYAMFTRLGVCFFPSMKDPSYDSETYRNPGWRRDRALVLQQARGPEGVCKGRTAAGRTCSRKMDQRGGGPPGTLAETSQGGTLP

SEQ ID NO: 62185 - DNA, 653 bp, Zea mays
  misc_feature: Ceres CLONE 1526766
  misc_feature: Encodes the peptide sequence at SEQ ID NO. 62186
  misc_feature (376)..(376): n is a, c, t, g, unknown, or other
  misc_feature (381)..(381): n is a, c, t, g, unknown, or other
  misc_feature (395)..(395): n is a, c, t, g, unknown, or other
ggtggcggccgctctagaactagtggatcccccgggctgcaggaattcgtctcacccctagaaaaaatcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacggncccancctacaacattgancatctggtcaagtctctcaaattcgtcaccaacaaacgcgcttacgggacgtacggcagggacgagggcacccccgttcggtgtcaaggtggatgacaacggccaacgtcgctggcttctttggccgctcctggagatggcctggaacccatcgggctctacgtgaacccccactaataacttaaacgaagggatcggatcttctgcatgcctgcaaatgccgaatggctggctgcttgcccggccctgaaaaaaaaa

SEQ ID NO: 62186 - protein, 125 aa, Zea mays
  misc_feature: Ceres CLONE 1526766
  misc_feature (15)..(126): Pfam Name: Jacalin Pfam Description: Jacalin-like lectin domain
  misc_feature (88)..(88): Xaa is any aa, unknown, or other
  misc_feature (90)..(90): Xaa is any aa, unknown, or other
  misc_feature (94)..(94): Xaa is any aa, unknown, or other
MGKPAKIGEWGGYAGDRRDLRATPDRLIEVKVTADNSSCIRSISFIYIGADGKPYEEGPWGFGHAGTEYKIDLCRFDESLTEISGTTXPXYNIXHLVKSLKFVTNKRAYGTYGRDEGTPVRCQGG

SEQ ID NO: 62187 - DNA, 657 bp, Zea mays
  misc_feature: Ceres CLONE 1526768
  misc_feature (246)..(246): n is a, c, t, g, unknown, or other
tggcggccgctctagaactagtggatcccccgggctgcaggaattcgtctcacccctagaaaaaaactttgtatggtattcagtggataattggattcgtcacgttcttcttccctggtgctgcgccaaacgtgaagaagggtgttcttccttggcacgtactctttgggctctttgtctacatcttagcactggctaatgcagaactcggctttcttgagaagctcactttcctcgagagctcangtctcgacaaatatggcacagaggcattcttagtgaacttcacagcattggttgtcgtgttatttggtgcctctggtgtggtggctgctatagctccagttccgctttgaagaaacacaggggtatgatcccattccagaaaactagtgcaaatgaaatgtacagcgtatgcagtttgcaaagattgcctgttaaccacatgaaaataaaattattctttttccctttattgacggaaaaaaaaggtgatgggaattttccccaataaagatgtaaaaaccaaaagggggggggaaaaacattccggggaaccttcaaaaatttccatatttggaaaaatgaaaatccccggtttttttaaaaaaaaaaaaaaaggggcggcctgggggaccccttttccccccaagaggg

SEQ ID NO: 62188 - DNA, 641 bp, Zea mays
  misc_feature: Ceres CLONE 1526774
  misc_feature (288)..(288): n is a, c, t, g, unknown, or other
  misc_feature (313)..(313): n is a, c, t, g, unknown, or other
  misc_feature (339)..(339): n is a, c, t, g, unknown, or other
atagctggagctccccgcggtggcggccgctctagaactagtggatcccccgggctgcaggaattcgtctcacccctagaaaaagtcttctctccgcctcgcgcacccggttccgcgtgcctttccccacctactctcgcggctctcgccagccagtctagggtttcggtcccggcgtgcttatccgcccccgccggccatgtcgaagcaaggagggtaggccaagccgctgtaagcgccctaggccgacgagatagagtacgacgagacggatcttgcatatctgcngatgaagaaagatgaagaaaaagcnctgtaggagcctaaggccaaagcacnatttgggcgccatttgggggctccgggcccgaaaaaaaatggaaagaaatgagactgggccccccgcctccataaccagaagatgattaagcaacccgcctatccgtggtgcgcctcccctaagggtgaatgggaaaaaggggaccccctgtggtcttggggtcccccgaagtttaaattggggtgccttgatccaaagaaagtttctaaccccccccctcgctaacattgataacaaaaaggcgcccccgataaaaaaagatgaaaaaattcccggggaaaaaaaaaaaaaaaaaaaaaat

SEQ ID NO: 62189 - DNA, 670 bp, Zea mays
  misc_feature: Ceres CLONE 1526776
  misc_feature: Encodes the peptide sequence at SEQ ID NO. 62190
  misc_feature (293)..(293): n is a, c, t, g, unknown, or other
  misc_feature (299)..(299): n is a, c, t, g, unknown, or other
  misc_feature (379)..(379): n is a, c, t, g, unknown, or other
  misc_feature (395)..(395): n is a, c, t, g, unknown, or other
  misc_feature (398)..(398): n is a, c, t, g, unknown, or other
  misc_feature (489)..(489): n is a, c, t, g, unknown, or other
  misc_feature (533)..(533): n is a, c, t, g, unknown, or other
  misc_feature (666)..(666): n is a, c, t, g, unknown, or other
tggcggccgctctagaactagtggatcccccgggctgcaggaattcgtctcacccctagaaaaatccccctttctgctcctgtgctgcgtccaccagcctcgtcgttaggacgtaaggtaagacacccaggggcgagccagtgagtacagagagtagccttacgtagcgaagctcagagcaagcgagggtacggtcaaggggggtgatggcgctgtctcgacgcatggcggctcccgtcctcgtcctcatgctcctcctcgtcgccacaaacctggggacgaccaaggtggcngaggcnaagctcttgtctgtcgcaaagccaccggttcaagggcctgtgtttgacccccccccggggggaaagtatgggggaaaccnaaaactttccccggcnccnattggtacggcgaaaggcacccacccccaaggggcttcgggggggaggaaatgcctggaaataacccccggcttttgctgggagcaagccntgtcggcggggccggcgcgcgcaatgcaagcgatccataagggngcttcctccgcgcgggggggtggttctcgaaccccggtggtcccctttccgacccaatacggaggtgtgctgggcgcttgcctttttttccccgccagaaagagcgcccgggggggtgcgcggaggggtgttntggg

SEQ ID NO: 62190 - protein, 153 aa, Zea mays
  misc_feature: Ceres CLONE 1526776
  misc_feature (58)..(58): Xaa is any aa, unknown, or other
  misc_feature (95)..(95): Xaa is any aa, unknown, or other
MALSRRMAAPVLVLMLLLVATNLGTTKVAEAKLLSVAKPPVQGPVFDPPPGGKYGGNXKLSPAPIGTAKGTHPQGASGGRKCLEITPGFCWEQAXSAGPARAMQAIHKGASSARGGGSRTPVVPFPTQYGGVLGACLFFPARKSARGGARRGV

SEQ ID NO: 62191 - DNA, 565 bp, Zea mays
  misc_feature: Ceres CLONE 1526782
  misc_feature: Encodes the peptide sequence at SEQ ID NO. 62192
  misc_feature (487)..(487): n is a, c, t, g, unknown, or other
  misc_feature (502)..(502): n is a, c, t, g, unknown, or other
aaagctggagctccccgcggtggcggccgctctagaactagtggatcccccgggctgcaggaattcgtctcacccctagaaaaagtcgataaccaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaaggttcatgttgttttgttttggtggtcgagcatcgcatgttcctgctctggttcagatctggagaatttctagtcgtcgtcgtcgtcgtcgttcgttcggagcggatctgaagcgacgatngctggaagcggcggnatcccttggtctgcagtcctcttccactccatggatgatgccctgccctgataattattggat

SEQ ID NO: 62192 - protein, 35 aa, Zea mays
  misc_feature: Ceres CLONE 1526782
MLCRLRSDCWIRHLTGLNRARTGRKQQTRVGSCIG

SEQ ID NO: 62193 - DNA, 614 bp, Zea mays
  misc_feature: Ceres CLONE 1526788
  misc_feature: Encodes the peptide sequence at SEQ ID NO. 62194
  misc_feature (394)..(394): n is a, c, t, g, unknown, or other
  misc_feature (405)..(405): n is a, c, t, g, unknown, or other
atagctggagctccccgcggtggcggccgctctagaactagtggatcccccgggctgcaggaattcgtctcacccctagaaaaaaaatttcccaaacgcaaaaccgcatcctctcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttcccgctacgcttacaggagtacagggcgactancatgggagtantgcaatacttttgggagccatagataacgaggatcctggtcttttcgataaaattgtgtatgaaatttttcgtccgggttggtttctgaatgaacccttggaactgaataaaccttctggatacccgaatcctgagtaaaccttttaaaccctggagggatcaccccatcctcgaaaaggaattttccctatttttggttgtccccgtg

SEQ ID NO: 62194 - protein, 90 aa, Zea mays
  misc_feature: Ceres CLONE 1526788
  misc_feature (10)..(66): Pfam Name: SecE Pfam Description: SecE/Sec61-gamma subunits of protein translocation complex
  misc_feature (79)..(79): Xaa is any aa, unknown, or other
  misc_feature (82)..(82): Xaa is any aa, unknown, or other
MDAIDSVVDPLRDFAKDSVRLVKRCHKPDRKEFTKVAARTAIGFVVMGFVGFFVKLIFIPINNIIVGSRYAYRSTGRLXWEXCNTFGSHR

SEQ ID NO: 62195 - DNA, 646 bp, Zea mays
  misc_feature: Ceres CLONE 1526793
  misc_feature: Translation starting site: 258
  misc_feature (391)..(391): n is a, c, t, g, unknown, or other
  misc_feature (612)..(612): n is a, c, t, g, unknown, or other
cgcggtggcggccgctctagaactagtggatcccccgggctgcaggaattcgtctcacccctagaaaaaagccgcatcccttcgtttcttcgccgccgtgcgcctgctctctgctgccgtcaacatggggataatgcctgcgatatgctatcgccagatcacgaacaagccatgaccccaagtccaggtactgccgtggtgtccctcgaccccaagatcaggatctactgatgtttgcatgacaagaaagggtgttgatgagttcccctactgtgtgcaccttgtctcttggcagaaggagaatgtctccagtgaggctcttgaggctgcccatattgcctgcaacatctacaatgacccattctgttcgaaaggatgccttccatcttgnggtccgggttcaccccttccatgtccttcatatcaacaagatgctttcgtgtgtctgggctgatacgctactgactggaatgaccgctgcctttagcaaggctcaagccacctgtgctagggtggacattgatcgtgtcatcttttctgctcgatgcaaggacagcatgctgcacatgctagtgtaagtctgcgtcgcgacaaattcagattccctgccgnccatagatgattgagagcagaaagtgcgcttcac

SEQ ID NO: 62196 - DNA, 413 bp, Zea mays
  misc_feature: Ceres CLONE 1526798
  misc_feature: Encodes the peptide sequence at SEQ ID NO. 62197
  misc_feature (213)..(213): n is a, c, t, g, unknown, or other
ctgggagcctccaccgacggtggcggccgctctagaactagtggatcccccgggctgcaggaattcgtctcacccctagaaaaatccatcacagctagctagcatacagacgaataatctcttcttcacctcactaacaccagctagcaactctttctctcctgcaataatggccgctcgctcctcctcctcccagccgcagctggtcgcggncggctgcggtcctggcagcggcgcttgctgctgctggcgcggggcgggaacgctcgcgcgtgaactcgctaggactctcgtggccctgctgtaccatggaacggggtcccctccgggtggtaaaagggtggcccctaaacccccgtctcgggggaaacgggggccccggaaggcccaaaaaaataaaggcccgcccccgg

SEQ ID NO: 62197 - protein, 81 aa, Zea mays
  misc_feature: Ceres CLONE 1526798
  misc_feature (15)..(15): Xaa is any aa, unknown, or other
MAARSSSSQPQLVAXGCGPGSGACCCWRGAGTLARELARTLVALLYHGTGSPPGGKRVAPKPPSRGKRGPRKAQKNKGPPP

SEQ ID NO: 62198 - DNA, 739 bp, Zea mays
  misc_feature: Ceres CLONE 1526808
  misc_feature: Encodes the peptide sequence at SEQ ID NO. 62199
  misc_feature (400)..(400): n is a, c, t, g, unknown, or other
  misc_feature (411)..(411): n is a, c, t, g, unknown, or other
  misc_feature (736)..(736): n is a, c, t, g, unknown, or other
  misc_feature (739)..(739): n is a, c, t, g, unknown, or other
tccccgcggtggcggccgctctagaactagtggatcccccgggctgcaggaattcgtctcacccctagaaaaacccgcttcccccagccgcacgaaaccctaacgccgccgccgcttcacaggtaagccgccgtcatggtctccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtccggtggactcgtacgccagaagatgaagtacctccgctttctccgcaaggggatgaacaccaagccatttttttgccccccccccctggggacagccgggggggaaaatccttttttcncaaccatcccncttggattatttcctcaaaaaaaccaattaaggggggaaggcggctccttggcaattttcaaaaacttatctaagggggttccccgcccgccgtataaaaaataaacaaagggccctggtgctttccccgggaatctcttttaaagtgcccaagagcggtccaaccccaggaaacactataaaagccactacccttgggaagaacactttttaaattgatgctctccaacctcaaccctccctctcgaaaccccactcgatcgagtcgttctcagctcccagccgggcatcatatatcacaggtctcatgtgttgggctattatnggn

SEQ ID NO: 62199 - protein, 126 aa, Zea mays
  misc_feature: Ceres CLONE 1526808
  misc_feature (11)..(126): Pfam Name: Ribosomal_L13 Pfam Description: Ribosomal protein L13
  misc_feature (89)..(89): Xaa is any aa, unknown, or other
MVSGSGVCAKRIVVDARHHMLGRLSSIIAKELLNGQKVVVVRCEEICMSGGLVRQKMKYLRFLRKGMNTKPFFCPPPLGTAGGENPFFXTIPLGLFPQKNQLRGEGGSLAIFKNLSKGVPRPPYKK

SEQ ID NO: 62200 - DNA, 848 bp, Zea mays
  misc_feature: Ceres CLONE 1526810
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
nnnnnnnnnnnnnnnnggggttttcctttcccnttnnnnannccttatnnnnaagcgagctggactccccgcggtggcggccgctctagaactagtggatcccccgggctgcaggaattcgtctcacccctagaaaaaataggggccatcaaatccaagaagagggaagagcaccaaggaccttcggcgcccgttcaggatccacatcttcccgagcgagttcttggttgacctcttcctcttcggaccaccggcgaggctcttggtgtaccttgcctctctcaccaatcaaggtgtcatgtctgatctcgaaattacagatcccagctgctcttcgatcccttccctgaggccaatggtgggggacgctggggcgcgaagaaggggtaaaagggactatgtacgccgtgtgacatcaagtatggttaacggcccccaaggaggggggggggggggggcgaagtcattttgaaaaaaggcaagcccggagtaagaggagtggaccccatgatgatacccctccacaaaagaaaccaacaaaaaaacacagagggaaacaaatggcgggccccgggagcgtcatgaacactctggtcccccggggagacaagaaaggccgcaaagttgttcgggaatggaaagacaggcatatgggtcccccaccaaccgcaaaaccagcagccacacgccctatgattagtttttatacgctgcggggtctggcgcgacgggagagtcgtggagagaaggggagggaagcgcccggcccgaaggcaatcacacggacaagtgtctaggccttatggcggggggagcccagtcgatacgacctctctgggggcaaaaga

SEQ ID NO: 62201 - DNA, 625 bp, Zea mays
  misc_feature: Ceres CLONE 1526811
  misc_feature: Encodes the peptide sequence at SEQ ID NO. 62202
ctccccgcggtggcggccgctctagaactagtggatcccccgggctgcaggaattcgtctcacccctagaaaaagtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgcggctacggaggcggtggcggctactgcggtcggcgcgagggtggtggtggcggctacagcggcggcggcggcggctggagggactgatgtgtgggcccatcctggccttgggccgagttatcttatctatctattagatcgggttcccgttcgcttctggtcccgtgtttagtgccggttctaacctttggattaaggggtg

SEQ ID NO: 62202 - protein, 115 aa, Zea mays
  misc_feature: Ceres CLONE 1526811
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGYGGGGGYCGRREGGGGGYSGGGGGWRD

SEQ ID NO: 62203 - DNA, 644 bp, Zea mays
  misc_feature: Ceres CLONE 1526815
  misc_feature: Encodes the peptide sequence at SEQ ID NO. 62204
  misc_feature (581)..(581): n is a, c, t, g, unknown, or other
caaaactggagctccccgcggtggcggccgctctagaactagtggatcccccgggctgcaggaattcgtctcacccctagaaaaaagcgctttcctgtccgactcccagccgtcgtctgctgcgtactccgcctccagtttggtctgtttcttgcaagttgctcttgcggtagttcccccaactgtcaccatgcagaacgaggagggtaagactgtggacctctatgttcccaggaagtgctcggccacaaacaggatcatcactgccaaggaccatgcctctgtccagatcaacattggccacttggatgcgaatggcctgtatgatggtcacttcacaacatttgctctctctgggtttgtccgtgctcagggcgatgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatctttgttgggttccttctgaattttgatgtngggggttcgtttaattcccttgtacaaccccctttaagatcattggggatgattttgggatcc

SEQ ID NO: 62204 - protein, 81 aa, Zea mays; identical to SEQ ID NO: 6959
  misc_feature: Ceres CLONE 1526815
  misc_feature (1)..(81): Pfam Name: Ribosomal_S21e Pfam Description: Ribosomal protein S21e

SEQ ID NO: 62205 - DNA, 629 bp, Zea mays
  misc_feature: Ceres CLONE 1526816
  misc_feature: Encodes the peptide sequence at SEQ ID NO. 62206
  misc_feature (526)..(526): n is a, c, t, g, unknown, or other
  misc_feature (527)..(527): n is a, c, t, g, unknown, or other
  misc_feature (537)..(537): n is a, c, t, g, unknown, or other
  misc_feature (540)..(540): n is a, c, t, g, unknown, or other
  misc_feature (548)..(548): n is a, c, t, g, unknown, or other
  misc_feature (571)..(571): n is a, c, t, g, unknown, or other
aaagctggagctccccgcggtggcggccgctctagaactagtggatcccccgggctgcaggaattcgtctcacccctagaaaaagtcgcacccaccaacacgagagatgagctccggcggcgcggacaagcccggcagtggcggcggcgcggtgaagacgccgtcggacttcctcaagtccatcaggggccgccccgtagtcgtaaagctcaactccggcgtcgactacagaggtatattggcttgtctggatggttatatgaacatcgcaatggagcagaccgaggagtacgtgaatggccagttgaagaacaagtatggcgatgccttcataaggggcaacaacgttctgtacatcagcacgacgaaccggacccttgccgatggcgcgtagccggattggattccctctgtcctcctcccgtgtgtgtgccgtgcaacttcaaagccgttagcttcggttgcgctctgactctgatgcatcccttcaaatctctgtaccccctgcggaaaaggaatttgggcnncatactcctnctnctcccccncaccttttgcgccacaccgccgncccctcactccttcttcccccacgacaccccctccccgtcctgtgccggcccggaaac

SEQ ID NO: 62206 - protein, 95 aa, Zea mays
  misc_feature: Ceres CLONE 1526816
  misc_feature (21)..(86): Pfam Name: LSM Pfam Description: LSM domain
MSSGGADKPGSGGGAVKTPSDFLKSIRGRPVVVKLNSGVDYRGILACLDGYMNIAMEQTEEYVNGQLKNKYGDAFIRGNNVLYISTTNRTLADGA

SEQ ID NO: 62207 - DNA, 678 bp, Zea mays
  misc_feature: Ceres CLONE 1526817
  misc_feature: Encodes the peptide sequence at SEQ ID NO. 62208
  misc_feature (440)..(440): n is a, c, t, g, unknown, or other
  misc_feature (446)..(446): n is a, c, t, g, unknown, or other
gaaagctggagctcaccgcggtggcggccgcctctagaactagtggatccccccgggctgcaggaattcgtctcacccctagaaaaactcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatgatctcagttgaagggtcttcagaagctgcaaagggcaagtcccaagtgaagttcagtgtgaagaaaaactcaagaatacngataangagatttaagggcaaaggcaggaagaaagccaaaaattcaaaaccccctggccaggagaaaagttgatgccatggtaaaatgacagttgatgccatgggacccttgaccgaaaagaactacatacctcccctttgtatgtttttctcaaaaattttggcaccatggaaccgaacctccccccgaaaactggggcgcgtggtcttctttgaatccttcctggcctaaaaggtt

SEQ ID NO: 62208 - protein, 124 aa, Zea mays
  misc_feature: Ceres CLONE 1526817
  misc_feature (101)..(101): Xaa is any aa, unknown, or other
  misc_feature (103)..(103): Xaa is any aa, unknown, or other
MAKYNVVQKNKRQCNQDRKRAAHGEPGTGKLKQRTAPVSMSGKRKKKLERRLNRKQKEAAMIKALENNMGDVDMISVEGSSEAAKGKSQVKFSVKKNSRIXIXRFKGKGRKKAKNSKPPGQEKS

SEQ ID NO: 62209 - DNA, 666 bp, Zea mays
  misc_feature: Ceres CLONE 1526824
  misc_feature: Encodes the peptide sequence at SEQ ID NO. 62210
  misc_feature (392)..(392): n is a, c, t, g, unknown, or other
  misc_feature (398)..(398): n is a, c, t, g, unknown, or other
aaagctggagctccccgcggtggcggccgctctagaactagtggatcccccgggctgcaggaattcgtctcacccctagaaaaactctctctctccactggctgacgccgcgaccgccccaacccaactgcccttttcggagatctcgccgcctccgccgtcgacttccgtcgcccccctatcccgcgtccgggcttacccgatggcacggctgcactggcttgaggccgtcctgccgctggggatcatcggcggcatgctctgcatcatgggcaacgcccagtatttcatccacaaggccgcgcacgggaggccgaagcacttcgggaacgatatgtgggacgtcgccatggagcttcgcccccccccccccggggaggggggggtccggntactanggtattgatccaccttaaacttttctgggagttgacgaacccccttccaaggacagaaggactgctctttttgttcccgggccaattggaaccaaaacttggttggttctgctttaaatatcaacaagttcggaaaaaaacctgtttccggcatcctgttttaattggaacaaagcccaatgactttgggtcagtggggtatgtgccaagtattttcccgcccaccggaaagctaatttccggaagaccccgcagcgaaacctctcgg

SEQ ID NO: 62210 - protein, 67 aa, Zea mays
  misc_feature: Ceres CLONE 1526824
  misc_feature (64)..(64): Xaa is any aa, unknown, or other
  misc_feature (66)..(66): Xaa is any aa, unknown, or other
MARLHWLEAVLPLGIIGGMLCIMGNAQYFIHKAAHGRPKHFGNDMWDVAMELRPPPPGEGGVRXLXY

SEQ ID NO: 62211 - DNA, 566 bp, Zea mays
  misc_feature: Ceres CLONE 1526828
  misc_feature: Encodes the peptide sequence at SEQ ID NO. 62212
  misc_feature (456)..(456): n is a, c, t, g, unknown, or other
ggagctccccgcggtggcggccgctctagaactagtggatcccccgggctgcaggaattcgtctcacccctagaaaaaagcgctgcgaacctcgagtcatcgacaagtcctcaaatcgtacgaattcttcccccctctccgatctcgacgcgcaccgatgcgggcgatgtcgtccgcggttaaatggtatgctgcgggcacagctgcgcggggcaccccgcgttcgcggctgcggacgaaagggggccgggcggctgcaccaccccacgtcacgaggagagccccaaggggtatctcttcacgcggccgccgccgtctccgggagaatctcgcacgtgagaagattggaagctgtcatgctacatgacctctttcatcacctccttcgtgctaggcgtcaggctcacgcacagctctaccttacaatccatacgtggtctcaccagaaggggatgnagcgcatccactacctaggaggtcgtctctgacgacacccagtgcgagtgatcggcgcgtctcaggtcatcttgagctcccagctgcctctgattgggtgcaaaaaaaag

SEQ ID NO: 62212 - protein, 51 aa, Zea mays
  misc_feature: Ceres CLONE 1526828
MVCCGHSCAGHPAFAAADERGPGGCTTPRHEESPKGYLFTRPPPSPGESRT

SEQ ID NO: 62213 - DNA, 838 bp, Zea mays
  misc_feature: Ceres CLONE 1526831-R2
  misc_feature (19)..(19): n is a, c, t, g, unknown, or other
  misc_feature (635)..(635): n is a, c, t, g, unknown, or other
gggtcctcgagcgtctcgnttttttttttttttttgagttgtgcagcaccatgaattgccattttttccggtagattaaccttaaattgatggtggatggggtaacaacttccatcgatccttcactccaagccgtttgtatagcatgggtctgctgaaaccgaggatgaacacagcacttatcgactgacccagagcgtaccttagcttcaataactcagatgggcaacgtccttcactacactaactaagataaacactctggactaggggaaactctcacggtagaaaacacgataacttggccgcgcgagcccctccgctcaattcctccagttcccgtcggagttgaaatatgcgccgcctacggtctgccaccgttgtagacgcgtccaccacggccagtgccgcttccgactcggtatccgacaactccgccttagccgaattcgccatcaacgaatcagccactctcatatccgcctcctacacagcaaccattgtaacgtctgcctccaacaacatcgccgccagcagattgcgctctttaactgcgatgcctcagccttcacgcctcgtagccctgctggactagatggtggtcactgtagtctcctcccggtgagatcgtgacnaagcgtaagctgcgtggactcggggtctcctcaaatgagatcatcgtggactcgaggacttcagacttagtgctctacgagtcttgtgaaggactggtttgcccatgcccatttttcaaggggaaagacaaatcctttaaggcgaggggatccgttggtcttaaacgccaaacccccggtgtggaacctcccgatcttttgcc

SEQ ID NO: 62214 - DNA, 970 bp, Zea mays
  misc_feature: Ceres CLONE 1526831-R
gggcccgtgggggcgcggcgggttcttaccatcttatttggccggggtgacagcatccatctatccgctatcactgctgtgtaatgcatgtgtctgctgaaacctaggactgatgctgcactcaccactgacgctgatcgaccttgctatcgacatcgcagatgggcaacgtccaacaccactcgaacgatgatcataccctctggactatggtatgttgcacggtagcgaattggataacttggccgcgcgggccccaacgctcagttcctcctgttcccgtaggagttgccgtatccgctcgcgcacggttgccaccgcgcgtatccgcacgccactgctaccgttagcgcgccgcccccaccgtagtcggcgccagatacgtatgcgcctccgtacattacggcgccacacaccggcgtagctgacacctccacggtacagatcagtaccctgcggaggcctggcttcaaagaaggtccggggaaagggggttccgtgcaattgtggagttcgcggggcctcccatattacatgccttgtaagggcctgcctagagggagtagcgcgggcccctgcatccttggggaagggggaaggtattggcccaagcccgtggagcagctcttgccgtttaggggacttccggcgaaagaagagggggaccgggaggggagccgcgccgccaaggggaccttaagggggcttatcgaaaagggaggggggcctctggcgcttgccctgtggttcttagggggtggggtagaaattgcgtcgcgggcgctagggggggaaacccgcgttcggggtggcgacgggcttccctcccgtagagttgggctgctaccacttgccatcggtgcccccgtggtgcgagggtgtttattggcgtctgcgcggccccgttttcacatgcggtcttcaacagtgtccgctcgtattcggtagttcggtgactgcgtcgtgcatt

SEQ ID NO: 62215 - DNA, 655 bp, Zea mays
  misc_feature: Ceres CLONE 1526831
  misc_feature: Encodes the peptide sequence at SEQ ID NO. 62216
tccccgcggtggcggccgctctagaactagtggatcccccgggctgcaggaattcgtctcacccctagaaaaaagcctacaaagaaacacgaccatacagctctgatagactgatactcacgaggcatggccatcctggatgccctcaggttcgcacagtctcaacccgccctcgtcggggtcgcgccacttgtcacgtcaccatataatgctgaacgctcctccgtgcacttccgcctcgcaaatggaggggccgccgatctcgtcgacgactcgctcctcgccgccgaccccgccatgcctttcattggaggacgaccgtaccggaagcaggtgacgctacggcaggacctcaccccctaatacttctgtgggctaacgctcttcaagcaagaattcaggacgtctatactgacggagggggaacttcaaaggcacgaaacctgctacgctcgagcttcttccatgcactactcacgagcgctgatctactctgacgctgatctcagaggcgctgatttgtcccttgcgcaatttagaatgtaaacctaatcaaaggctattttttaaggggaatttgccactgggaaaacctcttttaaaggttgccaacataagtggggcaaaattttacgaaagggccgttgccaaaata

SEQ ID NO: 62216 - protein, 78 aa, Zea mays
  misc_feature: Ceres CLONE 1526831
MAILDALRFAQSQPALVGVAPLVTSPYNAERSSVHFRLANGGAADLVDDSLLAADPAMPFIGGRPYRKQVTLRQDLTP

SEQ ID NO: 62217 - DNA, 835 bp, Zea mays
  misc_feature: Ceres CLONE 1526834
  misc_feature: Encodes the peptide sequence at SEQ ID NO. 62218
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
nnnnnnnnnnnnnnnnnnnttttttttttttnntttntttcgacccaccaaaagctggagctccaccgcggtggcggccgctctagaactagtggatcccccgggctgcaggaattcgtctcacccctagaaaaacccgagccgccaaaaccctaccgccgccgcgaatcccgcacgaccccaaccatgaccgtgctgagccgccctaccccgggcacggcccagtgcttcgggcggaagaagaccgacgtcgcggtcgcgtacacgaagccggggcgcggcctgatcaaggtgaacggggtcccgattgagctgatgcgaaccggaaggggcttccgcgtccagggccttttagcccatcctgattggcgggtccggtccccggttccaggggaacaacaaacatggcagaatccgccggcccgcgggggcggggaagaaaggccgaagaattcttaccccttccgtctcgggcccagatcagcccaaggggcctcgtttcgccttatgttacaagaaaagctacagttcccaccaaaagcccggccctaagaaaggggaagaatttaagggggaatttcctttttctcccggcctaccaaattgaccaaccccctaccttccggtcggctggaaacccgccagggaggtttgcagaacaccataaaaaaatattccggccgggaaccgggcggggccccgcccccccggggctccccagaagtttcattacccgctttaaacccacgctatccttgcgtcccaagttagaagtttttcaaaaaatccttttatttgggtgaatccttggggttgatatatgacgaagaaagaa

SEQ ID NO: 62218 - protein, 121 aa, Zea mays
  misc_feature: Ceres CLONE 1526834
MTVLSRPTPGTAQCFGRKKTDVAVAYTKPGRGLIKVNGVPIELMRTGRGFRVQGLLAHPDWRVRSPVPGEQQTWQNPPARGGGEERPKNSYPFRLGPRSAQGASFRLMLQEKLQFPPKARP

SEQ ID NO: 62219 - DNA, 842 bp, Zea mays
  misc_feature: Ceres CLONE 1526835
  misc_feature: Encodes the peptide sequence at SEQ ID NO. 62220
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
nntttttnnnnnnnnnnnnnnnnnttttnnnnnnnnnntgnnnnnnnnnnnnnnnttaacctgggatcgatcgaggtggcggccgctctagaactagtggatcccccgggctgcaggaattcgtctcacccctagaaaaacacccggcagtcacacctcgaaagcaacagcaagtcagcaacctacctagctagagctatcactatatcagtatcaggtacctagacctagcagcagccacacccacaccgtacgtcggcatggctaggtggtcgtcgtcagatctggtcgccgtcctcgtggtcctggccgcggcggtggcgtgctccgcggggggccccgtccccgcgcatcagcagcaggcgggagaggacgtgaatcggccggacacgctgcactagggggacggtgctgatctcgggggatggggaggctacgaagatcgggaggccaactaaatcccgggaacatctggggggctgggaccaacagggatccaccacccagcccacccaacggaccagattgccttcccccgagtgaccaaaacaaacaaccctggggaagcgccccaaacccctcggggcttgtccaaaggtacaccccacaacccccatttaaatgaatatggggcggcgcggcccccttcccacttggaaataactgttaccaccccccccttaggccaaaaagaggggcaccctataccgcccaaatcaaggaacaaggacaggggaggccgccaccgatcacggcaccaggaaccacaaaataaaaaatataacaaagatgaggcgaagcgcaggcgaagggagggagcgagaattaaacccaaagcagag

SEQ ID NO: 62220 - protein, 46 aa, Zea mays
  misc_feature: Ceres CLONE 1526835
MARWSSSDLVAVLVVLAAAVACSAGGPVPAHQQQAGEDVNRPDTLH

SEQ ID NO: 62221 - DNA, 653 bp, Zea mays
  misc_feature: Ceres CLONE 1526837
  misc_feature: Encodes the peptide sequence at SEQ ID NO. 62222
  misc_feature (498)..(498): n is a, c, t, g, unknown, or other
  misc_feature (611)..(611): n is a, c, t, g, unknown, or other
aagctggagctccccgcggtggcggccgctctagaactagtggatcccccgggctgcaggaattcgtctcacccctagaaaaaaaatcagacattgcttccctccggacaaaatgagatcagcggcaccaccgtgccaacttcccagcccaaaccccgacgcgtccccacctccgtcgccgatgacaccgcgtgccccgcagcttcggcatcacccgccgcacctcctcctcgccgaggctgtcgcctcctggcaccccttccacaagaagccctgtctcacggaccgctccacggctcccccctcctcggcccgcctccctgatgcggagactccgacgcctgccctctcggggggcggtagcggcggatccttccggtggttcgggctccgcaagcggcgccgccgcggtccgggctcgcggtccgtgtccggccgcagcagcgaccgccggagatccggcacgtgctccgacttccatttcacgtgcggcgcccngtgggtggtggcggcggcggcgccactgactccagcggggagatgtgggcgtcggatggtcgggaagtgcggatgaagaaccgtgccgatgggcgacgggagtcggcccgtcncctgtttgttgggggtggtgtctggaaaatgggtgggggtcc

SEQ ID NO: 62222 - protein, 37 aa, Zea mays
  misc_feature: Ceres CLONE 1526837
  misc_feature (24)..(24): Xaa is any aa, unknown, or other
MWASDGREVRMKNRADGRRESARXLFVGGGVWKMGGG

SEQ ID NO: 62223 - DNA, 654 bp, Zea mays
  misc_feature: Ceres CLONE 1526839
  misc_feature: Encodes the peptide sequence at SEQ ID NO. 62224
ctccccgcggtggcggccgctctagaactagtggatcccccgggctgcaggaattcgtctcacccctagaaaaaaccagcctcattgcctcaaccccaaaccaatccgtcgcagacactcaaggtcgcaggatgccgccgccgcgtgagcaccaccagccccaggacgaagaggacgacgataccgcaggcgttgtcaagctcatcagcgccgagggcttcgaattcgttgttgacaggaaggccgccatggtctccaacaccctccgcaacatgctcacatccccaggcggcttctctgagacgcgccagggcgaggtccgcttcccagagatccccaccaacatcctcgagaagatctgccagtatttctattggtcgctccattactccagtgggaaggagacagcggagtttccaatcgaaccggagataaccctggagcttatgatggccgcaaactatctggacacttgatgaggagcctgagggatttgatctgatctgatccgatccagtgtggtctggcacaatgtaatgtaaaggtgggagggaagcagaaaccaaggaatacattttgcaatctacagtgtgtgctactatcaactcttggtagtgttttgttgtctcctgggaggccgtgactgctgctgct

SEQ ID NO: 62224 - protein, 114 aa, Zea mays
  misc_feature: Ceres CLONE 1526839
  misc_feature (20)..(82): Pfam Name: Skp1_POZ Pfam Description: Skp1 family, tetramerisation domain
MPPPREHHQPQDEEDDDTAGVVKLISAEGFEFVVDRKAAMVSNTLRNMLTSPGGFSETRQGEVRFPEIPTNILEKICQYFYWSLHYSSGKETAEFPIEPEITLELMMAANYLDT

SEQ ID NO: 62225 - DNA, 676 bp, Zea mays
  misc_feature: Ceres CLONE 1526846
  misc_feature: Encodes the peptide sequence at SEQ ID NO. 62226
ctccccgcggtggcggccgctctagaactagtggatcccccgggctgcaggaattcgtctcacccctagaaaaaaaaaagccgccgccgccgcctccgccacctgtcccagcgcgccgccgccgcagccaccatgggtcgcgtccgcaccatgaccgtgaataagacctccaggcaggtgatcgagaagtactactcccgcatgaccctcgacttccacaccaacaagaaggtgctcgaggaagtctcgattctgccctcgaaacgactccgcaacaagggggctggcttctgtacccacctgatgcgccgcatccaccgaggcccactccgcggcatctccctcaagctgcccgacgaggagcgcgagcgccgcatggacttcatgccggagaagtcctcgctctaggtcgaacagatccgcgtcgacaaggagaccatggagatgctcgctgccctcgacatggcccacctgcccggcgttgagcgctcggatgaggtctccagagcccccgcctacagtcgcacgcagtacggtggtccccgccgtgaccgcgcttacacttcacggcggttgcctcttgatctcactgctattcgtagatgatgacctactatgcgaaacttctcttacatctttggttgcatctgtggaggctaagttctgaacttgcctg

SEQ ID NO: 62226 - protein, 91 aa, Zea mays
  misc_feature: Ceres CLONE 1526846
  misc_feature (1)..(92): Pfam Name: Ribosomal_S17e Pfam Description: Ribosomal S17
MGRVRTMTVNKTSRQVIEKYYSRMTLDFHTNKKVLEEVSILPSKRLRNKGAGFCTHLMRRIHRGPLRGISLKLPDEERERRMDFMPEKSSL

SEQ ID NO: 62227 - DNA, 668 bp, Zea mays
  misc_feature: Ceres CLONE 1526848
  misc_feature: Encodes the peptide sequence at SEQ ID NO. 62228
ggagctccccgcggtggcggccgctctagaactagtggatcccccgggctgcaggaattcgtctcacccctagaaaaagtttatctcttcttccactgcctcccaaccacttcgtcctcgccggctcgcaactccttgatggcggccacggcgagtctcactaccactgctccctcccctccagctctcctcaaagcatcagctcctttgcttatctcctttcgccccgtctcccgccactgcaagaacctgtgcatcaagaccaaggccacagaaaatgatcagtctgctaaaaagcatcagaaggtgaagagcattctttgccaggactgcgaaggaaatggggcaatcacatgcaccaaatgtgaaggaaatggggtaaattctgttgactattttgaaggccgatttaaagctggatctttatgctggttgtgcagaggcaagcgtgaaatcctatgtgggaactgtaatggtgctggcttcttgggtggatttctgagcactttcgatgaaactgcgcaatagtcatcggtttaatttatgtttaagttacattgagggacccattatatatgtatcgtgttccagggacacataatcatattatataaaataatatttttaatgaatactcctttcgtccaaaaaaaaaaaaaaaaacgaga

SEQ ID NO: 62228 - protein, 129 aa, Zea mays; identical to SEQ ID NO: 52207
  misc_feature: Ceres CLONE 1526848

SEQ ID NO: 62229 - DNA, 667 bp, Zea mays
  misc_feature: Ceres CLONE 1526849
  misc_feature: Encodes the peptide sequence at SEQ ID NO. 62230
agctccccgcggtggcggccgctctagaactagtggatcccccgggctgcaggaattcgtctcacccctagaaaaatctttcttcgcctgctggatctctcgtcatccgttcctcgtcctctccggcattctaggatagttattcgccgggggcggcctagaaatcagccgtcagagtgaaccgggaggggtggttgcctgaggaggaagacatgatcgcgcgagccaagctggtggagcagctgcgggagcaccagatccggacggtccattcctactccgccgcgctcgccgtcttctcgcccaacccccacatcgcctccaggagagatctcaaggttgctgtcatctatgcgggcctgttttgctttctcatggagtcctgctatgccgccctttacttgaaatggttcagactttcagccatgtttgtaaccttcgggatcctccttccagtgagactcaaaatctctaggcatataaggctgaagaggaaaagagaaaggagactgttgttgccactgtccatgagaatacattttttttgatacaccctgtaacattctattggagatggcccgctacagaagatagggaaatcctcggcagaggaactcatctttactgccccagcctacgctatggaaaatgttgtatgcatcacaaa

SEQ ID NO: 62230 - protein, 111 aa, Zea mays
  misc_feature: Ceres CLONE 1526849
MIARAKLVEQLREHQIRTVHSYSAALAVFSPNPHIASRRDLKVAVIYAGLFCFLMESCYAALYLKWFRLSAMFVTFGILLPVRLKISRHIRLKRKRERRLLLPLSMRIHFF

SEQ ID NO: 62231 - DNA, 680 bp, Zea mays
  misc_feature: Ceres CLONE 1526851
  misc_feature: Encodes the peptide sequence at SEQ ID NO. 62232
  misc_feature (583)..(583): n is a, c, t, g, unknown, or other
aaactggagctccccgcggtggcggccgctctagaactagtggatcccccgggctgcaggaattcgtctcacccctagaaaaaatccattgctcccaccagttgatacatgtcttgtgacttgtgaagtgtgttcctatctgcatcaccttccttcgccttgcaaccctttggctagttcattcatacgaatggattattctaatttgcgtcgccaagctgcatccatgaaaaagactctctttgatcaggggtacctagatgagcaattttgccaggtggaagacttgcaggatgaagctagtcctaatttcgcggaagaggttgtcactttgtttttcaaggactcggccaggctaatatcaaatgctgaacaggctctggaaaaataccccaaagatttcaatagatgggatgcatacatgcagcagctaaaaggcagctgttccagcattggtgcttcaaggatgaagagtgagtgcgtgtcattccgggattactgcggacaggaaaatgttgaaggttgtatgagattcttcccacaaagtgaagagggagcacggtgccctgaggcaaaaactaanaggcctatttccaggctgctaccacaagctgggtcctgctgtgaactgccccccaggccctggatgtaagaacttaggaatttccaggaaaactgaa

SEQ ID NO: 62232 - protein, 153 aa, Zea mays
  misc_feature: Ceres CLONE 1526851
  misc_feature (131)..(131): Xaa is any aa, unknown, or other
MDYSNLRRQAASMKKTLFDQGYLDEQFCQVEDLQDEASPNFAEEVVTLFFKDSARLISNAEQALEKYPKDFNRWDAYMQQLKGSCSSIGASRMKSECVSFRDYCGQENVEGCMRFFPQSEEGARCPEAKTXRPISRLLPQAGSCCELPPRPWM

SEQ ID NO: 62233 - DNA, 708 bp, Zea mays
  misc_feature: Ceres CLONE 1526854
  misc_feature: Encodes the peptide sequence at SEQ ID NO. 62234
  misc_feature (189)..(189): n is a, c, t, g, unknown, or other
tggagctccccgcggtggcggccgctctagaactagtggatcccccgggctgcaggaattcgtctcacccctagaaaaagccgcccttctcttcatcttcactctcctggtttattcctccgtgccgatctcctcttctccggcgggaccatggcgccgtcctccctccgattcgacgatccggcggcnggtgagcggcccccgcagcatgaacggaaagccgcgtatatgttgcttctcccggtcgtttacgcccccgttcctcccccttcataaggatcgggctgtgggacaatcccctgggggagggaacgctctttttaaggggcctcggcggggcaattccccccgggggcttcctcttaattaaaattttttaatgtggaaaaccaaaagaaggggattccctcccaggaggaagggggaaaaattttttgggggcaaaaattttttttcctctgggatttcaaaatttggaggaaaaagagcactgggggatttcaacaaaataagggggggtggttcccccacgtgtttttttgggggggggcgaataaaattttgtccaaagaggggaaggggggtggcaaaaaaaaagaattttccgcttggggaaaaaaaaaaaaaaaaaaaaaaaaaggggggcccgcggggggccccccttcttccctcccctggggggggggttttatttcccccgcccccgcg

SEQ ID NO: 62234 - protein, 41 aa, Zea mays
  misc_feature: Ceres CLONE 1526854
MAPSSLRFDDPAAGERPPQHERKAAYMLLLPVVYAPVPPPS

SEQ ID NO: 62235 - DNA, 691 bp, Zea mays
  misc_feature: Ceres CLONE 1526857
  misc_feature: Encodes the peptide sequence at SEQ ID NO. 62236
ggagctccccgcggtggcggccgctctagaactagtggatcccccgggctgcaggaattcgtctcacccctagaaaaagccgcacccccaagacttccgtccgaggctgagctcatctccgcgcgctgccgccgacgccgccgccgctcgacgcccactgcgcactcgtggcggaacagaccggagaaggcttttctcaagcagcctaatgtggtcctcagctcatggaactcgggctagggaaacaaaccggggccgggatggcaatcgatttatggaagagcattggccttggtttcaagactcccagggaagcaattgaacggacctacattgacaagaaatgtccattcactgcagccgtatctatcaaacgcataattattgctggaacctgccgcagagctgatatgaacagaaccatccttgttcacgtgaactacctccactttgttaatagataccagaggtctgaaaagaggcactccaacattccagctcacatctccccatgcttccgtgtgaaggaaggcgaccatgtcatcattggccagtgcaggcccctatcaaaaactgtgaggttcaatgtcgttaaagtcattccagctggatctgctgctgctggcaagaaggctttcaccgcagcctgagtttaaaactatgttcgatgagtagtttatagagtgatgtc

SEQ ID NO: 62236 - protein, 141 aa, Zea mays
  misc_feature: Ceres CLONE 1526857
  misc_feature (56)..(125): Pfam Name: Ribosomal_S17 Pfam Description: Ribosomal protein S17
MELGLGKQTGAGMAIDLWKSIGLGFKTPREAIERTYIDKKCPFTAAVSIKRIIIAGTCRRADMNRTILVHVNYLHFVNRYQRSEKRHSNIPAHISPCFRVKEGDHVIIGQCRPLSKTVRFNVVKVIPAGSAAAGKKAFTAA

SEQ ID NO: 62237 - DNA, 695 bp, Zea mays
  misc_feature: Ceres CLONE 1526861
  misc_feature: Encodes the peptide sequence at SEQ ID NO. 62238
aagctggagctccccgcggtggcggccgctctagaactagtggatcccccgggctgcaggaattcgtctcacccctagaaaaaaagtccacatccacgtcggcgtgctcccgagccctgaaccctgtccctgacccgttcacccgtccaaggcgagcagcggacaccctgaggagacgtcgcgcctgtgcctaccatggacgagaaggagttctggcgcatgctcgacctcttccccgtcggccgctcccgtggctattgcgctgatcctggaacatctatcataggaacctgacatcgctcactagtttccgacgcagcgaatggcaatgacaaggactcatccgacgcacaagatttgtttatgcaaaagttgacgatggctgcagagaagaaggtttgtatatgtattttccagtatcatgaagagccactcaatactctgattggaacagctgaagcagacttcttctgcgaggcatttgaagaacctcatgagaagcttgtttaccaacagctgaatttggatgctgctaataactttctgagcacatatgagagctgatgatgaactctatgtagatgctgctcaaggatcggcaggtgcctctgatcctccaaagttgttgatgctgtcgagattttgatcattgacaagcttgtgttgtgtgcacaccgtagacatccctttctggt

SEQ ID NO: 62238 - protein, 66 aa, Zea mays
  misc_feature: Ceres CLONE 1526861
MQKLTMAAEKKVCICIFQYHEEPLNTLIGTAEADFFCEAFEEPHEKLVYQQLNLDAANNFLSTYES

SEQ ID NO: 62239 - DNA, 691 bp, Zea mays
  misc_feature: Ceres CLONE 1526862
  misc_feature: Encodes the peptide sequence at SEQ ID NO. 62240
cagctggagctccccgcggtggcggccgctctagaactagtggatcccccgggctgcaggaattcgtctcacccctagaaaaaataccgcgcgtgagagctctacgtcgtttccgacggtgaagtcacgcggaggatagccatggccgccttactccaccaagcggctaccccgaccgcaaaaccaccccaccgcctatgggctctcatctccacacacagccgcctctcaccgctctctaaacgacggcgcgccccagccatccgctcggcggccacggacagcagcttcaactccggacagacgccgaccaagatgaccacccgcaaggagaagcaacaggatcgccggcggcaccaagacgtgcaggaacggaaacatcggctcctggggatggaatacccgcccctggcgaagcaagacggtggcggcagcatcggggaggttgacgactacgacaagcttccgcagcccgtgttcgaccgcatcctgcgcctgatcgcgttcacgtgggccttcccatggcatctggagtctcgctgctcaacgtgtaatacgcactcaagcgcgatcagggggtagtggggccatcatggttgcatttctgaacatccgcatcgacttcggcaaattgcgctggatatcgcccaacggaagctaacggctccctgggaccccgataacaaaggcc

SEQ ID NO: 62240 - protein, 88 aa, Zea mays
  misc_feature: Ceres CLONE 1526862
MTTRKEKQQDRRRHQDVQERKHRLLGMEYPPLAKQDGGGSIGEVDDYDKLPQPVFDRILRLIAFTWAFPWHLESRCSTCNTHSSAIRG

SEQ ID NO: 62241 - DNA, 681 bp, Zea mays
  misc_feature: Ceres CLONE 1526865
  misc_feature: Encodes the peptide sequence at SEQ ID NO. 62242
  misc_feature (399)..(399): n is a, c, t, g, unknown, or other
ggagctccccgcggtggcggccgctctagaactagtggatcccccgggctgcaggaattcgtctcacccctagaaaaaaccaagcacgagtgcagcaatggcgcatcccatgcctcccctctcagcatcacagagcacaatcaccaccgttctgaagatccttccaaaacctcctgctgctccggagagcagaagcaataattgtgcttttggggccaaattcgacagtaggagggcacttctatgcggcttggtcgctgctgctgctgctgctggcaccatgctgggcgctgacatcgctggtgctgcttcgaagaggcggcctccaccgccagcgccggcagaggcgaacaaagacccgaacgtcagcggagtgcaggctaaagtgcttgctagcangaacaggaaggaggccatgaaggaagctgtggccaagctgagggagaaaggtaagccggttgataagtgaaggccagaaccagtgacccttgatcaagaaatgtaacttattgttaaataatatactccctctattcttctaaagtaataagccattaatttgaatagtctactcactttatgtgtacagatgagaataaaaatacaactattttgcttgaaaagaagaaaaaacctggatgagatacaaaaaaaaaaacgagacgctcgaggtacccaatt

SEQ ID NO: 62242 - protein, 123 aa, Zea mays
  misc_feature: Ceres CLONE 1526865
  misc_feature (101)..(101): Xaa is any aa, unknown, or other
MAHPMPPLSASQSTITTVLKILPKPPAAPESRSNNCAFGAKFDSRRALLCGLVAAAAAAGTMLGADIAGAASKRRPPPPAPAEANKDPNVSGVQAKVLASXNRKEAMKEAVAKLREKGKPVDK

SEQ ID NO: 62243 - DNA, 669 bp, Zea mays
  misc_feature: Ceres CLONE 1526866
  misc_feature: Encodes the peptide sequence at SEQ ID NO. 62244
  misc_feature (201)..(201): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (387)..(387): n is a, c, t, g, unknown, or other
gagctccccgcggtggcggccgctctagaactagtggatcccccgggctgcaggaattcgtctcacccctagaaaaaacacacagtccaacacacatggccgccgccgccgccgccctggtgagcagcaacagcctccgcgccccggcggccttctccgtcgtcgtccgcgcggcctcccggccggcgcctgtcgtcgcantagtgacgccgctgcccgcggccaaggcggccgccgcccgcggcgccaggctgcgcgcgcaggccacccacaacgtcaagctcatcacgccggacggggaggtacagctctagatgcccggcgacgtctacatcctggaccatgtttaggacccacggttggaggggggggggtcctgccnnnncngcccctgctcctcctgcgtgggaaagatagtctcccgctccgtcgaccaggtcgaccaaagcttcctcgacgacgaccaggtcgccaagggctttgtgctctcctgcattcgcctaccccaccctcggacctcttattccggagtcccatgggagtatgctctccccgaaatccaactattttaagcctgcagttagaggccccccgtcctcccgtctccctttgcgttggggggaagtgagaagaaaaataacgatccgccccttttatagtaacctactc

SEQ ID NO: 62244 - protein, 72 aa, Zea mays
  misc_feature: Ceres CLONE 1526866
  misc_feature (36)..(36): Xaa is any aa, unknown, or other
MAAAAAALVSSNSLRAPAAFSVVVRAASRPAPVVAXVTPLPAAKAAAARGARLRAQATHNVKLITPDGEVQL

SEQ ID NO: 62245 - DNA, 663 bp, Zea mays
  misc_feature: Ceres CLONE 1526867
  misc_feature: Encodes the peptide sequence at SEQ ID NO. 62246
  misc_feature (415)..(415): n is a, c, t, g, unknown, or other
  misc_feature (530)..(530): n is a, c, t, g, unknown, or other
  misc_feature (531)..(531): n is a, c, t, g, unknown, or other
ggagctccccgcggtggcggccgctctagaactagtggatcccccgggctgcaggaattcgtctcacccctagaaaaaaccacaggcgaatgtggaggcggaggagcggaggtaggagatctccagcaatccggaggcagaggagatgaagacgttcgactcgtggccggtcttcttccgtcgggagtggaagcgcaactggcccttcctcacgggtttcgcgatcgctcggattcatcatcacggaagatgatggccgagttcgcccaggaggatctcactaactccgagttcgtccagaaacacaggatgaagcgctgactaaccaggtgaaggagttgttctagacgcatgtatgaacatccaccactgtgatgctatgtgactgagaaatctagacgctgcgatctcgttnccttaaactaaaagctagccatctaggtccagttgccatgtcataagaggggaatcggatggatctaacgggaaacatggtttggattgaaaaaaacaatttgcctgccctccannttccacctggggaaaccgaaaatttaaaataattttagggtggaaagtttccgaatttcccgggggaagttttttggccccccctcttgggggaaaggcccccttaaaaaccccccggaacattccccggga

SEQ ID NO: 62246 - protein, 35 aa, Zea mays
  misc_feature: Ceres CLONE 1526867
MKTFDSWPVFFRREWKRNWPFLTGFAIARIHHHGR

SEQ ID NO: 62247 - DNA, 737 bp, Zea mays
  misc_feature: Ceres CLONE 1526869
  misc_feature: Encodes the peptide sequence at SEQ ID NO. 62248
aaactggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacacccggacgttggtgggcggcatccaggacgtgccggggagcgagaacgaccttcacctccaggagctcgcccgcttcgccgtcgatgagcacaacaagaaggccaatgctcttctggggatcgagaagcttgtgaagccccccacacaaatggttgctggcacgatgtactatctcactattgaagtgaaggatgggaaaatcaaaaaactctacgaatctttcccccccccagaagccctgaggataacttcaaggcacctgaacggaattcctacctgtaagaaaagggcgctacgcgccttaggacgtctccttcctccatgtgccagtctgcacttctccatcaaacttccatgaataaacgaacctctgctccccttggtgcatctctacaacaactacttaccctccctaacgtcctttcttttcgttccctttttagtctccccttccgccatattaatatgacaaaaacatctttttactacttgtctctaaaccactattgcggccgttatatctccctctttcaaataatccaacttaat

SEQ ID NO: 62248 - protein, 123 aa, Zea mays
  misc_feature: Ceres CLONE 1526869
  misc_feature (10)..(97): Pfam Name: Cystatin Pfam Description: Cystatin domain
MANNTRTLVGGIQDVPGSENDLHLQELARFAVDEHNKKANALLGIEKLVKPPTQMVAGTMYYLTIEVKDGKIKKLYESFPPPEALRITSRHLNGIPTCKKRALRALGRLLPPCASLHFSIKLP

SEQ ID NO: 62249 - DNA, 684 bp, Zea mays
  misc_feature: Ceres CLONE 1526876
  misc_feature (546)..(546): n is a, c, t, g, unknown, or other
  misc_feature (561)..(561): n is a, c, t, g, unknown, or other
  misc_feature (571)..(571): n is a, c, t, g, unknown, or other
  misc_feature (572)..(572): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (680)..(680): n is a, c, t, g, unknown, or other
aagctggagctccccgcggtggcggccgctctagaactagtggatcccccgggctgcaggaattcgtctcacccctagaaaaagaacggaacccagaggaacagagcagacgacgcgaggcgatttctgcgggtttgcttgctccatctgtagaccttaggccgccgccgggcgaccgtgcgcgtgcggtgctcacgccccaccccgctcaggtgcgatgcgttcgatgccttcatgtagtaatcttcgtaagcttgttgcttgataggtggttccccgtatcgatcgtctgtttttgtgatgccgcgagggattgggaagccccgctcgatctcagttctccgcgcagcaaagcagtcacgcgaggacgcgccagtccgccggatatcgcaggacgccgcatcccgtgcagattgttgtgcctgactagtcctcgcaagattttgcgatttctggacctgcatgggttgtttttgtattggtcttatcttttgttctgaaatacgcatgtggttgctttcgatgatgatgatgatgatgatgaanagaaaaaaaaaaaanaaaaaaaaannaaaaaaaannnnaaaaaaaaaaaaaaaannnnnnaaaaannnnnannnnnnnnnaaaannnnnnnnnnaannnnnnannnnnnnnaannnnnaaaaaaannnnaaaanccca

SEQ ID NO: 62250 - DNA, 644 bp, Zea mays
  misc_feature: Ceres CLONE 1526878
  misc_feature: Translation starting site: 143
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
ggagctccccgcggtggcggccgctctagactagtggatcccccgggctgcaggaattcgtctcacccctagaaaaactctctccgtcgccgcttcctcccggtatactctgttatgctagggtgtccaccatttcgcgcaaatggtgtgccttcaatgttccattcgtttctcctggtggggtcgcgcgctagccgactccctgcgaccgagcactctacgatttaccggcatgacccgtctgggccactgctgtgagtccgcgatccagagcaagtctctgggacttcctgatcaagttgaccaatgttctgaagagcggctgccatgtcctggccctcgactagatcttcaagcgtaacccgacgactattgatacctacgtctctctaggttgtctgctaacaaaaggcaaaaaccccgggggtccccccccctttgttttttaagagaggaatctctcccccgaggaaaaccccnnnnnnnacccccgggggtttaaaaaaaaaaaaaaaaaaaagagccgctctccccccccccgggggggccccccccctccttctttaaaaaaaaaaaaacaaaccccgggtttttttttttttttttttgttgaaggggaaaaaaaaaaaaaaaatttttttttc

SEQ ID NO: 62251 - DNA, 703 bp, Zea mays
  misc_feature: Ceres CLONE 1526879
  misc_feature: Encodes the peptide sequence at SEQ ID NO. 62252
  misc_feature (471)..(471): n is a, c, t, g, unknown, or other
  misc_feature (492)..(492): n is a, c, t, g, unknown, or other
  misc_feature (504)..(504): n is a, c, t, g, unknown, or other
ggagctccccgcggtggcggccgctctagaactagtggatcccccgggctgcaggaattcgtctcacccctagaaaaagcccaccgggtcatcgccattcgccacaaagccatttgaaccccccacgtctcctcgcctcgttccccatttgctgcgtctccttgcccgcgccgccgctcgccgtttgcccctcgtctccgcaccgcgcgctgttgtccatccttgtgcagcaaaaatgacggctggctacattgttggctcactggtcggatcctttgccattgcatacctgtgtgacacatttatctctgacaagaaggcatttggaggtagcacccccaagactgtttctgagaaggagtggtggcaagccacagacaccaagttccaggcctggcctcgcactgctgggccaccggttgtcatgaaccccatcagccgccagaacttcatcgtcaagtcactgagtangtttgggctggagaagctggntctgcgacttgntgccgcatgaagccagagttctttttctaagtcttaatcatttggataaaacgaaataccggcgggatttttttttgggattttacctgaactgggagcgaacctgggtctttccctttgcctcaaggggttcggccctggggaaacttccccaaccacaaaaaaccggggtgtttccaaaaaagcgctttgctccacc

SEQ ID NO: 62252 - protein, 92 aa, Zea mays
  misc_feature: Ceres CLONE 1526879
  misc_feature (3)..(75): Pfam Name: DUF1138 Pfam Description: Protein of unknown function (DUF1138)
  misc_feature (79)..(79): Xaa is any aa, unknown, or other
  misc_feature (86)..(86): Xaa is any aa, unknown, or other
  misc_feature (90)..(90): Xaa is any aa, unknown, or other
MTAGYIVGSLVGSFAIAYLCDTFISDKKAFGGSTPKTVSEKEWWQATDTKFQAWPRTAGPPVVMNPISRQNFIVKSLSXFGLEKLXLRLXAA

SEQ ID NO: 62253 - DNA, 677 bp, Zea mays
  misc_feature: Ceres CLONE 1526881
  misc_feature (638)..(638): n is a, c, t, g, unknown, or other
  misc_feature (642)..(642): n is a, c, t, g, unknown, or other
ggagctccccgcggtggcggccgctctagaactagtggatcccccgggctgcaggaattcgtctcacccctagaaaaatagtactgcttaactagaactaatcaatattttctttgttcagtgcattcaacgaaacaatcctgattttgggtaattagcagcagcaatacatgatacgtccttgctgaagcctgaacttgattgtcatggaaactggcagtgatttccaaaaaaagaagaagaaagaaacgaactatttaccgacacagctcctcgactactattcattcacacctttctgcgagttctccttcccgattaatgtcgcctacttgtgcagctcattgcttgtggcgtcgctgtggccacctacaacgacggggcaacggatttcagagacacgcctgcttacaaggaatcccaatcacaggagttccctgaggagtcggaatcatcgagcgctgatgtgttcgaaggcaacccgactgaggtagcaccagctcttgagtaggactagcaaggaggcacgggggagaaaacttgtctgtctattcaagctttagcaccagctcttcgcgtttgcagtatagatgtaaaaaggtttggttaaaatctgatgctacgaaaattggctggtngcgnagaaaactcaagcggaactacagggagaggctctt

SEQ ID NO: 62254 - DNA, 915 bp, Zea mays
  misc_feature: Ceres CLONE 1526881-R
  misc_feature (915)..(915): n is a, c, t, g, unknown, or other
aattcgattctgcagtttgggggatcctctagttttggagcgggcgtcaccgtatgatggagctgccactgttgtttgctttgatgagggttaattgcgcgcttggcgtgatggtggtcatacacagatgttcctgtgtcaaatagctagccggtcgctggtcaatcaacatacgaaccagtccgtatccactggagagcatgtgtgtagccgaattagtgagctaaactgcattactttgcattgcgcttgctgcaggactttcgagttggagaagcatgactcgatttcaggatttctgaatccgtgaaaaattcctcaggaacagcaaccggctggggcggacgaacgtttttacgattagggatgccgtctgcaatcacctcccgtctgtgtcatcggtatacgcccatggatggcagtcaaacggttatccactgaatcagggcacgacgtcggattcagcatgtgaagcactagacctgccaaacatcagaatcggttccaaaaggcgcctttgatggcgtttatttcttaggagaccctggcgcgtggcgagcctgttaaaggattgacccggcattgcaggaagtccgtcaaatcccgagggacgttctttgattttccttggagtttccccccctggaaagccccttccctgagcctcctctgggtgcgtaagcttaaccgcttaacggcgaaacaatgcccgggcctttcatcccttttagggggaagcggccggcccctttattggtatagccagagtctctctcccgggctttgttcaaggatgtggccgccccaaggaaatcctccttcccccttttggggggcctctttggggggggagcgcccgaccccagcaaatcccttggaccgttttggggcctttagtgttcgggtgacctttcn

SEQ ID NO: 62255 - DNA, 689 bp, Zea mays
  misc_feature: Ceres CLONE 1526882
  misc_feature: Encodes the peptide sequence at SEQ ID NO. 62256
aagctggagctccccgcggtggcggccgctctagaactagtggatcccccgggctgcaggaattcgtctcacccctagaaaaaacctgctgcttaacatctactaacgactcttttagctatagcaggacatactgcacgcagttatgatttagcatcattagcggcggcgatggcggatctccatgatgtcctcgccagctctggatggggctcctcacgggctgccatccctcggccgccgcgccgacctccttcacctacttctgctcccagatcaacatcatagatctacaatccctactggattgggggtggcctgaccgatcaacgtcgactcctatcgtgagaaagggcgatggcaacggcgtgtaccacttcttcaacaactacggcgcgaacgtcaaaggctacccctcgcttctacgactaggcatgactgggctctcaccgacgacgtctacatctgtggaaccacatgggcttctgatctgggccgactgcctcgctgggattctcggcggcgactacctcctcgtctacgacaacaagccttctctggctaacgatatcctatgcatgctcttcttgcgattcgtcatgataaatcaaggtgtgtgtctatactcaagcctccatggatgctcggccttcgtcatgtaacaataatcagtgctactcttcattaca

SEQ ID NO: 62256 - protein, 151 aa, Zea mays
  misc_feature: Ceres CLONE 1526882
  misc_feature (22)..(120): Pfam Name: PsbR Pfam Description: Photosystem II 10 kDa polypeptide PsbR
MGLLTGCHPSAAAPTSFTYFCSQINIIDLQSLLDWGWPDRSTSTPIVRKGDGNGVYHFFNNYGANVKGYPSLLRLGMTGLSPTTSTSVEPHGLLIWADCLAGILGGDYLLVYDNKPSLANDILCMLFLRFVMINQGVCLYSSLHGCSAFVM

SEQ ID NO: 62257 - DNA, 1093 bp, Zea mays
  misc_feature: Ceres CLONE 1526882-R
ttcgagcgtctcgtttttttttttttttttgtaatgaagagtagcactgattattgttacatgactaacgttgagcatccatggaggctagattatagacagacgccctgattttacatgacgaatcgcaagaagcgcatgcattggatatccttagccggagagggcgctggtgttgtagactaagagggcgccgccgccgaggatcccagcgagggtgacggcccagatcagaagcccagtggttccaccgacctagacatcccccgtgggagaccagtcatcctccttgtagattgggctgtaatccgtcgaactttgcgccgtacttgtcgacgaactgggacacgcccttggccccttgcccttttctccccttgggatcaaagtccaccgggtagggcaacccccccaattcaggaaggggttgttccgtcttggatcttttctttctttgtgaagcctaatgaaccgctcaaaggatgggtatgcggcccgcccgtctgaaggggggggggctattgcactctggtggcgggcccccccccccaaaaatttgtgcggatgctccaaaataaattgggagagggtgtggtgaaaatgcctgcccaccgcgctttataaactatttttatccctatagctttatgtcgttcacgctgggagatagtcgggggtgtgcttttgtgtgagattgtagtgattgatatcctatttagactcacgtattgtagagctgattttatagccgtatacgatagtctctcggtgtggggagtgtatctttgtatttatagttctgtgtagtgaatgataataatattaccaccgatcactctctcctattatgtgccaccgcgccctttactgtatatatattcggttggtgtggattggtcattatattttttgtattacgccggagagagtatcacagagtccaattcgtgttccctccagattatcatctccccccaccacacccgcgttttgcaagtatgttcgattaggccggtccagagagctagtttcgtccttgcccctgatatatcattttttgacccaggtgctatgccgcgcggtgctctcttag

SEQ ID NO: 62258 - DNA, 693 bp, Zea mays
  misc_feature: Ceres CLONE 1526890
  misc_feature: Encodes the peptide sequence at SEQ ID NO. 62259
aaactggagctccccgcggtggcggccgctctagaactagtggatcccccgggctgcaggaattcgtctcacccctagaaaaaatccactctcagcatcaccagctaagaacaggtcttcgtctcaataatggaaggcaaaacagggcagctcaggtgctgtttcgtcgccatcgtgctcgtcctgggtcttgtccttgagcagtcccagcacgctgaagctaaaggcaaatggtgctgcgaaaccgccaccggaaaataccattttaatcgctgcgttgactcgggttgggtcgacaatattgggttctgtgcgagtaatgcccgttgcatcattatggaggacagatgtggaggtcgttagccagtgcctgctcgtgatgcgctttctctggatgtcatttgattaattataagcaagtacgtgaagttaagacacgagggccagacgactgtcgtccaacgattggtaatatgtgaacttgtcgattgacatcgtagttcaactatccaatcagctccttcgtgtcatcatgtactcgcacttcaagtttgtcgactgttgcgtagacaaatctatctagcaaataaacacggacgccgaacgtgcaaatgactctacttcctgatcttgcagtcgattgcatcactcaatggtctgtggctgattaatctaagaaccttgcaacatgtt

SEQ ID NO: 62259 - protein, 77 aa, Zea mays
  misc_feature: Ceres CLONE 1526890
MEGKTGQLRCCFVAIVLVLGLVLEQSQHAEAKGKWCCETATGKYHFNRCVDSGWVDNIGFCASNARCIIMEDRCGGR

SEQ ID NO: 62260 - DNA, 685 bp, Zea mays
  misc_feature: Ceres CLONE 1526904
  misc_feature: Encodes the peptide sequence at SEQ ID NO. 62261
gagctggagctccccgcggtggcggccgctctagaactagtggatcccccgggctgcaggaattcgtctcacccctagaaaaaaacttcctgcttgcacgcaagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcaaacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgtaaggttaatcccgaattctgaagtcatgggtgcgcttccagtcgcagcgtctttagctaaccagctcgcatacatataggcaaacttgagtgagctatgtagtacggatatgggttgtgtggccaactgcccatgactattgacatccttgcctatatggactggggacaggatccccctgcaaaacggggccctggtttccccaacctaattccttaaataaccggtgggggttttttcaaaaaaaaaaag

SEQ ID NO: 62261 - protein, 73 aa, Zea mays; identical to SEQ ID NO: 39404
  misc_feature: Ceres CLONE 1526904

SEQ ID NO: 62262 - DNA, 625 bp, Zea mays
  misc_feature: Ceres CLONE 1526922
gctctgaactagtggatcccccgggctgcaggaattcgtctcacccctagaaaaatccgctcctgtcctcttctctcgtcgcttcctccgtctctcggcgtcgaatctcctccaaccaccgcgcacactctactcgacgcccggtggaaggagttctccgggatttgagctgtttctgccctcacctccgctaggccggcgtcgagtggagatccaatcggaaatcgaactgacttcatcttctgttgcatccccatcaggataagccatgccaggagtgatcaccaagttccgcggttacatccatggtgaatgtggaatggccccccggttgcgatcccttttttgggcccccacctcaccccaatacttttccccgggggggggagactggaatgatcttttctttaacccaaaaaaaattccctctcgggggggggccccccggggggggggtgaaaaaaacggtaaccttttccgggggtatacccgtttttttgaaacacctttttatccgccggcacccaaaaggcgaggaagtgggttcgttatcccccgggggaaagataccctgcccaccgctacgctataccacgcccctctttttttggggggaagaatacgc

SEQ ID NO: 62263 - DNA, 585 bp, Zea mays
  misc_feature: Ceres CLONE 1526928
  misc_feature: Encodes the peptide sequence at SEQ ID NO. 62264
ctggagctccccgcggtggcggccgctctagactagtggatcccccgggctgcaggaattcgtctcacccctagaaaaacacccccacccccacccccacctcgcctcccggatccgcacccgatgggcagcctcggcggcgacgcggagccgcagggcgcgaggcggcggccgcggttcctgtgcctgcacgggttccgcaccagcggcgagatcatgcgcaagcaggtgctcgggaagtggcccgccgacgtcacggcgcgcctcgacctcgtcttcgccgacgcgccgttccccgccgaagggcagtccgacgtcgacggcatcttcgacccgccctactacgagtggtttccgtttcgacaagagtttttatggagtacaaggaatttcgacaagtgctgggcctacatcgagagctgatgataaagaccgccccctccacgactgatgggtttcttccaggggttcattctggtcgcggggctttcggggggtccaaaaacaggctggggctcgacttagttcccaaagggcagttccctcctttcatcgggggggcccaatttctcgttcccgaagggg

SEQ ID NO: 62264 - protein, 99 aa, Zea mays
  misc_feature: Ceres CLONE 1526928
MGSLGGDAEPQGARRRPRFLCLHGFRTSGEIMRKQVLGKWPADVTARLDLVFADAPFPAEGQSDVDGIFDPPYYEWFPFRQEFLWSTRNFDKCWAYIES

SEQ ID NO: 62265 - DNA, 702 bp, Zea mays
  misc_feature: Ceres CLONE 1526931
  misc_feature: Encodes the peptide sequence at SEQ ID NO. 62266
  misc_feature (576)..(576): n is a, c, t, g, unknown, or other
  misc_feature (684)..(684): n is a, c, t, g, unknown, or other
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatctagggcatgaacggcaaggagctggaccgccgcaacatcaccgtcaacgaggcccagtcccgcggcggccctgaaggcggcggcggtgggtacgggggtggccttggaggctttggttacggcggtggcaggcgccgtgatggcccctggtacttaccgtatgggcggtcgcggcttaccggggggttgttccgnctttccttggttgtttcctgccggtttatggtcggttgccaccctgtttttgttctgcttttcttctttttccttctgtggaactgtgcgagggattctgaaccgttnttctacccccgcctttta

SEQ ID NO: 62266 - protein, 66 aa, Zea mays
  misc_feature: Ceres CLONE 1526931
  misc_feature (10)..(67): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAI

SEQ ID NO: 62267 - DNA, 678 bp, Zea mays
  misc_feature: Ceres CLONE 1527110
  misc_feature: Encodes the peptide sequence at SEQ ID NO. 62268
  misc_feature (390)..(390): n is a, c, t, g, unknown, or other
  misc_feature (428)..(428): n is a, c, t, g, unknown, or other
  misc_feature (431)..(431): n is a, c, t, g, unknown, or other
  misc_feature (486)..(486): n is a, c, t, g, unknown, or other
  misc_feature (540)..(540): n is a, c, t, g, unknown, or other
  misc_feature (553)..(553): n is a, c, t, g, unknown, or other
  misc_feature (571)..(571): n is a, c, t, g, unknown, or other
ctggagctccccgcggtggcggccgctctagaactagtggatcccccgggctgcaggaattcgtctcacccctagaaaaagacgcctcgccgctacgcccgcatttcccaatccatcctcgtcgccaggtgctcatctcgcgtcgacatttacccggtccgatccccggcacgaaaaataaagaagctagtgggtacagacacaagacaatattatattgggactcaattagtttgatgtttggcaaagatcatgcaaccggtgaagtcgcaaagaccctagctgatggcgcgagagacatgagtaaggaagaggtgatgcgcgcaagtacgattccttgttggcacttctggtgatccttaggaagagatggctgctgaagcaactganaaagtgaacctgagtgtggtttggtgaattgactactngtngatgtgttgccgagtgaaaaattgtgggtctgtgatctaataataatttggtctnatatatgttggtcacttggtctagtatatgttgcttatgataaatctggatgtngatgataattccngaacactcataatctggntgggtgcgaaaaaaaaaaaaaaaaacgaaacctcgagtacccaatccccctataggagccaatacccggctcctgggccgcgtttaaaagccggactggaaaacctg

SEQ ID NO: 62268 - protein, 117 aa, Zea mays
  misc_feature: Ceres CLONE 1527110
GAPRGGGRSRTSGSPGLQEFVSPLEKDASPLRPHFPIHPRRQVLISRRHLPGPIPGTKNKEASGYRHKTILYWDSISLMFGKDHATGEVAKTLADGARDMSKEEVMRASTIPCWHFW

SEQ ID NO: 62269 - DNA, 690 bp, Zea mays
  misc_feature: Ceres CLONE 1527116
  misc_feature: Encodes the peptide sequence at SEQ ID NO. 62270
aaagctggagctccccgcggtggcggccgctctagaactagtggatcccccgggctgcaggaattcgtctcacccctagaaaaaagccgtcatcgtttcgcgtccgcctcagcccgccgcaaggggaggtaagttcatgagacaccttcgagaagctgaaatggctcctaaagctgctcctgccaagaagggtgatgccaagacccaggccttgaaggttgccaaggctgtgaagtctggggcagccaagaagaccaagaagatccgcacatctgtgacatttcaccgccccacgaccctgaagaaggctagggaccccaagtacccacgaatcagcactaccggaaggaacaagcttgatcagtaccaaattctcaagtacccccttaccacagaatcagcgatgaaaaagattgaagataacaacactctggtcttcattgttgacctcaaggcagacaagaagaagatcaaggctgccgtcaagaagatgtatgacatccaggcaaagaaagtcaacaccttgatcaggcctgatgggaagaggaaggcttacttgaagctgactcccaactatgatgctcttgatggggccaacaaaattggcatcatctaaagggctgcattaaggcatccggtggtttcccaagttcaaccggtggggcccaaattccaagtggaaaaccgaat

SEQ ID NO: 62270 - protein, 151 aa, Zea mays
  misc_feature: Ceres CLONE 1527116
  misc_feature (69)..(148): Pfam Name: Ribosomal_L23 Pfam Description: Ribosomal protein L23
  misc_feature (11)..(63): Pfam Name: Ribosomal_L23eN Pfam Description: Ribosomal protein L23, N-terminal domain
MAPKAAPAKKGDAKTQALKVAKAVKSGAAKKTKKIRTSVTFHRPTTLKKARDPKYPRISTTGRNKLDQYQILKYPLTTESAMKKIEDNNTLVFIVDLKADKKKIKAAVKKMYDIQAKKVNTLIRPDGKRKAYLKLTPNYDALDGANKIGII

SEQ ID NO: 62271 - DNA, 708 bp, Zea mays
  misc_feature: Ceres CLONE 1527124
  misc_feature: Encodes the peptide sequence at SEQ ID NO. 62272
cgcggtggcggccgctctagaactagtggatcccccgggctgcaggaattcgtctcacccctagaaaaacctcttgctcataccgcgacgctctctctctttcgccgagctcctcgaaaccctaggagcgtgcttgaccggcggcggcgaggtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccgtccgccattgccggcaagctcggatctctccctttccaggcctgcgagcatcagatcgtcaccgtcgactgccagccatcgggtcctcagggaggcatgctcgtcttcgtctccggttccatacgcaccggggccccgagagccccccatcaagttctcccaggcattccatttgctgccggccgctgggtccctcttcgtgcaaaaaggcatgttcccgcctgaactattgggttaagaacgcccgatactcttggggatgaagggaatggtttaagggtttccttgttgaaacgatgaaatacttaatggttcccccaaccccgggcccccttttgaaaccctcccttggggggctgcccttccctggaattccacaaaaaattggcctagaacctggaattattttcccg

SEQ ID NO: 62272 - protein, 121 aa, Zea mays
  misc_feature: Ceres CLONE 1527124
  misc_feature (8)..(106): Pfam Name: NTF2 Pfam Description: Nuclear transport factor 2 (NTF2) domain
MAMDPDAVAKAFVEHYYRTFDTNRAALVGLYQETSMLTFEGQKFQGPSAIAGKLGSLPFQACEHQIVTVDCQPSGPQGGMLVFVSGSIRTGAPRAPHQVLPGIPFAAGRWVPLRAKRHVPA

SEQ ID NO: 62273 - DNA, 675 bp, Zea mays
  misc_feature: Ceres CLONE 1527125
  misc_feature: Encodes the peptide sequence at SEQ ID NO. 62274
ccatgctggagctcaccgcggtggcggccgctctagactagtggatcccccgggctgcaggaattcgtctcacccctagggaaggctgcgcccttctcaccgccgccagcccgccagaaggtctcctcccgtctctagagtggctctttctctctccgtcaaatggctctcgcgtgcgcctctcacgcgtgccgctttctcctcgccggccaggcgagatctttccacgcccagccctaccatgccaaggtcggcgtggtggagttcctgaacggcgtctggaaaggggtggaggcgcacgccgcgaagctggaggaggctgtgggcggcaacctccagaggctccttgaggcccgcacgctgcggctcaagaagctcggcatcccctgcaagcataaacaaatccccttgaggtttgcacacaagtaccgttttgggctctggaagccccaagcaaaaccccaggaaaggtgaaaaaaggtgggttcgtccttcaaagaaaagtctactgtctggaaggagcgcatgtttgggacaaccaaatcttgtctctgtcattaaaaacccccaacccctttggttctctggctcctggccaagcctattttgtatccatttcgccccaccaacaaaaatgcgtccgacccggtccgattttcctccgcggggacaccg

SEQ ID NO: 62274 - protein, 103 aa, Zea mays
  misc_feature: Ceres CLONE 1527125
MALACASHACRFLLAGQARSFHAQPYHAKVGVVEFLNGVWKGVEAHAAKLEEAVGGNLQRLLEARTLRLKKLGIPCKHKQIPLRFAHKYRFGLWKPQAKPQER

SEQ ID NO: 62275 - DNA, 625 bp, Zea mays
  misc_feature: Ceres CLONE 1527144
  misc_feature: Encodes the peptide sequence at SEQ ID NO. 62276
  misc_feature (445)..(445): n is a, c, t, g, unknown, or other
gggcggccgctctagaactagtggatcccccgggctgcaggaattcgtctcacccctagaaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaagggacacaagaagacgcgcatcgtcccgcgccacgtgctgctggcgatcccgcacgacnaagagctcgggaagctgctgaacggcgtgacatcgcccacggcggcgtggtgcccaaaatcaacccggttctgctgcccaagaagacgggggaaaaaggcgtccaacgggcgggagcaaggagggcaaagtcccccaaaaagggcccccaagtccccccaaaaaaggataaggggtttgg

SEQ ID NO: 62276 - protein, 164 aa, Zea mays
  misc_feature: Ceres CLONE 1527144
  misc_feature (31)..(104): Pfam Name: Histone Pfam Description: Core histone H2A/H2B/H3/H4
  misc_feature (105)..(105): Xaa is any aa, unknown, or other
MDATGTGAGGKAKKGAAGRKAGGPRKKSVTRSVKAGLQFPVGRIGRYLKKGRYAQRVGSGAPVYLAAVLEYLAAEVLELAGNAAKGHKKTRIVPRHVLLAIPHDXELGKLLNGVTSPTAAWCPKSTRFCCPRRRGKKASNGREQGGQSPPKRAPKSPQKRIRGL

SEQ ID NO: 62277 - DNA, 717 bp, Zea mays
  misc_feature: Ceres CLONE 1527146
  misc_feature: Encodes the peptide sequence at SEQ ID NO. 62278
  misc_feature (490)..(490): n is a, c, t, g, unknown, or other
  misc_feature (518)..(518): n is a, c, t, g, unknown, or other
  misc_feature (521)..(521): n is a, c, t, g, unknown, or other
ctccccgcggtggcggccgctctagaactagtggatcccccgggctgcaggaattcgtctcacccctagaaaaaaagcaagaacagctgtcgatccaattgtcacttgctctccctccaacaagctaattatggccggtcatccctcttctagctcgtttcattatccatggcggaggagaagcaccaccaccaccacctgttccaccacaagaaggacgaggagcaggatgagcagctcgccggcggcgagtacagcgagtccgccaagtacacataggccacggtgacggaggtcgtgtccacgggcgaagacgagtactaggagtcccagactgacgagaagcagcacatgcccaagcagcacctcggtgaggccagcgccatcgccgtcggtgccttcgcactctacgagtagctccaagcaatagtgcacccggagtacgtgcaactgccactagatctatgacgtagtcttcggcggcggcttnccatcggatcctggggcattcgcttccntcnagccctcgaggaggagaaggacatcaggacgccctagaggtcgggctggtagaagaacacccgcttctccggtgaatgatcccccggatcgtcgatcatccccggggggtaacctggcgggggtgaaatgaattcaacccccgcccggttgaccgcgcgaacaatggaagggcccggggaagcccaatatacgctt

SEQ ID NO: 62278 - protein, 36 aa, Zea mays
  misc_feature: Ceres CLONE 1527146
MAEEKHHHHHLFHHKKDEEQDEQLAGGEYSESAKYT

SEQ ID NO: 62279 - DNA, 667 bp, Zea mays
  misc_feature: Ceres CLONE 1527147
  misc_feature: Encodes the peptide sequence at SEQ ID NO. 62280
aaagctggagctccccgcggtggcggccgctctagaactagtggatcccccgggctgcaggaattcgtctcacccctagaaaaagccgaattaagttcgtgcacgtacgcacgcaccgggacaccagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctcccgtcaccaagagaggtctgctgctcaagttcctgctgctgggcggcggctcacttcttgcctacgtcagcgcgtcggcgtcaccggaccctctgccgaatcagaagggacctcaagagccgccgcagccgggcccgcgcgggcaagatctagcctcagctttctcatttgcatgggctagtagctttgctttgtactgctagcgc

SEQ ID NO: 62280 - protein, 159 aa, Zea mays
  misc_feature: Ceres CLONE 1527147
  misc_feature (5)..(142): Pfam Name: PSI_PsaH Pfam Description: Photosystem I reaction centre subunit VI
MASLAAVSVKPVAIKGLAGSSISGRKLAVARPSARSIRRPRAAAVVAKYGDKSVYFDLDDIGNTTGQWDLYGSDAPSPYNPLQSKFFETFAAPVTKRGLLLKFLLLGGGSLLAYVSASASPDPLPNQKGPQEPPQPGPRGQDLASAFSFAWASSFALYC

SEQ ID NO: 62281 - DNA, 676 bp, Zea mays
  misc_feature: Ceres CLONE 1527161
  misc_feature (676)..(676): n is a, c, t, g, unknown, or other
agctccccgcggtggcggccgctctagaactagtggatcccccgggctgcaggaattcgtctcacccctagaaaaagtactgttttggcaaccccgcccggagaattaaaaggacatacgaggttgccacttcttgttctagttgtaactgtgtttatgaattgtgtgttcatcccgagtgattgactgttccctgagtgatatcagagtccccttgttcatgtggctgctgctgttcaactcttttctgcacctcatctaaataatcgtttggtcggtcaatgcttctgcaggtaccgtgctatcacgagcgcgtactacccctgagcagtaggggcgctcgtcgtactcaacgtcacgcggcatgtctccttctgacaacgtaccaaggtggataacccacctcagggaccataccgacaccaacctcctgatcatgctaggtgagaactatgcgtactcttgacaccgtcagggctgccccgacctacgattcccacgtctctgccgagatggataacgtctacttacagcagactgcggaccttgaattgatgaatgcgaagccctccttcaccgaatggctcatccaggtctagctcatcatgtaccgtgacctccactccctcatggatgaccacgacaactcctccatctgcgagacaatcacgaccgn

SEQ ID NO: 62282 - DNA, 730 bp, Zea mays
  misc_feature: Ceres CLONE 1527166
  misc_feature: Encodes the peptide sequence at SEQ ID NO. 62283
  misc_feature (208)..(208): n is a, c, t, g, unknown, or other
  misc_feature (532)..(532): n is a, c, t, g, unknown, or other
ccccgcggtggcggccgctctagaactagtggatcccccgggctgcaggaattcgtctcacccctagaaaaactctcgcgccgccgcggatcacaacaccgcaccacactacccagcggaatccgcccacccgcacccgcacccggagcacaggagatatgtcgcagggaaagggaggagcgcccaggaaggaggaggtggtcaccanggagtacaccatcaacctccacaagcgcctccacggctgcacattctagaagaaggcacccagcgccttcaaggagatcaggaagtttgcgcagaaggccatgggcaccacggacattaggatccatgtgaacctcagtaggcacatctggaccaccgggatcaggagcgtgccgcgaagggttttgtgccccccccccgccagaggtacgacaagaggatgcccaggaggaccctactcccttgccaccggctcagaagtcccccgccgaggggttggaagggctggggaacaagggcgtggacgaacccgaatagctggggnggtttctccatcttttacagagtcctagttgtgttgtgcatcgcgaaccctttcggatgcaccacgttgttaagttcccagccgaatgtgatggctggcttctcattagaggggcggacacccttacccacgtcacccccccaggaagacgcggccccgcgcgggcatccctcgcaaacccccgcgtgtgggcagtcg

SEQ ID NO: 62283 - protein, 32 aa, Zea mays
  misc_feature: Ceres CLONE 1527166
  misc_feature (17)..(17): Xaa is any aa, unknown, or other
MSQGKGGAPRKEEVVTXEYTINLHKRLHGCTF

SEQ ID NO: 62284 - DNA, 696 bp, Zea mays
  misc_feature: Ceres CLONE 1527169
  misc_feature: Encodes the peptide sequence at SEQ ID NO. 62285
caaagctggagctccccgcggtggcggccgctctagaactagtggatcccccgggctgcaggaattcgtctcacccctagaaaaaaacgcaaaaccacttttccttcacgcatcgcaacgcatctacacttcccaaaacgcagcagcacttctttcctccacttcccaaatcgcagaaggaccagggaacagaagagacccttcgttttcagtccggaactggcgagatcaatggacgccgccggggaggcctcgtcgccgtcgtccccgtcgaagctgcgggacaagctgcggaccacggtgtgctgttgcttcggcgcgggcggcggcccggagaggacgaggtggcggcggcggggcgcggccgcggccgcgggcgagttccgctacgacgcgctcagctacccgctcaacttcgacgagggcgacgacgacgacgcgtacgcggaccccgccgcggtcttccggtacaggaacttcaacgcgcgcctcccgtcctcggcgggcgccgctgccgcgggtggggacccagcggcaacacaccacgggcatcgccctagaaccgtaaaaaggggagggctctccctgtaaatttttttgggcgaacttctggaattttttttggggcccctccctttttaacgggaccgaacctactaaaccgagcggacggaagttccttagggctccctcggg

SEQ ID NO: 62285 - protein, 119 aa, Zea mays
  misc_feature: Ceres CLONE 1527169
MDAAGEASSPSSPSKLRDKLRTTVCCCFGAGGGPERTRWRRRGAAAAAGEFRYDALSYPLNFDEGDDDDAYADPAAVFRYRNFNARLPSSAGAAAAGGDPAATHHGHRPRTVKRGGLSL

SEQ ID NO: 62286 - DNA, 638 bp, Zea mays
  misc_feature: Ceres CLONE 1527183
  misc_feature: Encodes the peptide sequence at SEQ ID NO. 62287
aaagctggagctccccgcggtggcggccgctctagaactagtggatcccccgggctgcaggaattcgtctcacccctagaaaaattccttccccaactctgcaggctgctcgtcgccctccctccacgccggacgcgccccgatccagatccaggggcgtaacatggcatcaaaacgtatcctcaaggaattaaaggacctgcaaaaggaccctccaacgtcatgcagtgcaggtcctgctggtgaggatatgttccactggcaggcaaccatcatgggtcctcctgatagtccatatgctggaggtgttttcttagtgaacattcatttccccccggactaccctttcaagccctcaaaggtatcttttaagacgaaggtcttccatccaaacatcaatagtaatggaagcatatgtctcgacattcttaaggagcagtggagccctgctttgacaatctctaaagttttggctttctatctgcttcgctgcttactgatccccacccagacaactcctcttggcccttaaaattgctcccttgtacaggaaggaaccgccctaattaacaaggaaacaccccgaaactgggccccaaaaaaattccctggggttgaaaattaaatggaatcccaaa

SEQ ID NO: 62287 - protein, 122 aa, Zea mays
  misc_feature: Ceres CLONE 1527183
  misc_feature (5)..(118): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPAGEDMFHWQATIMGPPDSPYAGGVFLVNIHFPPDYPFKPSKVSFKTKVFHPNINSNGSICLDILKEQWSPALTISKVLAFYLLRCLLIPTQTTPLGP

SEQ ID NO: 62288 - DNA, 665 bp, Zea mays
  misc_feature: Ceres CLONE 1527187
  misc_feature: Translation starting site: 192
  misc_feature: SWISSPROT Homolog: EC 1.15.1.1 Superoxide dismutase
  misc_feature (570)..(570): n is a, c, t, g, unknown, or other
  misc_feature (584)..(584): n is a, c, t, g, unknown, or other
gctctagaactagtggatcccccgggctgcaggaattcgtctcacccctagaaaaaacctcgtcgcagcccccaaggccccaactacccccagtctcggaagagaactatccagaagcgcaagactccaaagccgtcgccttcctatccatcccttcctcgccacgggggtcgcctgagatcacataaacaatggtgaaggctgttgctgtgcttggtagcagcgatggtgtcaagggcaccatctttttcacccaagtgggagatggccctaccactgtcaccggaagtgtctctggcctcaagcctggcctccatgggtttcatgtgcatgcgcttggtgacaccaccaatggctgcatgtcaactggaccacactacaatcctgcgagcaaggaacatggagcaccaaagatgagaacgccatgccggtgatcttggaaatgtgacagctggagcagatggtgttgcaaacattaatgttaccgacagccagatcccactgactgggccaaactcatcattggcagagctgttgttgtcacgctgaccccgatgatctttggaaggntggaccgagctcancagagcaccggaacgctgggcgccgtgtggctttgtggatcatcgaactccaggctgaactgaaacgatggtcgctggact

SEQ ID NO: 62289 - DNA, 756 bp, Zea mays
  misc_feature: Ceres CLONE 1527188
  misc_feature: Encodes the peptide sequence at SEQ ID NO. 62290
  misc_feature (342)..(342): n is a, c, t, g, unknown, or other
  misc_feature (460)..(460): n is a, c, t, g, unknown, or other
  misc_feature (679)..(679): n is a, c, t, g, unknown, or other
  misc_feature (749)..(749): n is a, c, t, g, unknown, or other
  misc_feature (756)..(756): n is a, c, t, g, unknown, or other
tagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcaaaggtcccgcggcttcggcttcntcaccttctccacggaggaggcgatgcggaacgccatcgagggcatgaacgggaaggagctggaccgccccaacatcaccgtcaacgaggcccattccccgcgcggccgtggaagccngcggccgtggggtacggtggtgccccgtggaagccggcgcttaccgcgggggggggcccccctgatgggcgttggcggttaccggggggggcggggggttaaaggaggaccgcagccggttaagggggggggggggggccgactacccgggttggcaacacgggggtggggggtactggcaaatcccaagggaactgggaataacctaacaccgggggncccccttcctccaaaattatcttctccccaccctcgagggttacgccagaccacagagggttcttctctntgagggn

SEQ ID NO: 62290 - protein, 189 aa, Zea mays
  misc_feature: Ceres CLONE 1527188
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (54)..(54): Xaa is any aa, unknown, or other
  misc_feature (93)..(93): Xaa is any aa, unknown, or other
  misc_feature (166)..(166): Xaa is any aa, unknown, or other
MAASDVEYRCFVGGLAWATDDHSLHNAFSTYGEVLESKIILDRETQRSRGFGFXTFSTEEAMRNAIEGMNGKELDRPNITVNEAHSPRGRGSXRPWGTVVPRGSRRLPRGGAPLMGVGGYRGGRGVKGGPQPVKGGGGGRLPGLATRGWGVLANPKGTGNNLTPGXPLPPKLSSPHPRGLRQTTEGSSL

SEQ ID NO: 62291 - DNA, 681 bp, Zea mays
  misc_feature: Ceres CLONE 1527190
  misc_feature: Encodes the peptide sequence at SEQ ID NO. 62292
  misc_feature (523)..(523): n is a, c, t, g, unknown, or other
  misc_feature (574)..(574): n is a, c, t, g, unknown, or other
  misc_feature (681)..(681): n is a, c, t, g, unknown, or other
aaagctggagctccccgcggtggcggccgctctagaactagtggatcccccgggctgcaggaattcgtctcacccctagaaaaaaagaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgactaccgtccagggattgaagaaggagttcagctacagcaagatcctcaaagatctcaagaaagagttctgctgcaatggtacagtggtccaggacccagaacttggacaggtcattcagctcccaggtgatcagaggaagaacgtctcgaatttcctcgtccggnccggcatttgtgagaaagagcacattcagattcatggtttctgagcaaccngcgggtccatagcaaaccaatcctgcatgcagggcccagcttattattaataaaatctgaaggggaccatattctacctggctgggtactacaagcagggccaatan

SEQ ID NO: 62292 - protein, 115 aa, Zea mays
  misc_feature: Ceres CLONE 1527190
  misc_feature (27)..(108): Pfam Name: SUI1 Pfam Description: Translation initiation factor SUI1
  misc_feature (102)..(102): Xaa is any aa, unknown, or other
MSDLDIQIPTAFDPFAEANAGDSGAAAGSKDYVHVRIQQRNGRKSLTTVQGLKKEFSYSKILKDLKKEFCCNGTVVQDPELGQVIQLPGDQRKNVSNFLVRXGICEKEHIQIHGF

SEQ ID NO: 62293 - DNA, 695 bp, Zea mays
  misc_feature: Ceres CLONE 1527200
  misc_feature: Encodes the peptide sequence at SEQ ID NO. 62294
  misc_feature (413)..(413): n is a, c, t, g, unknown, or other
aaaagctggagctccccgcggtggcggccgctctagaactagtggatcccccgggctgcaggaattcgtctcacccctagaaaaagacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtctacgccaacgggagaaagggcaagggcaagggcgtgtaccagttcgtcgacaagtacggcgcgaacgtcgacggatacancccaatctacaacgaggatgactggtctcccacccgcgacctctacgtcgggggaaccactgggcttctgatctgggccgtcaccctccctggggatcctcgggggcggcgcccctccttgtctacaaacaccagggccctcttccggctaaggatagcccaatggcatgcgcttccttgccaattccgccctgttaaaaacccgggggggcctggccaaacaactctgcccccccgtgggaaggcccccaccccttgggtaaaaggaaacccattaaacca

SEQ ID NO: 62294 - protein, 173 aa, Zea mays
  misc_feature: Ceres CLONE 1527200
  misc_feature (32)..(129): Pfam Name: PsbR Pfam Description: Photosystem II 10 kDa polypeptide PsbR
  misc_feature (80)..(80): Xaa is any aa, unknown, or other
MAASMISSSALAVAPQGLPPLGRRASSFAVVCSKKKIKTDKPYGIGGGLTVDVYANGRKGKGKGVYQFVDKYGANVDGYXPIYNEDDWSPTRDLYVGGTTGLLIWAVTLPGDPRGRRPSLSTNTRALFRLRIAQWHALPCQFRPVKNPGGPGQTTLPPRGKAPTPWVKGNPLN

SEQ ID NO: 62295 - DNA, 667 bp, Zea mays
  misc_feature: Ceres CLONE 1527203
  misc_feature: Encodes the peptide sequence at SEQ ID NO. 62296
aaagctggagctccccgcggtggcggccgctctagaactagtggatcccccgggctgcaggaattcgtctcacccctagaaaaaactcgtctcatctcttccatacgaccataccctacctccaaattcccaattgtcaacctctcctcagagttcgagtgaccatgtcggggcgcggaaagggcgggaaggggctgggcaagggcggcgcgaagcgtcaccgcaaggtcctccgcgacaacatccagggcattacgaagccggcgatccggaggctggcgagaaggggcggcgtgaagcgcatctcggggctcatctacgaggagacccgcggcgtgctcaagatcttcctcgagaatgtcattcgcgacgctgtcacctacacggagcacgcccgccgtaacacccccaccgccatggacgtcgtctacgcgctcaagcggcagggccgcaccctctacggatttggcggctgaggggtcaggggtgtccgccagctgctgctggtcgtggcagaagtcttgggtcgcggccaccaaatggagtgattccagagtactcttgcccatgggcttagtttcggaggcttatcactctagactctagtgccttgggcccagaatagcatacgacttggacctgcatttctttgttctgaaccctctaa

SEQ ID NO: 62296 - protein, 103 aa, Zea mays
  misc_feature: Ceres CLONE 1527203
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRNTPTAMDVVYALKRQGRTLYGFGG

SEQ ID NO: 62297 - DNA, 629 bp, Zea mays
  misc_feature: Ceres CLONE 1527210
  misc_feature: Encodes the peptide sequence at SEQ ID NO. 62298
  misc_feature (418)..(418): n is a, c, t, g, unknown, or other
  misc_feature (575)..(575): n is a, c, t, g, unknown, or other
ggcggccgctctagaactagtggatcccccgggctgcaggaattcgtctcacccctagaaaaaaggcaggcagcagcggagcgccttggtgatctacgaagaggatgaattccaggatctccctcctctgcgccctcgtcctcgcctcctccctcctgcactgcgccagatccgacggcaatgacgcgcagctcctcaagggcatcaacagctacaggtcctcgctcaaggtcccggcgctgtccgagaacaagaacgcggcgtgcctggccgagcagctcgcgaggcagttcaaggggcaggagtgcaccaacacgacgggcgccaacaccgtcatcggcaccgagcagcagttcccggactaccccaggtacctggaccgctgccacctcaacgcgtcggtgaccgaggacggccnagtgatgccggcgtgcgtgccgggcctcgcccccgccgtcgtcctcgccaactacaccaagtcgcagtacaaccggttccctcacgacagccagtttctcgggcgccggaattccgagcaaggggcaacggggtccggggcccgggcccaccaccancaggggaatccgggaaaatatttcccgggtcccccccgggtccaaattgggggg

SEQ ID NO: 62298 - protein, 175 aa, Zea mays
  misc_feature: Ceres CLONE 1527210
  misc_feature (105)..(105): Xaa is any aa, unknown, or other
  misc_feature (157)..(157): Xaa is any aa, unknown, or other
MNSRISLLCALVLASSLLHCARSDGNDAQLLKGINSYRSSLKVPALSENKNAACLAEQLARQFKGQECTNTTGANTVIGTEQQFPDYPRYLDRCHLNASVTEDGXVMPACVPGLAPAVVLANYTKSQYNRFPHDSQFLGRRNSEQGATGSGARAHHXQGNPGKYFPGPPRVQIGG

SEQ ID NO: 62299 - DNA, 688 bp, Zea mays
  misc_feature: Ceres CLONE 1527215
  misc_feature: Encodes the peptide sequence at SEQ ID NO. 62300
  misc_feature (431)..(431): n is a, c, t, g, unknown, or other
  misc_feature (433)..(433): n is a, c, t, g, unknown, or other
cgcggtggcggccgctctagaactagtggatcccccgggctgcaggaattcgtctcacccctagaaaaatccatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaagtgacgtcgtcggtggcgccgtgcctcgggtacgcgatgggcagcgcggcgtcgccctcccgcgcgtgctgcagcggggtgcgctcgctcacagccgcgcgtcgtcggcggcggaccggcaggccacccctgcactgctcaagacatgacgggncngctcgggcggggcgtcagatggcccacgccgccaaatcccgggaagtgcggggtctccgtggggtgccctcagccccacgtcaaatgcccaaaatcaattgatcgatggaccctatgggaggaacccccccgtgggagggaacgtaagtggcattaacaacatgaatcctcccctaaaaaaaaaagcccaacaccggggggcccggcccacaacggccaaaaaaaaaaaaaaatctgcccccccttggtgtcctc

SEQ ID NO: 62300 - protein, 126 aa, Zea mays
  misc_feature: Ceres CLONE 1527215
  misc_feature (93)..(93): Xaa is any aa, unknown, or other
MAARSSSSQPQLVAAAAVLAAALLLLAAGAGTASAAVSCGEVTSSVAPCLGYAMGSAASPSRACCSGVRSLTAARRRRRTGRPPLHCSRHDGXARAGRQMAHAAKSREVRGLRGVPSAPRQMPKIN

SEQ ID NO: 62301 - DNA, 724 bp, Zea mays
  misc_feature: Ceres CLONE 1527223
  misc_feature: Encodes the peptide sequence at SEQ ID NO. 62302
  misc_feature (386)..(386): n is a, c, t, g, unknown, or other
  misc_feature (388)..(388): n is a, c, t, g, unknown, or other
gcggtggcggccgctctagaactagtggatcccccgggctgcaggaattcgtctcacccctagaaaaagcacagcagcagccagctccatccatcctctttcccctcctcgcttcgcttcctcggcggattcctcctccctcggccgtccccgtcccctttttcggcgcgcgagctcgcccgagatggcaaacgcgagatcgggtgtcgctgtgaatgacgagtgcatgctcaagttcggcgagctgcagtcgaagaggctgcaccgcttcctaactttcaagatggacgacaagttcaaggagatcgttgtggaccaggtcggggatcgcgctaccagctacgaggacttcaccagggggcggggcgagaatgactgcccatacncnatccaccacttcaactttgtcactgcagaagatgtccggaagagcaggatcttctatatcctatgggtccccatcctcggccaaaggtgaagagcaagaatgcttatgccaggctcaaacccaaaattgcagagggggctcaagggctttcggggggaactggcgggctctagtggaagggaatccccccttgaggaattcagggatcgggttccttaggatccggaaccgggccccggggacccgcccaatccgggggattggggggcatttaaaatgtgggcctggaaaaacggctaaaggtttcggggtttttgcctggtaaaaaaggcccgg

SEQ ID NO: 62302 - protein, 97 aa, Zea mays
  misc_feature: Ceres CLONE 1527223
  misc_feature (68)..(68): Xaa is any aa, unknown, or other
MANARSGVAVNDECMLKFGELQSKRLHRFLTFKMDDKFKEIVVDQVGDRATSYEDFTRGRGENDCPYXIHHFNFVTAEDVRKSRIFYILWVPILGQR

SEQ ID NO: 62303 - DNA, 686 bp, Zea mays
  misc_feature: Ceres CLONE 1527228
  misc_feature: Encodes the peptide sequence at SEQ ID NO. 62304
ccatgctggagctccccgcggtggcggccgctctagaactagtggatcccccgggctgcaggaattcgtctcacccctagaaaaaatggctacagctccttcctgtttctggagataccaagcacgagtgcagcaatggcgcatcccatgccctccctctcaggatcacagagcacaatcaccaccgttctgaagatccttccaaaacctcctgctgctccggagagcaaaagcaataattgggcttttgggggccaatttcgacagtaggaggggtcttctttgcttgtccgccaaatgaaacaaccacctcccccccccccttttcggcccctaacatcacttggagctgccttaaaaaatttttttcccccccccctgggaggggggggggggggggcgcccccccccccccccccccccccccccccgttaaaaaccacatcccaaacccgccgcccggcggggggcctctcccaaactccccggcccccccgccccacgccgcatacccctacccgtcgctgtccccccgccccaccccaactctccaacgcaccccccggccccctccccgcctcctcgccccccgctctcccccctcacgcccacgctcctctcgcggctctctcgacctctcaccccctacctaccacccccagcaccaccccgcacccccctcctcg

SEQ ID NO: 62304 - protein, 44 aa, Zea mays
  misc_feature: Ceres CLONE 1527228
MAHPMPSLSGSQSTITTVLKILPKPPAAPESKSNNWAFGGQFRQ

SEQ ID NO: 62305 - DNA, 717 bp, Zea mays
  misc_feature: Ceres CLONE 1527229
  misc_feature: Encodes the peptide sequence at SEQ ID NO. 62306
  misc_feature (406)..(406): n is a, c, t, g, unknown, or other
agagctggagctccccgcggtggcggccgctctagactagtggatcccccgggctgcaggaattcgtctcacccctagaaaagtgcgctttctcttacgagtccgagcttacctctaccagcctagggtctaggctaccaccccagtgcgaagaaattcatagctctccgcctccggcggcggggttcgatactgatgggggtcttcgggagctcttgtcctgcctgcttcaccctctgcgccttcctcacatgcctcgacctcattcgccttccttctcgccgtctgcgccgggtgccgtcggaggaccgggaaggtgttgcatgaccactacgacgagcgttcctactgtctcttttaaaccgacccccccggagggggggggggttcccctttcttcttgctnctcccccaccgtgccattgtctcccccccagcgcgttgctttggcttcccgccccgggcctcccttcacgacgctgccccggcccccgttttttgttctcttctgggcgcattctttttcaccggcgaaatcccgcctcgcggggggggttcccggcgataatttctaaacccgccccgttttcttacctgtttcgcccaacgcggccaccccggtggttgttgtgtttaccctccgccaggtggtgccttcccccgtcctcgtgtgcgttatccatgccttccccgccgcttttttttttcccttcctgc

SEQ ID NO: 62306 - protein, 43 aa, Zea mays
  misc_feature: Ceres CLONE 1527229
MGVFGSSCPACFTLCAFLTCLDLIRLPSRRLRRVPSEDREGVA

SEQ ID NO: 62307 - DNA, 697 bp, Zea mays
  misc_feature: Ceres CLONE 1527230
  misc_feature: Encodes the peptide sequence at SEQ ID NO. 62308
  misc_feature (365)..(365): n is a, c, t, g, unknown, or other
gctctagaactagtggatcccccgggctgcaggaattcgtctcacccctagaaaaactccccgccgcacagcctccacagcccgaaaccctcgccgccgatcggtttcggagaagagaagcaaatcaagatgtttctcggctcgctcccgcggcgcccgagcaaggaggctgcttacaagcagctgcggtcgcacatcatcatcatggcctcctgcgccgccgtcatccgcgccaccccttacatcctccatttcctcgcccgcgacggcgacatccaggaactcaagctagatctgtaggcccgtccgttgcttccccacctccagaggtgctacaaaggcaaccgttagttcgagcccactgncaggtactatggagttagtggctatagtgcctgcttaagtttttttgttgttccaagtttagtgacaaactgacaatggtgtagcaactggcctgtgctgcgacaagtatttcgtttttgctatctgtatggtctagtctttgtttgcactggtggatttgcagagatgtatcattcacaatgttccggtgtcagtcgccattgtcttaaaaaaaaaaaaaaaacaaaaccctcgaggtaccaattcgcctatagggggtcgtattacgccgctcccgggccgtcgtttaaaaggccggaccggaaaaccctgcggtacccaactaatcgcc

SEQ ID NO: 62308 - protein, 56 aa, Zea mays; identical to SEQ ID NO: 61818
  misc_feature: Ceres CLONE 1527230

SEQ ID NO: 62309 - DNA, 617 bp, Zea mays
  misc_feature: Ceres CLONE 1527239
  misc_feature: Encodes the peptide sequence at SEQ ID NO. 62310
  misc_feature (248)..(248): n is a, c, t, g, unknown, or other
  misc_feature (343)..(343): n is a, c, t, g, unknown, or other
aaagctggagctccccgcggtggcggccgctctagaactagtggatcccccgggctgcaggaattcgtctcacccctagaaaaaaagcagagtgtgtcattggaagagagacgacggcggccatggcgacctccttccaggggacgaccaccaagtgcaccgcctgcgacaagacggtgtaccttgtggacaagctcaccgccgactaccgcatctaccacaaggcctgcttctgctgccaccactgncagggcaccctcaagctcgtccactacgactacttcgagggagtgctctactgcacgcctcacttgaccagcatgtctagaggatcgggagcttngactagagcttccaagggactccgaatgttgttaagacggaaagaaaattttggaattaaaagctactaaaaactcaagcgcctttcttggccacaaagaaaagttttggattcaccagaaaaatctttccactttaaagggtcctgtttaaaacccttttttgccccaaagcctgttttcacgggttcccctgggagggggaccccaaacccctttaaaaacctttggccccaagggggaatttttttttagaaaaccccccccttttgcttg

SEQ ID NO: 62310 - protein, 96 aa, Zea mays
  misc_feature: Ceres CLONE 1527239
  misc_feature (12)..(67): Pfam Name: LIM Pfam Description: LIM domain
  misc_feature (42)..(42): Xaa is any aa, unknown, or other
  misc_feature (74)..(74): Xaa is any aa, unknown, or other
MATSFQGTTTKCTACDKTVYLVDKLTADYRIYHKACFCCHHXQGTLKLVHYDYFEGVLYCTPHLTSMSRGSGAXTRASKGLRMLLRRKENFGIKSY

SEQ ID NO: 62311 - DNA, 712 bp, Zea mays
  misc_feature: Ceres CLONE 1527243
  misc_feature: Encodes the peptide sequence at SEQ ID NO. 62312
  misc_feature (407)..(407): n is a, c, t, g, unknown, or other
  misc_feature (510)..(510): n is a, c, t, g, unknown, or other
  misc_feature (607)..(607): n is a, c, t, g, unknown, or other
gctcttgaactagtggatcccccgggctgcaggaattcgtctcacccctagaaaaaatctcgcccgccgttttcgtccttatcgatctcctcgcacctcgtggcggcacctctccccttcgatccaccaagggtttaggatcggcggcgatggcggcgaggctggcacagctgcgcgctcaggcggtgcaggcggcggagttcgcctcgaagcacggcggctcctactacaaggagctcatggagaagaacaagcagtacgtcgtgcagccccccaccatcgagaaatgccaggagctctccaagcagctcttctacacccgcctcgcaagcctaccaggtcggtatgagtcattctggaaggagcttgatggtgtcaagcaggtatggaagaacaggaaggacctncagggtgaggaccttgggattgcgactttatttggagttgagctttatgcatggttctgcgtaggcgaagatgttgggcagaggtttcaccttaccggctatnaggtctagttgatttccagtggattaagacctgctttataaatcgacactttagctgatgcttgtcgaacgacgatgatacctgccctccctcacanttttgtttcctgttagagtctacctagtgctgaatgccagcaagacgggcacatgggtgcacattgcctcaatatttgcccgcgcattcttgattttgatgctga

SEQ ID NO: 62312 - protein, 122 aa, Zea mays
  misc_feature: Ceres CLONE 1527243
  misc_feature (8)..(122): Pfam Name: ATP-synt_G Pfam Description: Mitochondrial ATP synthase g subunit
  misc_feature (121)..(121): Xaa is any aa, unknown, or other
MAARLAQLRAQAVQAAEFASKHGGSYYKELMEKNKQYVVQPPTIEKCQELSKQLFYTRLASLPGRYESFWKELDGVKQVWKNRKDLQGEDLGIATLFGVELYAWFCVGEDVGQRFHLTGYXV

SEQ ID NO: 62313 - DNA, 728 bp, Zea mays
  misc_feature: Ceres CLONE 1527247
  misc_feature (325)..(325): n is a, c, t, g, unknown, or other
  misc_feature (453)..(453): n is a, c, t, g, unknown, or other
  misc_feature (643)..(643): n is a, c, t, g, unknown, or other
  misc_feature (707)..(707): n is a, c, t, g, unknown, or other
ttagctggagctcaccgcggtggcggccgctctagaactagtggatcccccgggctgcaggaattcgtctcacccctagaaaaactctttctcttagactatctgccgctccagcctttcgctagggtttatccaccggcggcgcgcgcgacggcggcaagatggtgcagcgtctgacctaccgcaagcgggacagctatgccacgaagtccaaccagacgcgggtcgtccaagacccctggtggcgagctcgtagtacaagtcacctgtgaagatagttagtgggtcctagcgttcccatgaaccagaaaaaaaaaaccagggnatctccctttcctgtagggcggctgtattagaaaagagacccagcctccccccccgtaccaccaccacgcccccccacccgctccctactgtttgtagttacgtggggccccccccgccggccccacncaacgcggccccacgcgcggccctgcgctcgcctcgacccaacatagcccagtgcgcccggccactgggcttcgacctgcgtccatccgcccccattagctaatgctcccgcactcctctctcccccccccccgccgcccgcccgacgggcccacccccccctcttcctcaccccacccccccgaccccntcccctctccgccctaccacccgctcacccaacccgcgtccgacccccccccttcgcctccgcnccgccgcatcccgcacccccc

SEQ ID NO: 62314 - DNA, 670 bp, Zea mays
  misc_feature: Ceres CLONE 1527249
  misc_feature: Encodes the peptide sequence at SEQ ID NO. 62315
agagctggagctccccgcggtggcggccgctctagaactagtggatcccccgggctgcaggaattcgtctcacccctagaaaaaatctctcactcgctagcactagcatagtcgtctctttcttttctgcttccagacattgtccacacgagctagtgcactggtgtcgctcgcaaccaaattaaggacgtactgagccatggcatccaagggcgtcctcttcttggctctcaacctcctgttcttcacagtggccaacgcctgcggcagctgcccgaccccaacgccgccggtcgtgccaccgccgccgcctccttctgctaccccacccccttcatcctccagtgggaagtgcccgctgaacgcgctcaagttcggcgtgtgcgtcaatgtgctcggcctcgtcaaaggcgaggctggcaaggtacctgccgagccatgctgcaacctcatcaaaggccttgcagacttcgaggccgccgtttgcctctgcaccggcatcaagggcaacgtcctccgcgtcgtcttcaatgtccctatcaagtccatggcctccccaactactgtggaaagggcgtgcccaagggctacatggttgcgaaagctccccccggtaaacctcccaacccgtccgcgggcgaaataaaccaggcccctgctgggcaacatg

SEQ ID NO: 62315 - protein, 148 aa, Zea mays
  misc_feature: Ceres CLONE 1527249
  misc_feature (52)..(127): Pfam Name: Tryp_alpha_amyl Pfam Description: Protease inhibitor/seed storage/LTP family
MASKGVLFLALNLLFFTVANACGSCPTPTPPVVPPPPPPSATPPPSSSSGKCPLNALKFGVCVNVLGLVKGEAGKVPAEPCCNLIKGLADFEAAVCLCTGIKGNVLRVVFNVPIKSMASPTTVERACPRATWLRKLPPVNLPTRPRAK

SEQ ID NO: 62316 - DNA, 725 bp, Zea mays
  misc_feature: Ceres CLONE 1527254
  misc_feature: Translation starting site: 169
  misc_feature: SWISSPROT Homolog: EC 3.2.1.23 Beta-galactosidase
  misc_feature (561)..(561): n is a, c, t, g, unknown, or other
  misc_feature (674)..(674): n is a, c, t, g, unknown, or other
  misc_feature (681)..(681): n is a, c, t, g, unknown, or other
  misc_feature (688)..(688): n is a, c, t, g, unknown, or other
gcggtggcggccgctctagaactagtggatcccccgggctgcaggaattcgtctcacccctagaaaaaattccttcgcttccgtcaggtcgggtccgcagcctccccctctcgcagatccccacctgctcctccgccggccaccgcgttgctcccctcggcagccaggatgacagaagtaccatttctgccgcgtgagaggctcttcaagcagcaacattacttccagaacttgaccaagcacacctacctgaaagggcgctacgacgtgatcacctccgtcgccatcccccttgcactcgctgcctccagcatgttcatgattgggcgtggagtttacaacatgtctcatggggttgggaagaaagagtgatcttccactggttaactattgtttctgcttggcatggaagtcataccgtcgagactgcgaagtcctcttcgcttgcaaataatacggccaaataacaattcgactacattttcgcatcaattttctgtttgtatttgtgggtgtgaagtggcagtaacttgaaaatcagcactgtcactggtttgggtnaaaaaaaaaaaaaaacgagacgctcgaggtaccccattcgccctatagtgagtcgtattacgcgcgctcactggccgtcgtttttacaacgtcgtgactgggaaaaccctggncgtaccnaacttantcggcttgcagcacttccccctttcggcagctggcgt

SEQ ID NO: 62317 - DNA, 704 bp, Zea mays
  misc_feature: Ceres CLONE 1527257
  misc_feature: Encodes the peptide sequence at SEQ ID NO. 62318
  misc_feature (57)..(57): n is a, c, t, g, unknown, or other
  misc_feature (79)..(79): n is a, c, t, g, unknown, or other
  misc_feature (704)..(704): n is a, c, t, g, unknown, or other
aaagctggagctccccgcggtggcggccgctctagactagtggatcccccgggctgncaggattcgtctcacccctagnaaggtcgctcggtccaccacctcagctccgccgcttgcccgcttttgctctctccctcccggctctcggcttcttctacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggcccccccccatgagaagtacaaggaccaaagctttgaaatcctggctttcccatgcaaccagttttggtgggcaggagcctggtaccaaatgaggagattgtccagtttgcctgcacacgctttcaggctgagaaccccatcttccacaaagttgaatgtcaacggtaacaaagcttgcgccccatcctaaaactccctggaaatccaaccaaaagggggcctttttcggcgaaacgcaatcaaggtgaaaattttttccaaagtcctttgggctgaacaaggaaaggaaccttgtttgttcan

SEQ ID NO: 62318 - protein, 115 aa, Zea mays
  misc_feature: Ceres CLONE 1527257
  misc_feature (10)..(111): Pfam Name: GSHPx Pfam Description: Glutathione peroxidase
  misc_feature: SWISSPROT Homolog: EC 1.11.1.12 Phospholipid-hydroperoxide glutathione peroxidase
MAASSTATSVHDFIVKDASGKDVDLSTYKGKVLLIVNVASQCGLTNSNYTELAPPHEKYKDQSFEILAFPCNQFWWAGAWYQMRRLSSLPAHAFRLRTPSSTKLNVNGNKACAPS

SEQ ID NO: 62319 - DNA, 692 bp, Zea mays
  misc_feature: Ceres CLONE 1527260
  misc_feature: Encodes the peptide sequence at SEQ ID NO. 62320
tccccgcggtggcggccgctctagaactagtggatcccccgggctgcaggaattcgtctcacccctagaaaaagagacgaggaggggcacaccacgcaggagaccggaggagagcgcgcgcgcggatccacctcgatgttggcaagaccatcagcaccgcctttggtgactgctcaaactcctgaagtcggcatcttcattacagctcgcaacgtctcgggtgcactggtcgccaagcttcctggtaacaaaaacaagtgtggaggaagatcgaatgtccggcagcggaacatcctacctgaggaaaaggggctgtcgtccaggagtggcgggcgctctcagcaactgaccaagcgcacgcttctaccctggacgtaaatgaggagtgcatacggggcgcacactccatttgggttcctccagccaacaccccgaggaagaggctgaaaaaaagccgtttggttgggacccactcccccgtacttggatcggagcaaaagggaaaaaggaaggttccccacccgccaaaggcggaaaccttggaatgctggaactaaatccaagaaaccctggggctttgtcagaacaaaaaacccttggggaaggggtggctaaaaaaaattctcccccaagggttccttgggggggccacccccccacacggcaaaggggaaggccccaaaatggtgggc

SEQ ID NO: 62320 - protein, 80 aa, Zea mays
  misc_feature: Ceres CLONE 1527260
MLARPSAPPLVTAQTPEVGIFITARNVSGALVAKLPGNKNKCGGRSNVRQRNILPEEKGLSSRSGGRSQQLTKRTLLPWT

SEQ ID NO: 62321 - DNA, 618 bp, Zea mays
  misc_feature: Ceres CLONE 1527262
  misc_feature: Encodes the peptide sequence at SEQ ID NO. 62322
ctggagctccccgcggtggcggccgctctagaactagtggatcccccgggctgcaggaattcgtctcacccctagaaaaactccaccacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacgggccactaccgcccccccaactgggccgccgccgtcgaccccgccgacctccgcgccgctcacctcgcccgcacctacgcccgggcctgagcggccccggctcccttcaccctgctccggctcgtctcgtatgacatacgccgcaccgtacgtaccagggggaaacaaagtgaggggtccggggttcttgaggcgaaacgccgtgttgagccacccccccggtgc

SEQ ID NO: 62322 - protein, 95 aa, Zea mays
  misc_feature: Ceres CLONE 1527262
  misc_feature (1)..(89): Pfam Name: LEA_3 Pfam Description: Late embryogenesis abundant protein
MALSLSGTSARFALASLVPRARAYAASAASGAMRRAAEGAAAGEAKEAGRAAAAAAEGSWVPDPVTGHYRPPNWAAAVDPADLRAAHLARTYARA

SEQ ID NO: 62323 - DNA, 705 bp, Zea mays
  misc_feature: Ceres CLONE 1527269
  misc_feature: Encodes the peptide sequence at SEQ ID NO. 62324
  misc_feature (477)..(477): n is a, c, t, g, unknown, or other
tccccgcggtggcggccgctctatacctagtggatcccccgggctgcaggaattcgtctcacccctagaaaaatcacgcagctttagtcccatctctcaaaccatccgaccccacctcgccgctcactcccaagccagtccctgccggcagcgatggcccgcacgaagcagacggcgcgcaagtcgacgggcggcaaggcgccgcggaagcagctggcgacgaaggcggcgcgcaagtcggcgccggccacggggggcgtgaagaagccgcaccgcttccgcccgggcaccgtggcgctgcgggagatccgcaagtaccagaagagcacggagctgctgatccggaagctgccgttccagcggctggtgcgggagatcgcgcaggacttcaagacggacctccggttccagtcctccgccgtggccgcgctgcaggaagccgccgaagcctacctcgtgggcctcttcgaggacacnaacctctgccgcctccagcgcaaacgggtcaccctcatggccaaagaacatccagctccgcccgccgcatccgggggggaaagggcctgagcaccccccggccctgctggggtccccttccctttctgaattccggaaccgccaaaaaactactggaataagggaaagaacctccccctggttaaattggggggtggggggaaagaaaaacaaagaaaggtgcgggtg

SEQ ID NO: 62324 - protein, 137 aa, Zea mays
  misc_feature: Ceres CLONE 1527269
  misc_feature (58)..(131): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCRLQRKRVTLMAKEHPAPPAASGGERA

SEQ ID NO: 62325 - DNA, 704 bp, Zea mays
  misc_feature: Ceres CLONE 1527277
  misc_feature: Encodes the peptide sequence at SEQ ID NO. 62326
caaagctggagctccccgcggtggcggccgctctagaactagtggatcccccgggctgcaggaattcgtctcacccctagaaaaaactgctactcctacatcgatcagtgctgtgtagacaagaaaagcgggcagcttcgttcaaccccgagaaagcttggagccagagcagggggggcgaagagacgatggtcgggatcttctccaggttctccgccggcgcccaccgccgctccaagagcgtggccgaggctgtcgagacgctggcccccaacataagtacaggagaatctgacccagcggcagctgttcctgcggagagcccccatggcatcgaggttggtgttgagttccaagccagtggagcgccccgtggaacctatcaatcttgatgagccagtgaaatgcccccttcctgagccgcctatactgcacaaccgggaggatatggaaaggagaaaatgtctttcatccgccccaagggtgaaaaacagactttgccgggtccgtgaagggaaggggccccacactgggaacccggacgggaaccaaggggcttagggtccacgagtcttggaattttctcaggggggccccattaaatggccccctccctttaaacgcggcctcccggggccaaaaaacattctctaagcgcgttccccttatgaccccagagcgcggaacactttctctccctgggg

SEQ ID NO: 62326 - protein, 67 aa, Zea mays
  misc_feature: Ceres CLONE 1527277
MVGIFSRFSAGAHRRSKSVAEAVETLAPNISTGESDPAAAVPAESPHGIEVGVEFQASGAPRGTYQS

SEQ ID NO: 62327 - DNA, 635 bp, Zea mays
  misc_feature: Ceres CLONE 1527279
  misc_feature: Encodes the peptide sequence at SEQ ID NO. 62328
atagctggagctccccgcggtggcggccgctctagaactagtggatcccccgggctgcaggaattcgtctcacccctagaaaaaaaaccctagccgcctgcctctcctcctcaagagctcgtcgccaccggccaccgccaccctcgatcacgccgtccgtcgaggtaaggtcagcatggtgagggtcagtgtgctcaacgatgcgctcaagtccatgtacaacgctgagaagatcggcaagaggcaggtcatgatcaggccgtcgtccaaggtcatcatcaagttcctgacggtcatgcagcgccacggctacattggagagttcgagtacgttgatgaccaccgatcgggcaagatcgtggtcgaactcaacgggaggctgaacaagtgcggcgtcatcagccctcgctttaatatcggcgtgaaagacattgagggatggactgcaaggctgctcccgtccaggcagttcggatacatcgtcctcacaacttcggcaggcatcatggaacacgaggaggcccgccggaagaacctaggaggcaaggttctaggtttctttcattgaaaaaacttaaaatcttttgttatgggctgcctgcctgtcttactctctcagactaaagtacctgtta

SEQ ID NO: 62328 - protein, 130 aa, Zea mays
  misc_feature: Ceres CLONE 1527279
  misc_feature (5)..(130): Pfam Name: Ribosomal_S8 Pfam Description: Ribosomal protein S8
MVRVSVLNDALKSMYNAEKIGKRQVMIRPSSKVIIKFLTVMQRHGYIGEFEYVDDHRSGKIVVELNGRLNKCGVISPRFNIGVKDIEGWTARLLPSRQFGYIVLTTSAGIMEHEEARRKNLGGKVLGFFH

SEQ ID NO: 62329 - DNA, 631 bp, Zea mays
  misc_feature: Ceres CLONE 1527281
  misc_feature: Encodes the peptide sequence at SEQ ID NO. 62330
  misc_feature (631)..(631): n is a, c, t, g, unknown, or other
aaagctggagctccccgcggtggcggccgctctagaactagtggatcccccgggctgcaggaattcgtctcacccctagaaaaaaacaccaactcgatcggtctgctagtgttggagagaagagaatacactacagtactacatggcgaagcagcagcagcagggcatggcggcagtggcgctggtagtgctggtggtgctggcggcgacggcggccgagacggcgtcggcggcttcgtgcaacgccgggcatgctggcggcgtgcgcgccggcgatcactgccggcgcgacgccctccgcgtcgtgctgctccaacctcaaggcgcagcaggggtgcttctgccagttcgtgaagaaccccacctacgggcgctacatcaacagccccaacgcgcgcaaggtcgtcgcctcctgcggcgtctccgtgccgcgctgctagtactagtacgtgtgctgtgcatgcatgtacgtgcgcacgtgggctgatcttcctgctttgtttcgtgtcttgccgcgcgccctcaggtgttttgtgtcaccttttctggttagccctctctacatgtgtactggccctcgtgtaccgctcccccataatccgtgtccgggtcgggctaattaatatatatn

SEQ ID NO: 62330 - protein, 62 aa, Zea mays
  misc_feature: Ceres CLONE 1527281
  misc_feature (2)..(62): Pfam Name: Tryp_alpha_amyl Pfam Description: Protease inhibitor/seed storage/LTP family
MLAACAPAITAGATPSASCCSNLKAQQGCFCQFVKNPTYGRYINSPNARKVVASCGVSVPRC

SEQ ID NO: 62331 - DNA, 712 bp, Zea mays
  misc_feature: Ceres CLONE 1527285
  misc_feature: Encodes the peptide sequence at SEQ ID NO. 62332
  misc_feature (622)..(622): n is a, c, t, g, unknown, or other
ggcggccgctctagaactagtggatcccccgggctgcaggaattcgtctcacccctagaaaaaaccgcgaccgggagagagtcagagagagacgcccgcctccagatcgtccggcggggatggcggcgtcggtctttccagcgctgctgctggccgtagcggcggtgcttctcctaccggtggcagaggccgtgtggctcgagctcccgccgtcggggaccaagtgcgtctccgaggagatccagcccaacgtcgtagtgctcgccgactacgctatcatgtacgagtcccaccccagctcgcatcccaccgtcgccgtcaaggttacatcaccctatggcaatactgtgcatcataatgaaaatgctacaacgggccagtttgcattcaccacttcagaagctggaaactaccttgcatgtttctggatagacagcgtggagaaaggatcaggaacatctctaaatcttgattggaaaatagggattgctgccaaggactggaatacatttgctaaaaagagaaaattgagggcgtagaactagaacttaggaaactggagctgcagcccagccctccttcctaactggctggatctccaagcagggaaagctaaatgcgnaacggggccgaaaaaaccaattcttaagttgcccgggttccaccccccgcctttgggaatttcgggttccccttcctgggctgaatttgg

SEQ ID NO: 62332 - protein, 139 aa, Zea mays
  misc_feature: Ceres CLONE 1527285
  misc_feature (56)..(121): Pfam Name: EMP24_GP25L Pfam Description: emp24/gp25L/p24 family/GOLD
MAASVFPALLLAVAAVLLLPVAEAVWLELPPSGTKCVSEEIQPNVVVLADYAIMYESHPSSHPTVAVKVTSPYGNTVHHNENATTGQFAFTTSEAGNYLACFWIDSVEKGSGTSLNLDWKIGIAAKDWNTFAKKRKLRA

SEQ ID NO: 62333 - DNA, 685 bp, Zea mays
  misc_feature: Ceres CLONE 1527287
  misc_feature (48)..(48): n is a, c, t, g, unknown, or other
  misc_feature (55)..(55): n is a, c, t, g, unknown, or other
  misc_feature (220)..(220): n is a, c, t, g, unknown, or other
  misc_feature (308)..(308): n is a, c, t, g, unknown, or other
  misc_feature (310)..(310): n is a, c, t, g, unknown, or other
ccaggctggagctcaccgcggtggcggccgctctagaactagtggatnccccggnctgcaggaattcgtctcacccctagaaaaagatccaagaactcgctcgcgcgcacggacagggccggaacccagggatcgagactgaacagcagtccgagacgccatgaacgtggaggaggaggtcgggaggctcaaggaggagatccataggctcggccagcancagcccgatggctcttacaagggcaagtttggcgtcctctccaacgacgaccggtgtgcatatttctttgcaccaagagagaggaacncnaagggccccccaaatttagaagatcttggacctacgaaggggaagctgcttttttttttcccccccccccagcggagggggagggggggtttttctccccccccctttttttcccccccctcgttgggagcgaaagagcaaacccccggccggccgcccgcgccgagatctttgtgttccctccgccccggcccaggcccgggcggcggaatccgcgcacaacgacacggcggtgcctcacaacaacgggtcatcctggggtccatcccagggcgcgcagtaccaacccgagctcgtcccccgcaccaaggcaaagcgggggcgggccccctaccgtgcgccctcgccccaaggagcccgggggcccgccccgcc

SEQ ID NO: 62334 - DNA, 719 bp, Zea mays
  misc_feature: Ceres CLONE 1527294
  misc_feature: Encodes the peptide sequence at SEQ ID NO. 62335
  misc_feature (322)..(322): n is a, c, t, g, unknown, or other
  misc_feature (397)..(397): n is a, c, t, g, unknown, or other
  misc_feature (400)..(400): n is a, c, t, g, unknown, or other
  misc_feature (445)..(445): n is a, c, t, g, unknown, or other
  misc_feature (450)..(450): n is a, c, t, g, unknown, or other
  misc_feature (619)..(619): n is a, c, t, g, unknown, or other
  misc_feature (643)..(643): n is a, c, t, g, unknown, or other
  misc_feature (670)..(670): n is a, c, t, g, unknown, or other
  misc_feature (671)..(671): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
acagctggagctccccgcggtggcggccgctctagaactagtggatcccccgggctgcaggaattcgtctcacccctagaaaactcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgggggaagtttgctgtgaagagaaaagcngttggaatttgggggtgcaaggactgtgggaatgtgaaccctcggggggggggggggggggaacactggttaatnccntccccccccccggaccaccgatcccgcccccggaggggacgaggnttggnaggcggggaagaggctctttttaataaatggggggttcccctgaagattgcctcctggccagggcaagtgttggggggggccctattcctttgggaaaaggggggaaagccgggggccgggcggtttgttcgaaaaacaaagggtccgtaaaataggggtgaagggggnctagggaagcggaaagtggttggnatagaatttgcccgtgcgcggccccgnntcgaaggatcggnnncggggagtggtgtttgtccccgagagaagcagg

SEQ ID NO: 62335 - protein, 143 aa, Zea mays
  misc_feature: Ceres CLONE 1527294
  misc_feature (2)..(95): Pfam Name: Ribosomal_L37ae Pfam Description: Ribosomal L37ae protein family
  misc_feature (76)..(76): Xaa is any aa, unknown, or other
  misc_feature (94)..(94): Xaa is any aa, unknown, or other
MTKRTKKAGIVGKYGTRYGASLRKQIKKMEVSQHSKYFCEFWGKFAVKRKAVGIWGCKDCGNVNPRGGGGGEHWLXPSPPPDHRSRPRRGRGLXGGEEALFNKWGVPLKIASWPGQVLGGALFLWEKGGKPGAGRFVRKTKGP

SEQ ID NO: 62336 - DNA, 618 bp, Zea mays
  misc_feature: Ceres CLONE 1527296
  misc_feature: Translation starting site: 171
  misc_feature (329)..(329): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (352)..(352): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (376)..(376): n is a, c, t, g, unknown, or other
  misc_feature (379)..(379): n is a, c, t, g, unknown, or other
  misc_feature (470)..(470): n is a, c, t, g, unknown, or other
  misc_feature (472)..(472): n is a, c, t, g, unknown, or other
  misc_feature (476)..(476): n is a, c, t, g, unknown, or other
  misc_feature (477)..(477): n is a, c, t, g, unknown, or other
  misc_feature (586)..(586): n is a, c, t, g, unknown, or other
  misc_feature (587)..(587): n is a, c, t, g, unknown, or other
aaagctggagctccccgcggtggcggccgctctagaactagtggatcccccgggctgcaggaattcgtctcacccctagaaaaactcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcatttggnaaatttttnnngggggnnnnnanaaaggaaaatttttnnnnnnntgnggngtaaaaaaccttggggtttttaagggggggggaacttttttttccccccaccctaaaaaaaaatcccccccctagggggaaaaaaaaaaananaaanntcctcttttatattgggggggggcggggaagagcccgccccgggagggggggggggggggcgccccccctgagaggaggaaagaaccccctccccccccttcttttttnngggggaggccgcctccttttttttttttttg

SEQ ID NO: 62337 - DNA, 702 bp, Zea mays
  misc_feature: Ceres CLONE 1527297
  misc_feature: Encodes the peptide sequence at SEQ ID NO. 62338
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
aaagctggagctccccgcggtggcggccgctctagaactagtggatcccccgggctgcaggaattcgtctcacccctagaaaaaggatcggtgcctttccttcgtgatttactcactcaactcatgccaccctctcaaagtttcaaccgtgtgcccatcgcaataaaaatacaatcaataatagagaggggaggtagcaacaccggctgcttaatctcttccttttcttcttcctatctccagcgcatcccaagaggcggaaagggaggagcgtggagcggcgaattattgtttgtttccccaagatgtcttctccaagcaagcgccgggagatggacctcatgaagctgatgatgagcgactacaaggtggagatggtgaacgatgggatgcaggagttctttgttgaatttcgtgggcctaacgaaagtacggattattaacgcaaaaggacgatttaggttttgtttctatggtcgatgattctgtagctcctgatttatgatctatatagaccgaagtgcaagtcttcnnnnnnnannnnnnnnnnnnnnnnnnnnnnnnnnnnnnnnnnnnnnnnnnnnnnttnnnnnaaaaaaaaaaaccgagacgctcgaggtacccaattcgccctatagtgagtcgtattacgcgcgctcactggccgtcgttttacaccgtcgtgactgggaaaaccctggc

SEQ ID NO: 62338 - protein, 45 aa, Zea mays
  misc_feature: Ceres CLONE 1527297
  misc_feature: SWISSPROT Homolog: EC 6.3.2.19 Ubiquitin--protein ligase
MSSPSKRREMDLMKLMMSDYKVEMVNDGMQEFFVEFRGPNESTDY

SEQ ID NO: 62339 - DNA, 573 bp, Zea mays
  misc_feature: Ceres CLONE 1527299
  misc_feature: Encodes the peptide sequence at SEQ ID NO. 62340
ctccccgcggtggcggccgctctagaactagtggatcccccgggctgcaggaattcgtctcacccctagaaaaactctttcactcgcttctcccagaagtcacgcaccaaacaccaccaccaaagaaggcgagaacgctccccttcccctccagtctccaggaccgtctcctcgcctgctcatctaccgctgctccccttctctgggctcggagaatcggagagaagcgcgcgcgaccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaggcctcctagctaccgaggtgcagatgttttcctgcttgcatcctcacttgtgagccgagctagccttgagatatcatgaagaagtggattccagaccttcaacattatgccccctgg

SEQ ID NO: 62340 - protein, 98 aa, Zea mays
  misc_feature: Ceres CLONE 1527299
  misc_feature (10)..(99): Pfam Name: Ras Pfam Description: Ras family
MASSASRFIKCVTVGDGAVGKTCMLICYTSNKFPTDYIPTVFDNFSANVVVDGTTVNLGLWDTAGQEDYNRLRPPSYRGADVFLLASSLVSRASLEIS

SEQ ID NO: 62341 - DNA, 582 bp, Zea mays
  misc_feature: Ceres CLONE 1527300
  misc_feature: Encodes the peptide sequence at SEQ ID NO. 62342
  misc_feature (355)..(355): n is a, c, t, g, unknown, or other
  misc_feature (545)..(545): n is a, c, t, g, unknown, or other
aagctggagctccccgcggtggcggccgctctagaactagtggatcccccgggctgcaggaattcgtctcacccctagaaaaactctccgtgctttctcagaggcgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatngcgcagcgcccatccgagggccatgaaacggcaaaggaagcttccaacggggcccccaaacattccccccgtttttaaaaaagggggccccaattcccccccgcggccccccaaaagcggcgggggggaaaaaacgggggggggggccccccttttatgggaggggggccccccccccccggtgggcggnggtgggccccgcccccccaaagagagagggggggggc

SEQ ID NO: 62342 - protein, 87 aa, Zea mays
  misc_feature: Ceres CLONE 1527300
  misc_feature (10)..(74): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (62)..(62): Xaa is any aa, unknown, or other
MAASDVEYRCFVGGLAWATDDHSLNNAFSTYGEVLESKIILDRETQRSRGFGFVTFSTEDAXAQRPSEGHETAKEASNGAPKHSPRF

SEQ ID NO: 62343 - DNA, 691 bp, Zea mays
  misc_feature: Ceres CLONE 1527302
  misc_feature: Encodes the peptide sequence at SEQ ID NO. 62344
aaagctggagctccccgcggtggcggccgctctagaactagtggatcccccgggctgcaggaattcgtctcacccctagaaaaaagagctccctgctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggccatctgctgctgctgctagttctgcttggagggcatgggcgtccatcatcgtggagatgtggccatgcgggacacccaccgccgaataaatgctgtacttatatgcacgcacgttagaaatgcattagtgtctgtttgatgtgatcttgtgtgtgtgtgaaatgcattagtgtctgtttgatgtgatcttgtgtgtgtgcgcgcgcatcttcatttgcaccggaaaaatgctttgtgaaagtctgtaaaactgttggtatgtatcttgggcagaagaacctctattaatgcgccaaatatctccctttccattggacaaaaaaaaaaaaaaaccagacgcttcaaggtacccaattcgcccct

SEQ ID NO: 62344 - protein, 54 aa, Zea mays; identical to SEQ ID NO: 48310
  misc_feature: Ceres CLONE 1527302

SEQ ID NO: 62345 - DNA, 639 bp, Zea mays
  misc_feature: Ceres CLONE 1527314
ctccccgcggtggcggccgctctagaactagtggatcccccgggctgcaggaattcgtctcacccctagaaaaagcgagctctcatatcgagtgtacggtgaacactgaacagatatctcagggacctcttcaggatgctaggcagatccgcagcacatggaggagaagatcaagctgccggaggcgaacatcgacccggcggcacggccgttgggtgtcgactgcacaaccgacgaccactcacgtcgcagcaggctaagaccctacaagccagggctctcacgtcctcatcggccgcgatcggcagacgctgtaatgacagcggctcggcgtacggcaccttctccgctgaggaggaaactcgacaaccccatgggaggattcctacccctacgaggccatggagcccccactcaccctactaccatcgcaagctccccggtccacccctggaggcatcgacttcttgaacgggcgactcccgtggcatgccccttgaccactgaatgcctttcttcgttgttttcccttgctcagagttcccctttcggggccgtttatggatggagggaaagatacattggtggggaaaaaaaacctacaacctttgcaactaacgccaatgattaaacttcccc

SEQ ID NO: 62346 - DNA, 575 bp, Zea mays
  misc_feature: Ceres CLONE 1527325
  misc_feature: Encodes the peptide sequence at SEQ ID NO. 62347
  misc_feature (435)..(435): n is a, c, t, g, unknown, or other
  misc_feature (529)..(529): n is a, c, t, g, unknown, or other
ctggagctccccgcggtggcggccgctctagaactagtggatcccccgggctgcaggatattcgtctcacccctagaaaaaagccacttacctgcagtcaccactcccaagccagtacccacagtcctacgagcagtcgcacgcaagtgtcaagagacaaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggccccttcgcgtcctgctgtagcggcgtcaggaacctcaagagcgccgccagcacccgcccccaacgggggcgccgcctgcaactgccctcaagaaccccccccagggggngtcagcgggcctcaaagcccgggaaaccccccccaggcatcccccccccaaagggggggggtgcgggatccccccttaaacccattaaaaaacnttccccccaaaaggccccccagggggtaacactaaaacccctacac

SEQ ID NO: 62347 - protein, 135 aa, Zea mays
  misc_feature: Ceres CLONE 1527325
  misc_feature (89)..(89): Xaa is any aa, unknown, or other
  misc_feature (120)..(120): Xaa is any aa, unknown, or other
MARTQSAVAVAVVAAVLLLAAAATTSEAAITCGQVSSAIAPCLSYARGTGSGPFASCCSGVRNLKSAASTRPQRGRRLQLPSRTPPRGXQRASKPGKPPPGIPPPKGGGAGSPLKPIKKXSPQKAPQGVTLKPLH

SEQ ID NO: 62348 - DNA, 617 bp, Zea mays
  misc_feature: Ceres CLONE 1527326
  misc_feature (414)..(414): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
ctggagctccccgcggtggcggccgctctagaactagtggatcccccgggctgcaggaattcgtctcacccctagaaaaatccccacccacccacgccgacgagcaaaccctagcgagcgagagagcccggagccgagagaccagccagccatggcgctgcgtgccctgtacaacgagatccggagcatgaagggtccggcgacgtgccggcttacctgaagccgcgcttgacctgggacaacgtcaagaagagcgccgaccaggccgtcgaccgctacatcgagaagtacatcgacacgagctcgcccggaccccttttcttaccattgttcttgcttccggaagggaatgacctcctcctacttcgtcaattctggcctggggaagcggggcccagctttggcccacccttnaaggaagttgggnnnnttgacaggtgggagaacgcctgaatcccttttcccccgtccccctccccgggtagcgcgggaaggaacgggtggaacttttctggggggcccatttccagggcggaagggcttccggttttctcccccgcgggtagaaccctccctgggggaatgccccgggcgcaccctttttgggcccccttgtg

SEQ ID NO: 62349 - DNA, 672 bp, Zea mays
  misc_feature: Ceres CLONE 1527345
  misc_feature: Encodes the peptide sequence at SEQ ID NO. 62350
atagctggagctcaccgcggtggcggccgctctagaactagtggatcccccgggctgcaggaattcgtctcacccctagaaaaaaccacgcaaaaaacaaacacactcgaaggcagcgaagcccgagccttcccttccctccaatcgatcacccgcttcgatccgctagctagctagcagcgcgatggcttccctcaccgtgtccacgaagaccgcggcggccggcggcaacaagcagcgcgagggcgcggaggtcatcacgggcgcggaggcctgcttcgcgcactccaagcagatgctccaggcgctgggcttcccgggcggcgtgatgccgctgcgggggctggaggagtgcggctgggtgcgccagaccggggggggggggatgcggcagaaggccccctacgaacactacttccgcggcacgggcacgcgggtgcgctaccacgccgaggtccccgcgtacctggagaacggccggatgaaacccaatgaccggggtgcgccacaagcaggtcatgcctctggggggccccaccgtcaaaatgaaccctccaacggagaagaagcgcgacacaaattttactttcaagtcccaaagttcggggattgtggccccctcggtcccccccgccccccgcccttttccctgacgaaggacaaaatataaag

SEQ ID NO: 62350 - protein, 161 aa, Zea mays
  misc_feature: Ceres CLONE 1527345
  misc_feature (19)..(129): Pfam Name: DUF538 Pfam Description: Protein of unknown function, DUF538
MASLTVSTKTAAAGGNKQREGAEVITGAEACFAHSKQMLQALGFPGGVMPLRGLEECGWVRQTGGGGMRQKAPYEHYFRGTGTRVRYHAEVPAYLENGRMKPNDRGAPQAGHASGGPHRQNEPSNGEEARHKFYFQVPKFGDCGPLGPPRPPPFSLTKDKI

SEQ ID NO: 62351 - DNA, 607 bp, Zea mays
  misc_feature: Ceres CLONE 1527351
  misc_feature: Encodes the peptide sequence at SEQ ID NO. 62352
ctggagctccccgcggtggcggccgctctagaactagtggatcccccgggctgcaggaattcgtctcacccctagaaaaaatcctccaccacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacgggccactaccgccccgcctactggggccgcgccgtcgaccccgccgaacctcgcgccgctcaactcgcccgcacctacgcccggggctgaacggccccggctcccttcaccctgctccgcctcgtctcgtatgaattacgccgcaccgtacgtcccagggtgaaactaagggaagggtccggggttcttggggcaaacggcgttttaaccc

SEQ ID NO: 62352 - protein, 95 aa, Zea mays
  misc_feature: Ceres CLONE 1527351
  misc_feature (1)..(89): Pfam Name: LEA_3 Pfam Description: Late embryogenesis abundant protein
MALSLSGTSARFALASLVPRARAYAASAASGAMRRAAEGAAAGEAKEAGRAAAAAAEGSWVPDPVTGHYRPAYWGRAVDPAEPRAAQLARTYARG

SEQ ID NO: 62353 - DNA, 681 bp, Zea mays
  misc_feature: Ceres CLONE 1527352
  misc_feature: Encodes the peptide sequence at SEQ ID NO. 62354
aaagctggagctccccgcggtggcggccgctcctcactagtggatcccccgggctgcaggaattcgtctcacccctagaaaaagcctctcccgcgacccgtaccccgcctcccggttcaaccaaatccctcgcctcatccccaccagcgcaaagccgccctatcgtcctgtcgtgagaagcaatggcgggccgtggcaaggcgattggcgctggtgccgcgaagaaagcgacgtcaaggagctccaaggctgggcttgagttcccagtcgggaaggatcgcccgttttccccaaggccgggaaagcacgccttatgcgcgtggtttttctgtagccccgtagtccaccctcccccctagttcccttttttttttccccccccccccacaaaggggggggggggggggggggtttttttattccttttattaattttttaataacccctattttcccgcccgctaatttgtaaatttcctttttcccctcgctgtcttcagcaaactgaggatattttaatccgtttcttgttctgtggcggcggccctcccttccccctcttgcgggtgggtcatccctcccccgcaccaccgaaaatatgaatactcccccccccacctcccaatcacgcgtcatcaacgtctagttccccgccccagcgccccctactggcccggcccg

SEQ ID NO: 62354 - protein, 58 aa, Zea mays
  misc_feature: Ceres CLONE 1527352
MAGRGKAIGAGAAKKATSRSSKAGLEFPVGKDRPFSPRPGKHALCAWFFCSPVVHPPP

SEQ ID NO: 62355 - DNA, 655 bp, Zea mays
  misc_feature: Ceres CLONE 1527354
  misc_feature: Encodes the peptide sequence at SEQ ID NO. 62356
  misc_feature (571)..(571): n is a, c, t, g, unknown, or other
aaagctggagctccccgcggtggcggccgctctagaactagtggatcccccgggctgcaggaattcgtctcacccctagaaaaaatcttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaaaaacggcaagacggtcgcgaccatcgtgggtgccaggaaggacgaactcctggccctgatcgaaaaagctgcccgcgcctgcccctgccactgcctcttgcctaaatgaaatcaaatcagtccgccccccgtccataaggcccaccacgtatgggctgtnaaatgttggccgttatcaggttctgggcttttgccctttggggggccgctttcgggaacctaagcggcacggtgtggtttcccc

SEQ ID NO: 62356 - protein, 124 aa, Zea mays
  misc_feature: Ceres CLONE 1527354
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDAHMTKAQEAGKLVVIDFTAAWCGPCRAIAPLFVEHAKKFTQVVFLKVDVDEVKEVTAAYEVEAMPTFHFVKNGKTVATIVGARKDELLALIEKAARACPCHCLLPK

SEQ ID NO: 62357 - DNA, 586 bp, Zea mays
  misc_feature: Ceres CLONE 1527359
  misc_feature: Encodes the peptide sequence at SEQ ID NO. 62358
  misc_feature (111)..(111): n is a, c, t, g, unknown, or other
  misc_feature (112)..(112): n is a, c, t, g, unknown, or other
  misc_feature (424)..(424): n is a, c, t, g, unknown, or other
  misc_feature (425)..(425): n is a, c, t, g, unknown, or other
  misc_feature (437)..(437): n is a, c, t, g, unknown, or other
  misc_feature (475)..(475): n is a, c, t, g, unknown, or other
  misc_feature (527)..(527): n is a, c, t, g, unknown, or other
  misc_feature (549)..(549): n is a, c, t, g, unknown, or other
  misc_feature (550)..(550): n is a, c, t, g, unknown, or other
  misc_feature (565)..(565): n is a, c, t, g, unknown, or other
ggagctccccgcggtggcggccgctctagaactagtggatcccccgggctgcaggaattcgtctcacccctagaaaaaaagcaagaacagctgctcgatccaattggtcanncttgctctccctccaacaagctaattaaggccggtcatccctcttctagctcgtttcattatccatggcggaggagaagcaccaccaccaccaccctgttccaccacaagaaagggacgaaggagcagggagggagccagcctccccccgggcgggcggggttaacgggccaaaatccccccccccaaaatccccccgaaaggcccaccggtggaaccggaagggcctctggcccccccggggggaaaaaaaaaacccgaggttcccccaacccagggtccccccaaaaaagggggggggagaaaaaaaaannccacaaaaaaancccaaaaaaatacccccccccctgggggggaaaagggncccccgcgcgccccccctcttttcccgcgcggcccccacgggggaggagggnggccctcctcatctttctctcnnaaacacaacatactnagattacacacaaaaaagaag

SEQ ID NO: 62358 - protein, 195 aa, Zea mays
  misc_feature: Ceres CLONE 1527359
  misc_feature (37)..(37): Xaa is any aa, unknown, or other
  misc_feature (38)..(38): Xaa is any aa, unknown, or other
  misc_feature (142)..(142): Xaa is any aa, unknown, or other
  misc_feature (146)..(146): Xaa is any aa, unknown, or other
  misc_feature (159)..(159): Xaa is any aa, unknown, or other
  misc_feature (176)..(176): Xaa is any aa, unknown, or other
  misc_feature (184)..(184): Xaa is any aa, unknown, or other
  misc_feature (189)..(189): Xaa is any aa, unknown, or other
GAPRGGGRSRTSGSPGLQEFVSPLEKKQEQLLDPIGXXCSPSNKLIKAGHPSSSSFHYPWRRRSTTTTTLFHHKKGTKEQGGSQPPPGRAGLTGQNPPPQNPPERPTGGTGRASGPPGGKKKTRGSPNPGSPQKRGGEKKKXHKKXPKKYPPPWGGKGXPARPPSFPARPPRGRRXALLIFLSXTQHTXITHKKE

SEQ ID NO: 62359 - DNA, 718 bp, Zea mays
  misc_feature: Ceres CLONE 1527474
  misc_feature: Encodes the peptide sequence at SEQ ID NO. 62360
  misc_feature (396)..(396): n is a, c, t, g, unknown, or other
  misc_feature (592)..(592): n is a, c, t, g, unknown, or other
acccgcggtggcggccgctctagaactagtggatcccccgggctgcaggaattcgtctcacccctagaaaaataactatatattataattaaaaatttgggtcactgatatcaatgtgtaaaacatcacttatttgcagctaaatggagtatatcattactatacctttgtctttttatatttatataaaaacacaatcgaatggagtccattcgtttcattgaacttgtctttgatgctatgaatgtttagtcacatgtagcagtttatgccctggtgtattaagagggtgcactaactgtgcttgttgattccctgttttctattaagtctaagttctgtttatatggatttttgtatgtatgattgcattgttctttgtatgaagctgcatantgcgaggcgatgtctagtcagcacggaccatactatgactagaggacctcacctattgatccccaggctgtgtatgcaagtggtggaaaagctcatggaaagtacaccatgtttgctaacgtcatcgacttgagcaaggtgagggttcagcgtggaggtttgtcgaagtctgctgctcgaacctcccgtcgctcantcaaaatcccacaaaatggaaccactgcccaaaaaactaagcaaaaccccttccctaggggaagtacaaccatcctcccccttggaacccaagggggatcaaaaacagagactccccggtttttgg

SEQ ID NO: 62360 - protein, 60 aa, Zea mays
  misc_feature: Ceres CLONE 1527474
  misc_feature (17)..(17): Xaa is any aa, unknown, or other
MDFCMYDCIVLCMKLHXARRCLVSTDHTMTRGPHLLIPRLCMQVVEKLMESTPCLLTSST

SEQ ID NO: 62361 - DNA, 671 bp, Zea mays
  misc_feature: Ceres CLONE 1527477
  misc_feature: Encodes the peptide sequence at SEQ ID NO. 62362
  misc_feature (432)..(432): n is a, c, t, g, unknown, or other
  misc_feature (601)..(601): n is a, c, t, g, unknown, or other
  misc_feature (603)..(603): n is a, c, t, g, unknown, or other
tggcggccgctctagaactagtggatcccccgggctgcaggaattcgtctcacccctagaaaaaagcagagtgtgtcgttgcggaggcaggaagagagacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttccaaggaactcccaaggttgtcaagccagaaagaaacgttgggaatgagaatgctactaaagtctcaagcgcctttgctggcaccaaanagaaatgtgttggatgcaacaagacagtctatccaactgagagggtcactgttaacaacactatgtaccacaagagctgcttcaagtgctgccatggagggtgcaccatcagcccttctaactactttgcgcacgaggggaagctgtactgcaagcaccaccacatccngntgatcaaggagaaggggaccttcagccggcttgaaaatgaccacaaaaaaaatcacaggctgggtcat

SEQ ID NO: 62362 - protein, 187 aa, Zea mays
  misc_feature: Ceres CLONE 1527477
  misc_feature (110)..(166): Pfam Name: LIM Pfam Description: LIM domain
  misc_feature (12)..(68): Pfam Name: LIM Pfam Description: LIM domain
  misc_feature: SWISSPROT Homolog: EC 2.7.11.1 Non-specific serine/threonine protein kinase
  misc_feature (108)..(108): Xaa is any aa, unknown, or other
  misc_feature (164)..(164): Xaa is any aa, unknown, or other
  misc_feature (165)..(165): Xaa is any aa, unknown, or other
MATSFQGTTTKCTACDKTVYLVDKLTADNRIYHKACFRCHHCKGTLKLANYNSFEGVLYCRPHFDQLFKRTGSLDKSFQGTPKVVKPERNVGNENATKVSSAFAGTKXKCVGCNKTVYPTERVTVNNTMYHKSCFKCCHGGCTISPSNYFAHEGKLYCKHHHIXXIKEKGTFSRLENDHKKNHRLGH

SEQ ID NO: 62363 - DNA, 705 bp, Zea mays
  misc_feature: Ceres CLONE 1527485
  misc_feature: Encodes the peptide sequence at SEQ ID NO. 62364
  misc_feature (674)..(674): n is a, c, t, g, unknown, or other
agagctggagctccccgcggtggcggccgctctagaactagtggatcccccgggctgcaggaattcgtctcacccctagaaaaagagccggaccaagtctcctcgtccctcacctcgtcgccgatggagggcggcgactcgtccggcgccggcgccggcggcgccgtggccgcggcggccaagtggcggagcgacgcgtctcgggcgttccagtactacctggaccgctcgacgcctcacgccacggggcggtggctcggtacgctcgccgccgcggccatctacgcgctgcgggtttacatggtgcagggcttctacgtcgtcacctacgggctcgggatctaccttctcaacctcctcatcggtttcctctcccgcgtggtcgaccccgagctcgacccttccgccgcctcctaggggccagctctgcgcaccctggggtccgacgagttcaagccattcatcaggcgcctccccgagttcaagtactggtatgacatcacaaaagcttttgttatagcttttgagatgactttcctcgtcgtggtttgacgtacctgtcttctggactatactactcggctagtggagtagtcttccttgtcattacaatgacccttcagattgtacatatgatcaaatcttatctgtgccctttcactatcggggagccnaaatatgcggggaagcacattgctgtgaccc

SEQ ID NO: 62364 - protein, 97 aa, Zea mays
  misc_feature: Ceres CLONE 1527485
  misc_feature (4)..(98): Pfam Name: Rer1 Pfam Description: Rer1 family
MEGGDSSGAGAGGAVAAAAKWRSDASRAFQYYLDRSTPHATGRWLGTLAAAAIYALRVYMVQGFYVVTYGLGIYLLNLLIGFLSRVVDPELDPSAAS

SEQ ID NO: 62365 - DNA, 754 bp, Zea mays
  misc_feature: Ceres CLONE 1527486
  misc_feature: Encodes the peptide sequence at SEQ ID NO. 62366
  misc_feature (379)..(379): n is a, c, t, g, unknown, or other
  misc_feature (386)..(386): n is a, c, t, g, unknown, or other
  misc_feature (434)..(434): n is a, c, t, g, unknown, or other
  misc_feature (447)..(447): n is a, c, t, g, unknown, or other
tggagctccccgcggtggcggccgctctagaactagtggatcccccgggctgcaggaattcgtctcacccctagaaaaagtccaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgancagaccnagtacaccggcatcgggtcccgcatcgagtacgccgtgtgcgcgctcnaggtggaggtccntcgtggtcattggccacagctgctgcggtggcatcagggccgctcctctccctctcaggacggcgcacctgacaactttcactttccttgaagactggggttaaagatcggcttcccctggcaagaattaaggtgaaagaagacccccgcctccgggtgccgttccaataaccaggtgctcctattctaaaaaaagggaggccggggaaccctgtccctggaaaacctcaaaaacctccccccttcttaaaggagaggctggggcaaagggaacctcaaagttggtcggggggccataaaaatttgg

SEQ ID NO: 62366 - protein, 127 aa, Zea mays
  misc_feature: Ceres CLONE 1527486
  misc_feature (31)..(125): Pfam Name: Pro_CA Pfam Description: Carbonic anhydrase
  misc_feature: SWISSPROT Homolog: EC 4.2.1.1 Carbonate dehydratase
  misc_feature (75)..(75): Xaa is any aa, unknown, or other
  misc_feature (78)..(78): Xaa is any aa, unknown, or other
  misc_feature (94)..(94): Xaa is any aa, unknown, or other
  misc_feature (98)..(98): Xaa is any aa, unknown, or other
MDDPVERLKDGFHKFKTEVYDKKPELFEPLKAGQAPKYVVFACSDSRVCPSVTLGLQPGEAFTVRNIAAMVPAYXQTXYTGIGSRIEYAVCALXVEVXRGHWPQLLRWHQGRSSPSQDGAPDNFHFP

SEQ ID NO: 62367 - DNA, 684 bp, Zea mays
  misc_feature: Ceres CLONE 1527487
  misc_feature (272)..(272): n is a, c, t, g, unknown, or other
  misc_feature (301)..(301): n is a, c, t, g, unknown, or other
  misc_feature (378)..(378): n is a, c, t, g, unknown, or other
  misc_feature (381)..(381): n is a, c, t, g, unknown, or other
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (405)..(405): n is a, c, t, g, unknown, or other
  misc_feature (473)..(473): n is a, c, t, g, unknown, or other
  misc_feature (483)..(483): n is a, c, t, g, unknown, or other
  misc_feature (515)..(515): n is a, c, t, g, unknown, or other
  misc_feature (521)..(521): n is a, c, t, g, unknown, or other
  misc_feature (574)..(574): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (669)..(669): n is a, c, t, g, unknown, or other
ctccccgcggtggcggccgctctagaactagtggatcccctgggctgcaggaattcgtctcagccttagaaaaattatcagccaagattatgagtttgattatgtcttcgactggacagttttgaaatacaaacaaggccacaaacaaaagcaaagtcctggggcacctattgctcgacctattcaagcacatggaccgaaacaagcaggtgtaaatggtgttattaatcataacgaagcccaggagcatgtaaagacaagtcgtccaacanggcaagctgcatggtcgcaagacaaacangcaaccaacaatgatcggaatcctgatgtgcggcataccgtgaatcttttccccccctcccggggggaggagggganctnacaacatctntnncctcttcctanttcccattggaaaaatatagcgattcaggacgtgaggaccatttgatcctgttcccccccatccgggnatttgaagcntaactacttcttctgacagttggtttcctatnttccgnccaaagtgccccagaaacggaccgacctcccctgcgggagcaaaaagaaatgnttcccagtttcaggggggccccggaacgcgacatcggcgccgcagaagcaaataccccacccgttttctcctcnnnnntttctgtaaacccaaanaacacaccccacaaa

SEQ ID NO: 62368 - DNA, 729 bp, Zea mays
  misc_feature: Ceres CLONE 1527489
  misc_feature: Encodes the peptide sequence at SEQ ID NO. 62369
  misc_feature (729)..(729): n is a, c, t, g, unknown, or other
ggagctccccgcggtggcggccgctctagaactagtggatcccccgggctgcaggaattcgtctcacccctagaaaaaaaaagcctcggtcacgacgcgcagtcgcccattccgcatctcgccctcccgtcccgtccgtccgttctccgattggccgccgcccgcctcgccctcctcgtcaacaaaagcccaccggaagcgagcgagcgagccaccctccccgccgccgccaccgcccccgtcccgcccccaccccgactcctcctgaccgccggcgtggggtgcccgggctccacctccggcgacgacaccctccccgccgcgtgcgcccccaccgcctgctccgtttgcgggggtagccggggctccggcctcggcggctttcaaagccccctccctcacaacaggatccaaaatcccgtcctagacttcttctacctcccctcccagaacttcctctttttgcatcccggacggtcgatctcgaccccttcgatttcgatccatctcttcttatcgattgatctttcctctaccttatttcggaaactggcattttgatcccttccttcttcccgccgccgggagttaattcccaattcccatcgaatcgactccccccggtttcgtggaattttctttcctccgtccgcccccggtttaagcccccgaaaaaaaaaaaatttttccccccccgccccaaaaaaaaaaaaaaaaaaaaacgccccn

SEQ ID NO: 62369 - protein, 186 aa, Zea mays
  misc_feature: Ceres CLONE 1527489
GAPRGGGRSRTSGSPGLQEFVSPLEKKSLGHDAQSPIPHLALPSRPSVLRLAAARLALLVNKSPPEASERATLPAAATAPVPPPPRLLLTAGVGCPGSTSGDDTLPAACAPTACSVCGGSRGSGLGGFQSPLPHNRIQNPVLDFFYLPSQNFLFLHPGRSISTPSISIHLFLSIDLSSTLFRKLAF

SEQ ID NO: 62370 - DNA, 707 bp, Zea mays
  misc_feature: Ceres CLONE 1527491
  misc_feature: Encodes the peptide sequence at SEQ ID NO. 62371
  misc_feature (504)..(504): n is a, c, t, g, unknown, or other
tacccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgacatggatatgattattatctatctagcttgtggtgggtggtgaacaataataagcgaggccgagctggctgcatacataggtattgtgtggtgtgggtgaaaaagagagaaacngagtcttcaggttgctatctctctccgcatggtttggcgtcagcctttgggctcatgtacctaccgtgggccacctgcagtgttggtgaacccattggctccgcgtgaaccattaattaattgggccccgaaagatggatttggaaccaataataaccaaaacccgagttccaaaaaaaaaaaaaaacgaaaccccccggggc

SEQ ID NO: 62371 - protein, 76 aa, Zea mays; identical to SEQ ID NO: 8464
  misc_feature: Ceres CLONE 1527491
  misc_feature (1)..(76): Pfam Name: Metallothio_2 Pfam Description: Metallothionein

SEQ ID NO: 62372 - DNA, 715 bp, Zea mays
  misc_feature: Ceres CLONE 1527493
  misc_feature: Encodes the peptide sequence at SEQ ID NO. 62373
  misc_feature (405)..(405): n is a, c, t, g, unknown, or other
  misc_feature (413)..(413): n is a, c, t, g, unknown, or other
  misc_feature (431)..(431): n is a, c, t, g, unknown, or other
  misc_feature (438)..(438): n is a, c, t, g, unknown, or other
  misc_feature (469)..(469): n is a, c, t, g, unknown, or other
  misc_feature (472)..(472): n is a, c, t, g, unknown, or other
  misc_feature (483)..(483): n is a, c, t, g, unknown, or other
  misc_feature (484)..(484): n is a, c, t, g, unknown, or other
  misc_feature (498)..(498): n is a, c, t, g, unknown, or other
  misc_feature (514)..(514): n is a, c, t, g, unknown, or other
  misc_feature (515)..(515): n is a, c, t, g, unknown, or other
  misc_feature (521)..(521): n is a, c, t, g, unknown, or other
  misc_feature (523)..(523): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (579)..(579): n is a, c, t, g, unknown, or other
  misc_feature (580)..(580): n is a, c, t, g, unknown, or other
  misc_feature (588)..(588): n is a, c, t, g, unknown, or other
  misc_feature (599)..(599): n is a, c, t, g, unknown, or other
  misc_feature (667)..(667): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (682)..(682): n is a, c, t, g, unknown, or other
  misc_feature (694)..(694): n is a, c, t, g, unknown, or other
  misc_feature (707)..(707): n is a, c, t, g, unknown, or other
ccacgctggagctcaccgcggtggcggccgctctagactagtggatttcttgggctgcaggaattcgtctcacccctagaaaaaaaaaggcagcacactcagctatccagcaaaagagatcgagacgcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcttgtccaggggggggaccgggctgagcctcgggttctgnaacacccncctggggtggatcctccnggggggngcggcctcaactggtccctctgccgcagttnggngtcggacctgnnccgggacgaggaancccggaggcctcccgnntctggnangaacccnnntccgtttattttgtttttatctcgcatcagggggggtgggccaccgnngggagtanaataacatggngtactcgacgcgccaagctcccggcccggcgcccgggccggcctgctgcgcgtaagacggatagaaanngnnttaaaaaagtnaccatattgcgnagattcttgtganaacgatca

SEQ ID NO: 62373 - protein, 172 aa, Zea mays
  misc_feature: Ceres CLONE 1527493
  misc_feature (1)..(127): Pfam Name: PsbW Pfam Description: Photosystem II reaction centre W protein, PsbW
  misc_feature (90)..(90): Xaa is any aa, unknown, or other
  misc_feature (93)..(93): Xaa is any aa, unknown, or other
  misc_feature (99)..(99): Xaa is any aa, unknown, or other
  misc_feature (112)..(112): Xaa is any aa, unknown, or other
  misc_feature (113)..(113): Xaa is any aa, unknown, or other
  misc_feature (116)..(116): Xaa is any aa, unknown, or other
  misc_feature (117)..(117): Xaa is any aa, unknown, or other
  misc_feature (121)..(121): Xaa is any aa, unknown, or other
  misc_feature (127)..(127): Xaa is any aa, unknown, or other
  misc_feature (129)..(129): Xaa is any aa, unknown, or other
  misc_feature (130)..(130): Xaa is any aa, unknown, or other
  misc_feature (132)..(132): Xaa is any aa, unknown, or other
  misc_feature (133)..(133): Xaa is any aa, unknown, or other
  misc_feature (149)..(149): Xaa is any aa, unknown, or other
  misc_feature (151)..(151): Xaa is any aa, unknown, or other
  misc_feature (155)..(155): Xaa is any aa, unknown, or other
MATVSAAVVTTIVARAAIARPNALGLPALRARSERVRCSYAKDAAPVSTKGAGASLLAAAGAVTASAGPALALVDERLSRGGTGLSLGFXNTXLGWILXGGAASTGPSAAVXXRTXXGTRXPGGLPXLXXTXXRLFCFYLASGGVGHRXEXNNMXYSTRQAPGPAPGPACCA

SEQ ID NO: 62374 - DNA, 669 bp, Zea mays
  misc_feature: Ceres CLONE 1527497
  misc_feature: Encodes the peptide sequence at SEQ ID NO. 62375
  misc_feature (354)..(354): n is a, c, t, g, unknown, or other
  misc_feature (355)..(355): n is a, c, t, g, unknown, or other
  misc_feature (533)..(533): n is a, c, t, g, unknown, or other
acccgcggtggcggccgctctagaactagtggatcccccgggctgcaggaattcgtctcacccctagaaaaactctccacgcagcgcgctcctcgatccccaacaggcaacagcccagccgctgtcgccctcgttccgtagtacggcgccgccagatcgtcagtcaccatgatcatctccaagaagaaccgccgcgagatctgcaaatacctcttccatgagggggtcttgtacgccaagaaggactacaacctggccaagcaccccaagcttgatgtgcccaacttggaggtgattaagctcatgcagagcttcaagtcgaaggagtatgtgagggataccttctcatggcannactactactggtacctcaccaacgatggcattgagcacctccgcagcttcctccacctgcccatcagaggttgggtgctatacccctcagaagtcttcccaagcccccggtctcggcccctcggctctgggcccacccggtgaccgccccaggggccctcctcgttatgaaggtgacnggcctaggtttggggaaaagggatggttaccaaaggagggccccgtgggcgctccgggggactttgggggggaaaaagggggggggggctcctggaaattttcccaaccccttttttttgggggggggcaaacccc

SEQ ID NO: 62375 - protein, 109 aa, Zea mays
  misc_feature: Ceres CLONE 1527497
  misc_feature (3)..(106): Pfam Name: S10_plectin Pfam Description: Plectin/S10 domain
  misc_feature (62)..(62): Xaa is any aa, unknown, or other
  misc_feature (63)..(63): Xaa is any aa, unknown, or other
MIISKKNRREICKYLFHEGVLYAKKDYNLAKHPKLDVPNLEVIKLMQSFKSKEYVRDTFSWXXYYWYLTNDGIEHLRSFLHLPIRGWVLYPSEVFPSPRSRPLGSGPTR

SEQ ID NO: 62376 - DNA, 727 bp, Zea mays
  misc_feature: Ceres CLONE 1527498
  misc_feature: Translation starting site: 266
  misc_feature (577)..(577): n is a, c, t, g, unknown, or other
  misc_feature (622)..(622): n is a, c, t, g, unknown, or other
aagctggagctccccgcggtggcggccgctctagaactagtggatcccccgggctgcaggaattcgtctcacccctagaaaaacactccccagaaggctcttctcctcctcgcctcctctccctagcctccacgacgcaagggagagtgacggaaagcgacgcggcgcgagcgaggagggccaaggggaagaaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgctccagacgacgcctacatccttgacgcagccgagactgccggtgtggagttgcatactcgtgccgtgctggggcttgctccacctgtgccnggcaaatcgagtctggttcggttgaccagtcggatgggtcctccnttgatgacggcagcaggaggaagggtatgtgctgacatgcgtctcctacccaagtccgactgcgtcatccacaccacaaggaagcgactgtactagggctagggc

SEQ ID NO: 62377 - DNA, 760 bp, Zea mays
  misc_feature: Ceres CLONE 1527499
  misc_feature: Encodes the peptide sequence at SEQ ID NO. 62378
aaagctggagctccccgcggtggcggccgctctagaactagtggatcccccgggctgcaggaattcgtctcacccctagaaaaagaggcgcggcgaggcgacggcggttggcgacctgatggcctcggtgcccagccgtgtttcgctctccgcggtgagccgcctcccgaatctccacgccgtggcaggagatacatctttcatttactagataagatgtccgactctttccattcctatggctctgacagcatctgccccacgcgcagctggccgcgtggttgatgccccagcagagataatctctgctgctcgccattcccaatttgatgtgaagaaatccggcaaaatgactcctccattccgcgtcatcctgcacaatgacaacccaaaaccccccatgattatgttgtccacctcctggagaaagtcattccctgaaatgacccgtctacacccccttcaacatcttccaagaaggaccatgtgaactggggttgtaagaggggaattgtcttcttcccaggccgaaggctgaaggagccctggaacgtacatctaggggcaacggccttcccaaacctccatccaaaccctggctatgggtgcctggctcaagttctagaaactggggagggtccttgattttcccaagtataattttggtaatcccccccattttcattttttatgtgaaacctgaaacggggtgggtttcatggatttatccatccccccaaacttgatcccccccggggga

SEQ ID NO: 62378 - protein, 83 aa, Zea mays
  misc_feature: Ceres CLONE 1527499
MALTASAPRAAGRVVDAPAEIISAARHSQFDVKKSGKMTPPFRVILHNDNPKPPMIMLSTSWRKSFPEMTRLHPLQHLPRRTM

SEQ ID NO: 62379 - DNA, 679 bp, Zea mays
  misc_feature: Ceres CLONE 1527500
  misc_feature: Translation starting site: 153
  misc_feature (397)..(397): n is a, c, t, g, unknown, or other
gcggtggcggccgctctagaactagtggatcccccgggctgcaggaattcgtctcacccctagaaaaaaggacaggttgcatttgtatctgagttcctgatcgttgtattccagtttcttccgtgagttttgtgggatcgcgaggaagaaggatgtcgtgctgcggaggcaactgcgggtgcggcgccggctgcaagtgcggcagcggctgcggagggtgcaagatgtacccggacatggctgagcaggtgaccaccaccaccaccacccagactctcatcatgggtgttgcaccatccaagggcgggggtcgaggcggccgccggagctgaaaacgggcggtgcaagtgcggcgccaactgcacctgcgacccctgcaccctgcagtgagactacnacggtggcggcgatgacgctgcagggcctgcaggccctgatgggggtcggaaggactctttatctctcctgcctattaatagcctctagctagtattataaatattctaccaggggcctttgcgtggggttttgttccaagtcagtaaaccgtccgcccgggggcctgggcccatggcttaaatggcttcgctttatctggtccatccctttgccctaggggggggaccgaggggggaaaccaaaaattgtccccgatgtttaaaaaaaaaaaaaaaccagg

SEQ ID NO: 62380 - DNA, 689 bp, Zea mays
  misc_feature: Ceres CLONE 1527503
  misc_feature: Translation starting site: 158
  misc_feature: Pfam Name: DIM1 Pfam Description: Mitosis protein DIM1
acagctggagctccccgcggtggcggccgctctagaactagtggatcccccgggctgcaggaattcgtctcacccctagaaaaaaagcagcagctcatcacctgaaggagagcagcccggaggagggggagcaagcagcagccgtccgtggaagaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctggcagcagtagctgagaccataaagaactttgcggtcatctaccttgttgacatcacagaggtccctgatttcaacaccatgtatgaggctgtacgacccttcgacagtgatgttcttcttccggaacaagcacatcatgattgatctcgggactggaaacaacaacaagatcaactgggccctgaaggacaagcaagagttcatcgacattgtggagaccgtatacaggggcgcccgggaaagctcctggtctggtgtttgctccaaggactactcccccaagtaccggttctaagaagggcggcgttccccttatggcatctattggggagtgtttcccggacagttagtccgaccggggatccctaactgtatcttggcctaccctcagaagttc

SEQ ID NO: 62381 - DNA, 770 bp, Zea mays
  misc_feature: Ceres CLONE 1527505
  misc_feature: Translation starting site: 160
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (237)..(237): n is a, c, t, g, unknown, or other
  misc_feature (247)..(247): n is a, c, t, g, unknown, or other
  misc_feature (287)..(287): n is a, c, t, g, unknown, or other
  misc_feature (320)..(320): n is a, c, t, g, unknown, or other
  misc_feature (349)..(349): n is a, c, t, g, unknown, or other
  misc_feature (365)..(365): n is a, c, t, g, unknown, or other
  misc_feature (368)..(368): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (435)..(435): n is a, c, t, g, unknown, or other
  misc_feature (482)..(482): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (550)..(550): n is a, c, t, g, unknown, or other
  misc_feature (553)..(553): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
nntttcttnnnccctaatatttttataaacgcggtggcggccgctctagaactagtggatcccccgggctgcaggaattcgtctcacccctagaaaaaccagcaacccccaacagcgccactgtccagtgcgcgcgtcaagcttgcttagctagccgccatggcctccctcgccgccgtctccgtgaagcccgtggccatcaagggtctcgccggcagctccatctccggaaggaanctcgccgtcnccaggccgtcggcccgctccatccggaggccccgcgcaanccgccgtgttggcccaactagggggagaaaacntctacttttgaccttttataacatccgcnaacccccccggaaaanggnaattttttttttcccccccccccggggggaagaaggggggnnnttannnannnnntttttttnnnanaattgtttggtggtgtaaaaaaaaaaaaaaaaaaggggtgggcttgntggggggttgcctnnnnttgtgggnnnaannntttattttttttggggcccaaaataaaccccacgcnagngatcgcccgtgggacctccgaggcacccgnnnnaaaagggagagttttagagcaatgcgcccccgccggggcgctaggggatgtgaataatgggggcgaggggtggtaatatggatgaccgccccagagacggtgggagtcaataggggcgtggacgcgaggacgcgcaccgtctcgtgaaaaaggatcatgtagttccaataccgggcgggtactg

SEQ ID NO: 62382 - DNA, 714 bp, Zea mays
  misc_feature: Ceres CLONE 1527506
  misc_feature: Translation starting site: 335
  misc_feature (343)..(343): n is a, c, t, g, unknown, or other
ctggagctccccgcggtggcggccgctctagaactagtggatcccccgggctgcaggaattcgtctcacccctagaaaaaatccgccggtctcttgctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggcactgccaccgccgccgtggccgttgccgccagcgtcctgcttgccggcggcggcgccatgggccangaggtgctgctgggcgcaggcgacggcgggctcgtcttcgagcccagcccagtcacccgtcaggccggcgacaccatcaccttcaagaacaacggccgcttcccgcacacgtcctgttcgagaaaaacaagtgccgagcggcgtcgacccctccaagatctcgaggaagagtacctcaacgcgccagggaaagactaatccgtcaccctcaccggggcgggcacctaaggctttctattggaaccccacccaaggacaagaaatgtccggaaaaatccaggcaaataaagggagggtttccatccggggttcccaatttggagtacccccccccggcaagagaaaaagccccccctcccaatttggtttcc

SEQ ID NO: 62383 - DNA, 701 bp, Zea mays
  misc_feature: Ceres CLONE 1527508
  misc_feature: Encodes the peptide sequence at SEQ ID NO. 62384
  misc_feature (350)..(350): n is a, c, t, g, unknown, or other
  misc_feature (547)..(547): n is a, c, t, g, unknown, or other
  misc_feature (641)..(641): n is a, c, t, g, unknown, or other
  misc_feature (651)..(651): n is a, c, t, g, unknown, or other
  misc_feature (652)..(652): n is a, c, t, g, unknown, or other
  misc_feature (666)..(666): n is a, c, t, g, unknown, or other
acccgcggtggcggccgctctagaactagtggatcccccgggctgcaggaattcgtctcacccctagaaaaaaacaacagcgaacacatctgcttcgcatttcttcccatcccccttcgcaacccaaaccccaactcgctccgcatcgatggcgcccaaggccgagaagaagcccgcggcgaagaagccggcggaggaggagcccgcggctgagaaggcgcccgccgggaagaagccgaaggcggagaagcgggtccccgctggcaagtccgctgccaaggagggcggcgagggcaagaggggcaggaagaagggcaagaagagcgtggagacctacaagatctacatcnttcaggtgctgaagcaggtgcacccggacattggcatctcctcccaggccatgtcgatcatgaactccttcattaacgatatcttcgagaagctagctgctgaggcccgccagctcgcgcgctataacaagaagcaaccatcacctcccgtgagatacagacttccgtgcgcctcgtccttcccggggagctcgccnagcacgccgtctccgagggcacaagggcgtcaccaagttcacctcgcctaggctgcgctgccgcgcttgcaggattgtctcctgtgtcacgtgnattgctgtanntaggggctgctggnttctggtctgtacccatctgtctgtagcactttgt

SEQ ID NO: 62384 - protein, 149 aa, Zea mays
  misc_feature: Ceres CLONE 1527508
  misc_feature (57)..(122): Pfam Name: Histone Pfam Description: Core histone H2A/H2B/H3/H4
  misc_feature (68)..(68): Xaa is any aa, unknown, or other
MAPKAEKKPAAKKPAEEEPAAEKAPAGKKPKAEKRVPAGKSAAKEGGEGKRGRKKGKKSVETYKIYIXQVLKQVHPDIGISSQAMSIMNSFINDIFEKLAAEARQLARYNKKQPSPPVRYRLPCASSFPGSSPSTPSPRAQGRHQVHLA

SEQ ID NO: 62385 - DNA, 475 bp, Zea mays
  misc_feature: Ceres CLONE 1527509
  misc_feature (140)..(140): n is a, c, t, g, unknown, or other
  misc_feature (246)..(246): n is a, c, t, g, unknown, or other
  misc_feature (264)..(264): n is a, c, t, g, unknown, or other
acccgcggtggcggccgctctagaactagtggatcccccgggctgcggaattcgtctcacccctagaaaaagcgctttcctgtccgactcccagccgtcgtctgctgcgtactccgcctccagtttggtctgtttcttgncagttgctcttgcggtagttccccaactgtcacatgcaaaacgagaggtagatgtgactcttgtcccagatgtcgcacacagatctcctgcaagacatgctcgtcnatcacatgccactgatcnatgcctgatatgccactccacttgcccccctgtttgcgggcccgggatgcaaactcctggaaggttgcaaaaaaaggcattcccccctattttcttcgtttcccaaattgcaccccctcacctttttaaaacggcccaaaacagggggtgttccccggcccctaaacaaaaaaaaaactttgggggccccccaaagtaaggggggggggcc

SEQ ID NO: 62386 - DNA, 553 bp, Zea mays
  misc_feature: Ceres CLONE 1527512
  misc_feature (247)..(247): n is a, c, t, g, unknown, or other
  misc_feature (248)..(248): n is a, c, t, g, unknown, or other
aaagctggagctccccgcggtggcggccgctctagaactagtggatcccccgggctgcaggaattcgtctcacccctagaaaaaattccaccttggtccatcagcagcgagcgaacaggcaaaaaggaaaggccgagaagcgctttatccggccgtacgtagcgataagagtggtgcacccgtagcggcacggcatggcggccactggcgtactccccgtggggcgctccctccggggggggggggnngggcccttggcggggcccccctttcttcccttgaagcggagaagggggtgggcccccccccccattttttccccccccaaaccccccggggggttttcctcccccggggggggccttttaaaaaaatttgtcccccgggggggaatttttttaaaaatctggggggggggggcccccctgaaaaaaccccctcccctcctttgggggggggggccccccccccccctttggaaaacaccccttttttttgggggaaaaaaaaaaagggggggggtgctcccccaaaaaaaaaaaagggggggggg

SEQ ID NO: 62387 - DNA, 711 bp, Zea mays
  misc_feature: Ceres CLONE 1527514
  misc_feature: Encodes the peptide sequence at SEQ ID NO. 62388
aagctggagctccccgcggtggcggccgctctagaactagtggatcccccgggctgcaggaattcgtctcacccctagaaaacgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggggctgcaggaagccatcaaatcctaccccgacgcccttccacggcgtcctcgggcttcaaacacatcaagccagacgcagtggcgtcggtttcttcccctaaaaaccccccggggaagcaaattaaaccgggccccgccgggccgcccccccgcgggtaaacttatagcccctggggggaaactaaaaacctaacctaggggccctggcgccctctcttgttgggtttgggtttttgtctttcgcgggaacccccccaaccccttttggggtgggggggggaatccccctcttccccccttttcacccccttttattt

SEQ ID NO: 62388 - protein, 194 aa, Zea mays
  misc_feature: Ceres CLONE 1527514
  misc_feature (57)..(147): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
AGAPRGGGRSRTSGSPGLQEFVSPLENARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKGLQEAIKSYPDALPRRPRASNTSSQTQWRRFLPLKTPRGSKLNRAPPGRPPAGKLIAPGGKLKT

SEQ ID NO: 62389 - DNA, 720 bp, Zea mays
  misc_feature: Ceres CLONE 1527515
  misc_feature: Encodes the peptide sequence at SEQ ID NO. 62390
  misc_feature (408)..(408): n is a, c, t, g, unknown, or other
aagctggagctccccgcggtggcggccgctctagaactagtggatcccccgggctgcaggaattcgtctcacccctagaaaaaatcttctcccccagctccccagcaccagtccccaattatttggcctccgtcagagaggggagaaagacccgttcgaggcggcggctatgtcggggcgcgacaagggcggcaagggtctgggcaatggtggagccaagcgccaccggatggtgctcctcgacaacatccagggtatcaccaagccggcgatccggaggctggctcggaggggcggcgtgaagcgcatctcggggctcatctacgaggagacccgcggcgtgctcaagatcttcctcgagaacgtcatccgcgacgccgtcacctacaccgagcacgctcgccgcangaccgtcaccgccatggacgtcgtctacgcgctcaagcgccagggacgcaccctctacggattcggaggctaggcgcctcttcgtagctggggcatgcttatgcggatacacgtctctgtcgctgtgggccatagtgttgctgcgttcatagatgtaatcatttatttttctgcaatgatggatgctggccagcatgctacctgcaaaaaatatataaacgagacgctcgaggtacctattcgcctatagtgagccgtatacgcgcgctcactgccgtcgttttacacgtcgtgactgggaaaccctgtcgt

SEQ ID NO: 62390 - protein, 103 aa, Zea mays
  misc_feature: Ceres CLONE 1527515
  misc_feature (25)..(94): Pfam Name: Histone Pfam Description: Core histone H2A/H2B/H3/H4
  misc_feature (80)..(80): Xaa is any aa, unknown, or other
MSGRDKGGKGLGNGGAKRHRMVLLDNIQGITKPAIRRLARRGGVKRISGLIYEETRGVLKIFLENVIRDAVTYTEHARRXTVTAMDVVYALKRQGRTLYGFGG

SEQ ID NO: 62391 - DNA, 687 bp, Zea mays
  misc_feature: Ceres CLONE 1527518
  misc_feature: Encodes the peptide sequence at SEQ ID NO. 62392
  misc_feature (521)..(521): n is a, c, t, g, unknown, or other
  misc_feature (563)..(563): n is a, c, t, g, unknown, or other
  misc_feature (576)..(576): n is a, c, t, g, unknown, or other
  misc_feature (598)..(598): n is a, c, t, g, unknown, or other
  misc_feature (608)..(608): n is a, c, t, g, unknown, or other
  misc_feature (687)..(687): n is a, c, t, g, unknown, or other
tccccgcggtggcggccgctctagaactagtggatcccccgggctgcaggaattcgtctcacccctagaaaaagccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcggaacgtggcggcggcggacgcccggcggcgacagccgcggccagctgctgctcgtcgtggtggcgcccgcccatcgggtgggtgctgtacaacatcctggcagcggcgctgaaccagctgaaccgcatgcgcagcancccaggccgtggccgcgggcctggggcctcgcgccgccgcgnccgccgggatgcngccccggccgaagcctcggcgnccgtggtganggactcgcgggaatcgccgccgccgcgcccgccaagaaaggcgcgggctcctcctgctcatcgtcgtcgcgcccgccan

SEQ ID NO: 62392 - protein, 169 aa, Zea mays
  misc_feature: Ceres CLONE 1527518
  misc_feature (115)..(115): Xaa is any aa, unknown, or other
  misc_feature (129)..(129): Xaa is any aa, unknown, or other
  misc_feature (141)..(141): Xaa is any aa, unknown, or other
  misc_feature (144)..(144): Xaa is any aa, unknown, or other
MATIATMALLKPAAKAAARSAPSTSSGSVSLRVRTGQAAKKAALSVSASSTLAGAFLAALASSPDAALAERGGGGRPAATAAASCCSSWWRPPIGWVLYNILAAALNQLNRMRSXPGRGRGPGASRRRXRRDAAPAEASAXVVXDSRESPPPRPPRKARAPPAHRRRAR

SEQ ID NO: 62393 - DNA, 815 bp, Zea mays
  misc_feature: Ceres CLONE 1527520
  misc_feature: Encodes the peptide sequence at SEQ ID NO. 62394
ctagaaaaagatccaacaaccaggtcgttcagccgcagattagcaggccgcctgcgctcctcctttcccctcagcctcccctcctctccggtgtacgtctccgccgagatggccgccccgctccggcggagcctcccctcccttggtcgcgcgcttctcacgccggcgccggcgcggatgctctccgcggaggcctctgatgccctcgttgagatcaagcccggggagatcgggatggtctccggcatccctgaggagcatctccgccgtaaggttctaatttattcaccagctaggactgcatcccagcaaggttcaggcaaagtcgggaggtggaaaattaattttttgtcaacccaaaagtgggagaacccgttgatgggatggacatctactggggatccatatgctaatgtcggtgaagcaggacttacgtttgacagtgcagagtcagcaaaggcgtttgccgaaaaacatggatggaattatgtggttcggaaacgccatgcacctcttctgaggcctaaggcctacgctgagaacttcaagtggagaggccctccgaaagcggagcaagcatgagctcgagacatctgtgatgctgacattggcacgatgtcgttttcctcctggctcgattttattttgctttcaaccgtgcccattgttaaagtacgaactagagtatgcatctatcaaacttgtaataagcatgatgtgcaatcaaacaaaatggtgtacttgtacttccaaaacgttaattcgtggatgmcaaaaaaaaaaaaaaaaaaaaaaaagaaaaaaaaaaaaaaaaa

SEQ ID NO: 62394 - protein, 157 aa, Zea mays; identical to SEQ ID NO: 40019
  misc_feature: Ceres CLONE 1527520
  misc_feature (54)..(156): Pfam Name: ETC_C1_NDUFA4 Pfam Description: ETC complex I subunit conserved region

SEQ ID NO: 62395 - DNA, 719 bp, Zea mays
  misc_feature: Ceres CLONE 1527522
tccccgcggtggcggccgctctagaactagtggatcccccgggctgcaggaattcgtctcacccctagaaaaacttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttatcctgtccaggaactgcttggccggagatccaaacaaacctctgtgttggggttctccggggttccttgcgctggagggaggtttcgttctcgctggccatggtttggctgagaagcagcagcggcagcatcttgatgccaaatctctgagctttatgaagatcgccactcacctgcgccgctcctgcttctccactccttctcggttgtcttcctctactggttttatgtgatctcataacttgccctcccccggatccgccattcccccgtggcctctctccgtccccctcacttctccctcctttcttgcttcccctcacatcgccaataacagcactagtggcagcgggtagagatcttttcgaggtagctaggccggccgggtccctgcgggaaaaaaaaaaaaaacgagacgctcgaggtacccattcgccctatagtgagtcgtatacccgcgcctcactggcgtcgttttacacgtcgtgact

SEQ ID NO: 62396 - DNA, 724 bp, Zea mays
  misc_feature: Ceres CLONE 1527523
  misc_feature: Encodes the peptide sequence at SEQ ID NO. 62397
  misc_feature (403)..(403): n is a, c, t, g, unknown, or other
  misc_feature (409)..(409): n is a, c, t, g, unknown, or other
  misc_feature (410)..(410): n is a, c, t, g, unknown, or other
  misc_feature (444)..(444): n is a, c, t, g, unknown, or other
  misc_feature (452)..(452): n is a, c, t, g, unknown, or other
  misc_feature (475)..(475): n is a, c, t, g, unknown, or other
ctccccgcggtggcggccgctctagaactagtggatcccccgggctgcaggaattcgtctcacccctagaaaaaagacccagatcgcacgacgcaaccgatccccaaatcttcccagttcccccctcccgctcgacccagatcgaggcctcgatccaccggccatggcgctggagtgggtggtgctgggctacgcggcgggcgcggaggcggtcatgctgctgctgctgacgctgccggggctcgacggcctgcgccggggcatggtctccgtggtgcggagcgcgctcaagcccatgatgtccgtggtgcccttctgcctcttcctgctcatggacatctactggaagtacgagacgcggcccacctgcgacgacgagcacgcctgcacccccctcgagcancctcgnncacagaagtccgtcatgaggtcgcagcgaaaggnggtccttnatgggcgcgggctccctctctantggatcctcttcttcgtcacccagctcgtcgtcaggctcgaccagatgcagcagcgcgtcaacaagctcaaaagcgcgacgactgatggggctccggttcccgcctttccccggttccacccgggggtccggttcttcccccgggcccgaaatttgggttttttttttcccgggtggaggggggaggcctaaaatccccaccggaatttgggggcgggggcgtcctttttccccttccgcctccaaaaa

SEQ ID NO: 62397 - protein, 167 aa, Zea mays
  misc_feature: Ceres CLONE 1527523
  misc_feature (80)..(80): Xaa is any aa, unknown, or other
  misc_feature (83)..(83): Xaa is any aa, unknown, or other
  misc_feature (94)..(94): Xaa is any aa, unknown, or other
  misc_feature (97)..(97): Xaa is any aa, unknown, or other
  misc_feature (104)..(104): Xaa is any aa, unknown, or other
MALEWVVLGYAAGAEAVMLLLLTLPGLDGLRRGMVSVVRSALKPMMSVVPFCLFLLMDIYWKYETRPTCDDEHACTPLEXPRXQKSVMRSQRKXVLXGRGLPLXWILFFVTQLVVRLDQMQQRVNKLKSATTDGAPVPAFPRFHPGVRFFPRARNLGFFFPGWRGEA

SEQ ID NO: 62398 - DNA, 496 bp, Zea mays
  misc_feature: Ceres CLONE 1527525
  misc_feature: Encodes the peptide sequence at SEQ ID NO. 62399
  misc_feature (211)..(211): n is a, c, t, g, unknown, or other
  misc_feature (215)..(215): n is a, c, t, g, unknown, or other
  misc_feature (218)..(218): n is a, c, t, g, unknown, or other
  misc_feature (225)..(225): n is a, c, t, g, unknown, or other
  misc_feature (229)..(229): n is a, c, t, g, unknown, or other
  misc_feature (243)..(243): n is a, c, t, g, unknown, or other
ggagctccccgcggtggcggccgctctagaatagtggatcccccgggctgcaggaattcgtctcacccctagaaaaatcacggagccttccggataggatttgtctcccctccactgcgcctctccgtttccgccatggctccggccgccgccttcctgtcggcgtgcgccgctggttccataccccgtgcgcccttcctgatccccgagnctcnttnctctccnattncgctctcccctgcncgctgggaacgcttccgcagctgcagcctctttggcgtaagggcaaaaatttggcgggggcaaaccttttaaagaaacgctttcccggaaacggggtttcctaaagggccgggttttggaaaatacaaaacgccgaaatacccctgaaaaaagggtccccccaaaaaagtacagaaaactgaaaaggggcaaaaaaagaggcccctccctccttgaaactcttccccccccttgggggggccccttttttaaa

SEQ ID NO: 62399 - protein, 59 aa, Zea mays
  misc_feature: Ceres CLONE 1527525
  misc_feature (26)..(26): Xaa is any aa, unknown, or other
  misc_feature (27)..(27): Xaa is any aa, unknown, or other
  misc_feature (28)..(28): Xaa is any aa, unknown, or other
  misc_feature (32)..(32): Xaa is any aa, unknown, or other
MAPAAAFLSACAAGSIPRAPFLIPEXXXSPIXLSPARWERFRSCSLFGVRAKIWRGQTF

SEQ ID NO: 62400 - DNA, 724 bp, Zea mays
  misc_feature: Ceres CLONE 1527531
  misc_feature: Encodes the peptide sequence at SEQ ID NO. 62401
  misc_feature (350)..(350): n is a, c, t, g, unknown, or other
  misc_feature (384)..(384): n is a, c, t, g, unknown, or other
  misc_feature (473)..(473): n is a, c, t, g, unknown, or other
  misc_feature (475)..(475): n is a, c, t, g, unknown, or other
  misc_feature (477)..(477): n is a, c, t, g, unknown, or other
  misc_feature (502)..(502): n is a, c, t, g, unknown, or other
  misc_feature (503)..(503): n is a, c, t, g, unknown, or other
ctccccgcggtggcggccgctctagaactagtggatcccccgggctgcaggaattcgtctcacccctagaaaaagcttttcgttcgtcttcatcctacgcgagggcgaaacccacaaaccctctccctcccgtactccggcctacacatccaggggcgatgacgctgggtagctccggcgccggatcgagcgtcgtcgttccccgaaacttcaggctattagaggagctcgagcgtggagagaagggcattggtgatggaacagtgagctatggaatggatgatgccgatgacatctacatgcggtcatggactggtaccatcattgggccctcacatactgtacatganggtcgcatctaccagctgaagttgttttgtgacnaagactatcccggagagccaccatctgtcagaatccactcaagaaatcacatgacatggcgtaatcacgagacaggaaatggtgatccnangnagtttggttggctagcgaactggcnncgggactacccgatggaaaacctccctcaccagctcaggaaagaaatggcctccctcccaaaatccaaaagtattggcacctccgaaagggaaatctttctaacaaattttccccttggcccgccatgggatccaaccgtaattttgaagtttttggggctaaaaacccaggtcaaatttgggggccccggccgggttttggaattttttaagaattttag

SEQ ID NO: 62401 - protein, 188 aa, Zea mays
  misc_feature: Ceres CLONE 1527531
  misc_feature: SWISSPROT Homolog: EC 6.3.2.19 Ubiquitin--protein ligase
  misc_feature (64)..(64): Xaa is any aa, unknown, or other
  misc_feature (76)..(76): Xaa is any aa, unknown, or other
  misc_feature (106)..(106): Xaa is any aa, unknown, or other
  misc_feature (107)..(107): Xaa is any aa, unknown, or other
  misc_feature (115)..(115): Xaa is any aa, unknown, or other
MTLGSSGAGSSVVVPRNFRLLEELERGEKGIGDGTVSYGMDDADDIYMRSWTGTIIGPSHTVHXGRIYQLKLFCDXDYPGEPPSVRIHSRNHMTWRNHETGNGDPXXFGWLANWXRDYPMENLPHQLRKEMASLPKSKSIGTSEREIFLTNFPLGPPWDPTVILKFLGLKTQVKFGGPGRVLEFFKNF

SEQ ID NO: 62402 - DNA, 686 bp, Zea mays
  misc_feature: Ceres CLONE 1527532
  misc_feature: Encodes the peptide sequence at SEQ ID NO. 62403
  misc_feature (498)..(498): n is a, c, t, g, unknown, or other
aaagctggagctccccgcggtggcggccgctctagaactagtggatcccccgggctgcaggaattcgtctcacccctagaaaaaatcacctcctcaacctccagcccaacctccagcccggaatcgagagcaatggcgctcgccaaggccaaggagatcgttgcctccgctcccctcgtcgtcttcagcaaaacttcctgtcctttctgcgtccgtgtgaagcagttgttcgagaagctcggagcaagctacaaggccattgagttggataaggaaagtgatggagctgagctccagaatgccctgaaggagtggactggacagaggactgtcccaaatgtcttcatcaatgggaagcatattggcggctgtgatgatactatggcactgaacaatgatgggaagctggtgcctctgctgactgaggctggagccatcgccgggtctgcctcgaagaacaccatcactgcttgacatgtgtgttaccattccgtgctnaaaataatgatgctttgcaagtgctgaacttgcagatgctatgtgggagtgactggtcgtttccctgtgtaaaactccctaaacatcatccaaatcgtgtttctgtggtgggttgggaaatctacaaaaaccattgctaacaaaaagccctggttccccggcctccagttggaaaaattgaaaaaaaa

SEQ ID NO: 62403 - protein, 113 aa, Zea mays
  misc_feature: Ceres CLONE 1527532
  misc_feature (15)..(77): Pfam Name: Glutaredoxin Pfam Description: Glutaredoxin
  misc_feature: SWISSPROT Homolog: EC 1.11.1.15 Peroxiredoxin
MALAKAKEIVASAPLVVFSKTSCPFCVRVKQLFEKLGASYKAIELDKESDGAELQNALKEWTGQRTVPNVFINGKHIGGCDDTMALNNDGKLVPLLTEAGAIAGSASKNTITA

SEQ ID NO: 62404 - DNA, 803 bp, Zea mays
  misc_feature: Ceres CLONE 1527534
cgcgctggagctcaccgcggtggcggccgctctagactagtggatcccccgggctgcaggaattcgtctcacccctagaaaaactcctgccgccgccgccgctcccgctcccagctcgtgttccgcttcttgcagccggtgccgcgaagcgctctagagaactttcgtcaacatgtgtaagatacgtgcgtctgggagtcaaggcgctagttcagagacccatctgcaggaaacacgcgcgggtctgacgaggcctatcttagaagcccttctttgcttgtatctgccctgaaaccctccccgtgggtaattcccctggccccggcccctccgtcctggaacagagcacttgatggccggacctgctgctcagtccttttttgttgagtacacccgcgcgcgccgtccttttctttaatgtgtagggtaaccccgccccccccccactttaaagtccgcttaaaacgcgctgcgctcgacgttcctgtttaccctcctatttttatcttgcttctctcccttgcctcccgttttgctgccgctctggtttaccccttcgttgccggaggtttatactgtcgttcccttcggtcttgcgtacgttgcggtgatttgtgttttacccgccgtttgcgcgccatttggcgcttgcgcgccgcccctctgctgacgatttccgtgtatatttgaacactgtctcctttcactccctccctctttgccgcaataagggcacgcaaaggtcgccggcaaggtgaggtgcggattagccctcgcgcgctattggacagggccgtgcttct

SEQ ID NO: 62405 - DNA, 638 bp, Zea mays
  misc_feature: Ceres CLONE 1527538
  misc_feature: Translation starting site: 140
ctccccgcggtggcggccgctctagaactagtggatcccccgggctgcaggaattcgtctcacccctagaaaaaagcctcccattcatcagattcagatcagatcgtagcagccaaggattccgcgctccgggggtgccatgaagctgaagctcctctctccctgccttctcctcctcgccttctttgccaccgcggcgtacgcggcgtcggcgtcggcgtcgcgcgcggcggccgtcgtcaggggcgcgggcgccccgtcgcagtcggagttggagtcggaacccggagaaccagtgcgtgtacacggtgtacgtgcggacggggtccatctggaagggcggcacggactcgaccatcggcgtgacgctgctgggcccccacgggcacgggcatcccgatccggaacctgccgggggggggggggcctcttggggcgcccggcccaaaattactagaagggggggaaacccgggaaaatcttctcgggggcgggggcccccctggatgagaccaaggggccccgggggccttgaaaacctccccccccaaaagggggccggggggccgacccaaagggggggggtgaggggaaaaaaaccccctcgaggggcccccgtgtccagtggggcgcccccc

SEQ ID NO: 62406 - DNA, 696 bp, Zea mays
  misc_feature: Ceres CLONE 1527540
  misc_feature: Encodes the peptide sequence at SEQ ID NO. 62407
aagctggagctccccgcggtggcggccgctctagaactagtggatcccccgggctgcaggaattcgtctcacccctagaaaaagccccactaaacactcccgcagacccacagtcccgcccgtccccgtccgtccacagccagctccgcctcccatccagcggccgtccacagccgtcgcagttccagtgagatcgagcgaggtaagcttatatctgagcgatttctctcgcgcgtcgtacgtaaagttcactcgacttcgactctctcatcctcttctgttcttccaggttccgtctacttcctcgagcagacagtgagagactcgtggtcttttagatcccgggcttcagatctgctgtttcttctacggattggttctagttctagcagtgtactcaaaccaccccccaggcttgtagccaagaaaggttctttaccacacctcccttgcgcaagtgagtcctgtcctgagtggatctgcccaccgctgccctcgggttttactgggggctgtcgggtttcttccactttcttcggtagctcttgggttggctggggagggaggaaaataaaagaaataaagcggagccctccaaggggccaaatttgtctttaatggggggcaaaataacaccccccccctggcccccgtgttaacaacccccgccctgggaaaaaaccttgttttcccccg

SEQ ID NO: 62407 - protein, 62 aa, Zea mays
  misc_feature: Ceres CLONE 1527540
AGAPRGGGRSRTSGSPGLQEFVSPLEKAPLNTPADPQSRPSPSVHSQLRLPSSGRPQPSQFQ

SEQ ID NO: 62408 - DNA, 745 bp, Zea mays
  misc_feature: Ceres CLONE 1527542
  misc_feature: Encodes the peptide sequence at SEQ ID NO. 62409
  misc_feature (284)..(284): n is a, c, t, g, unknown, or other
  misc_feature (428)..(428): n is a, c, t, g, unknown, or other
  misc_feature (461)..(461): n is a, c, t, g, unknown, or other
  misc_feature (488)..(488): n is a, c, t, g, unknown, or other
  misc_feature (551)..(551): n is a, c, t, g, unknown, or other
  misc_feature (591)..(591): n is a, c, t, g, unknown, or other
  misc_feature (613)..(613): n is a, c, t, g, unknown, or other
  misc_feature (614)..(614): n is a, c, t, g, unknown, or other
  misc_feature (713)..(713): n is a, c, t, g, unknown, or other
  misc_feature (721)..(721): n is a, c, t, g, unknown, or other
  misc_feature (722)..(722): n is a, c, t, g, unknown, or other
agagctggagctcaccgcggtggcggccgctctagactagtggatcccccgggctgcaggaattcgtctcacccctagaaaaagccagtcgccatccgccgccgccgccatgccgggcttcgctcagcgtctcgcgggcatcccgtggcggagcatcgcgaggcaaggcctctcccgcgtgttcctggtggcgaaggcctactgcgtgatccacgtcgtcaacgaccacctctgctcggtgaccttagtgcggggcgccagcatgctgccgtccctgaacctgncgggcgacgcggtggcggtggacagggtcagcgtgaggttcggccgggtcgcgccgggggacatcgggctgaagattttctccgaggacccgcgcaagttggtttgtcgagttgtgtttccccccccccaacgggaactccggnaccccacccttggacgaacccccgggaaaaagnggaattcctcccttctcaaaccccttnggtgtttcctgcaaaacacaatggtcctcggttttcgagggagcaaaaaagtcctctgcgctnctcccttgatttttgggggacaattttataacccccgggnctccacgaggcttctactaccnngcgcaagaacccgtttgcgccccccccggcggttacctcacagagaggcgcttatctccctctttttcgtaaccgctggagccacctcccctttttaangttatggnngcgagaactccctcctgatggaa

SEQ ID NO: 62409 - protein, 200 aa, Zea mays
  misc_feature: Ceres CLONE 1527542
  misc_feature (59)..(59): Xaa is any aa, unknown, or other
  misc_feature (107)..(107): Xaa is any aa, unknown, or other
  misc_feature (118)..(118): Xaa is any aa, unknown, or other
  misc_feature (127)..(127): Xaa is any aa, unknown, or other
  misc_feature (148)..(148): Xaa is any aa, unknown, or other
  misc_feature (161)..(161): Xaa is any aa, unknown, or other
  misc_feature (169)..(169): Xaa is any aa, unknown, or other
MPGFAQRLAGIPWRSIARQGLSRVFLVAKAYCVIHVVNDHLCSVTLVRGASMLPSLNLXGDAVAVDRVSVRFGRVAPGDIGLKIFSEDPRKLVCRVVFPPPQRELRXPTLGRTPGKKXNSSLLKPLXCFLQNTMVLGFRGSKKVLCAXPLIFGGQFYNPRXSTRLLLPXARTRLRPPRRLPHREALISLFFVTAGATSPF

SEQ ID NO: 62410 - DNA, 756 bp, Zea mays
  misc_feature: Ceres CLONE 1527543-R
  misc_feature: Translation starting site: 170
  misc_feature (1)..(1): n is a, c, t, g, unknown, or other
  misc_feature (2)..(2): n is a, c, t, g, unknown, or other
nnttttccgattgcgtactcgagcgtctcgtttttttttttttttttctgggggaagaactcttgcacgccaataattacccataatctctcttgctagcgcacaaggcagcaccccatatgaagatcgccgatgcacttgctgatcttcacctccttacacctcagcgatggtcacctcaacctccacaccaggctcaattgtgatggaggtgatcatgcttcaccacatcatgcgagctgatgaggtccaccaccctcgtctgcgaatgccgaactctcaccgatcccatgcgtttgttccttcaccgcttggggacttccgagtgatcgatgctggacaaccctaccaaggatcccgacaggtcccgtaaccctactatgcctgtccttgggtccatttaccgaatcgtgacaaactatctccaagctcttgaccctctcggatgacatcgtgatccccatgcacctgagctgcacttcgtgggcatcctcgacagctaggctccccttgtagacgcgatatctgacaacgccagcacggttctatggtgccaaggaaaaaggagtcgtgccctactccgtcggcctgctcatacactgcggctgatcaaggtacgctttttttttcgaagggggtagagggaattccccgaaccccggggggtccccccaaagggtccaaaggggggaaacccccccggggcgaaagccccaccgtatttctcccccaaaaagggagggttttatttttccc

SEQ ID NO: 62411 - DNA, 693 bp, Zea mays
  misc_feature: Ceres CLONE 1527544
  misc_feature: Translation starting site: 149
  misc_feature (264)..(264): n is a, c, t, g, unknown, or other
  misc_feature (410)..(410): n is a, c, t, g, unknown, or other
aaagctggagctccccgcggtggcggccgctctagaactagtggatcccccgggctgcaggaattcgtctcacccctagaaaaagagccacggagagcaaaggcagcacactcagctatccagcaaaagagatcgagacgcaggagtcatggccaccgtcagcgccgccgtggtgaccaccatcgttgcccgcgccgcgatcgccaggcccaatgctctagggctgcctgcgctgagggcgaggagcgagagggtgcggtgcanctacgccaaggacgcggccccagtcagcaccaagggcgcaggcgcgtcgctgctcgccgcagcgggcgcggtgaccgcgtcggcggggcccgcgctggcgctcgtggacaagcgcatgtccactgagggcaccgggctgaccctcnggctcacaaacacctgctggggtggatcctcctgggggtcttcggcctcatctggtccctctacaccatctacacctctgacctcaacgaggacgaggagtcccggggcctctccctctaaatccaccctctcctgttaatgatctgaatggaaaccttggtgggcggtcctcggtggtaaatttagacttggctattttgcatccaagatccctccctcccctgtaaaaaaggtttgggagactactctccccctgaaggcatggcaataaccaacttttgc

SEQ ID NO: 62412 - DNA, 660 bp, Zea mays
  misc_feature: Ceres CLONE 1527545
  misc_feature: Encodes the peptide sequence at SEQ ID NO. 62413
  misc_feature (283)..(283): n is a, c, t, g, unknown, or other
  misc_feature (357)..(357): n is a, c, t, g, unknown, or other
  misc_feature (387)..(387): n is a, c, t, g, unknown, or other
  misc_feature (388)..(388): n is a, c, t, g, unknown, or other
  misc_feature (410)..(410): n is a, c, t, g, unknown, or other
acccgcggtggcggccgctctagaactagtggatcccccgggctgcaggaattcgtctcacccctagaaaaaatcttgagaaagaactcctcgtcctcgctccctccccaaccatcaagagcgcacacgcacacgcacacgccgcgcgcaagccggccgacgtacggcatggagaagagcgctacaactggcggcggcggttcaagcggcggcggagaggcggcggaggaggcgaaggtgcctctgctgcagccgagggctgcggcggcggcggcggccgagnaggaacatgggaggaggagaggatacgacggcaaggcggcgtcggcggcggcggatgaggagggcagggacgcngtcgtggtcgtcgctgccgctgcggcggcnncgcgtgggaagaaaaccagaangctggggggttgtgggccgggcccgtccatcttcacgcgcttcgcgtcctttcggcggcccccgtcatcagccagggcttcatcggccaaattcgggcgccaaccgaagcctcggccgcctaacgcgctccttctccaccggtcctcatggaaggttcagcaacgggatccctgggaacgtaacggtgtctttttctattcaaaaccccattccgttcttgggaatcctgtgggtcccaaaaaccccccc

SEQ ID NO: 62413 - protein, 164 aa, Zea mays
  misc_feature: Ceres CLONE 1527545
  misc_feature (39)..(39): Xaa is any aa, unknown, or other
  misc_feature (74)..(74): Xaa is any aa, unknown, or other
  misc_feature (81)..(81): Xaa is any aa, unknown, or other
MEKSATTGGGGSSGGGEAAEEAKVPLLQPRAAAAAAAEXEHGRRRGYDGKAASAAADEEGRDAVVVVAAAAAAXRGKKTRXLGGCGPGPSIFTRFASFRRPPSSARASSAKFGRQPKPRPPNALLLHRSSWKVQQRDPWERNGVFFYSKPHSVLGNPVGPKNPP

SEQ ID NO: 62414 - DNA, 755 bp, Zea mays
  misc_feature: Ceres CLONE 1527546
aagctggagctccccgcggtggcggccgctctagaactagtggatcccccgggctgcaggaattcgtctcacccctagaaaaaaaaccaaaggaaccgatcagagagagagagagagcgcatagtccatcatgaagggtggcaagaaggaagtggccggtgcggtggtggccatactgctggttctgcagctcatggcagctccaccgacggccatggcccgcccgctcgccgcacggagccgtgccggatggctccctcgccacgacgcccaaagtgacgatgctgccggccacgctgtgccacacggtggagacatgcaaataccttggcctgcctcactccctgcttgctcctgcaaatatagtgatctctcgacgccacatcctaattttactccttgttgtttgaccccctctccgccgaagcacaactttttcctgccctgcttccatcccacgacctacacttccccttccttagaacttctccctcactccccgccattttttcccatggtcttcatgggcctgctcctctgacatatggagttcccgcagttatttaaccaagcccatgtccggggaacccccgccgccaagacggctgatttatttcatttcaaccttcttccggcgggacaaacacaaacacggtacatatacatttttaccatttccccccataaaataaaaaaaaacacacgccgcccccttcccggacccccacaattcccgttcaaaattacatgaccat

SEQ ID NO: 62415 - DNA, 675 bp, Zea mays
  misc_feature: Ceres CLONE 1527552
  misc_feature: Encodes the peptide sequence at SEQ ID NO. 62416
  misc_feature (407)..(407): n is a, c, t, g, unknown, or other
  misc_feature (521)..(521): n is a, c, t, g, unknown, or other
  misc_feature (643)..(643): n is a, c, t, g, unknown, or other
  misc_feature (656)..(656): n is a, c, t, g, unknown, or other
  misc_feature (657)..(657): n is a, c, t, g, unknown, or other
ctccccgcggtggcggccgctctagaactagtggatcccccgggctgcaggaattcgtctcacccctaaaaaaaaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggcccacgaggacatcagcacctgcaccggcgagttccacgagcgccacnaaaagctccctcgccagggctaactgagcccccccggggggccggcatccacccccgttcgtgcttggcctgcgggccctatgtatgtctgtgggttgactggtttggcagggnccatccgaacttgggtatcgaaacgggccgcccctcccctccctggccaaattacaaaaaaaaagcctcgggaccctgaataaaaactttccttcttaataaaaagaaaaaaagaaaaaaangggggggcccccnnggagggaagagaaagccg

SEQ ID NO: 62416 - protein, 92 aa, Zea mays
  misc_feature: Ceres CLONE 1527552
  misc_feature (86)..(86): Xaa is any aa, unknown, or other
MAYYQEVDYCSEEVRSVAPAGFGRHGGGVQQHVVKEKFEEVDTVSRAGANHHHHHGHHGGHGFVVRETRAHEDISTCTGEFHERHXKLPRQG

SEQ ID NO: 62417 - DNA, 786 bp, Zea mays
  misc_feature: Ceres CLONE 1527556
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (80)..(80): n is a, c, t, g, unknown, or other
  misc_feature (196)..(196): n is a, c, t, g, unknown, or other
  misc_feature (197)..(197): n is a, c, t, g, unknown, or other
  misc_feature (205)..(205): n is a, c, t, g, unknown, or other
  misc_feature (229)..(229): n is a, c, t, g, unknown, or other
  misc_feature (252)..(252): n is a, c, t, g, unknown, or other
  misc_feature (321)..(321): n is a, c, t, g, unknown, or other
  misc_feature (323)..(323): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (384)..(384): n is a, c, t, g, unknown, or other
  misc_feature (385)..(385): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
nnccaacnnnnnttcatgctggagctcaccgcggtggcggccgctctaaactagtggatcccccgggctgcaggaattcntctcacccctagaaaaagccacaacaatatcgcattgacagatcgttcatcgtaagctgcctccagtcgtctcccgagatcttctccggttataaatttccgcggcgattccccannccagatgngcaaacttcaaatcgtctcactcnggtctgccctgctcatactgctngccctcccccaatggtccacccacaacccaagggatgattcttttttgccacaaaggaggggaggtccntnttgnnnttttttttttttttctctatcgaactcgtagtagatnnnncctttttatattccnnccctaccggggaaaaagaaaaggggggannnnnnnnnnnnnnnncccccccccccccttcatgaaaaaaaaaaaaaaacaccctttctccttgtggggggggggggggtccacattcgcatttgcccccctgatggactccatcgtctttgattccgtcatcctaggccccctggaccccaactctccacagggcctgacggctacgggtcgagcatgtggagatgtcgggcacgcgcaagtgcgagttgtgtggggccataagccgggcgagcggcggatagttgaggggtgtgtccgtcatgccgggtgtttgggggcgggcggaagatgccgatcgtagagggaggcgaatgccatgggacgcgcgggggattgcggcgcggatattatcggaccggg

SEQ ID NO: 62418 - DNA, 707 bp, Zea mays
  misc_feature: Ceres CLONE 1527558
  misc_feature: Encodes the peptide sequence at SEQ ID NO. 62419
  misc_feature (628)..(628): n is a, c, t, g, unknown, or other
tggagctccccgcggtggcggccgctctagaactagtggatcccccgggctgcaggaattcgtctcacccctagaaaaaatccaactcatcagatacccaaccttcgcctacaccataaaaatcgccagttctttggtccgcgtcagagaggcggcggccatgtctgagcgctgcaagggcggcaagggtctgggcaaggacggcacgaagcgccaccggaaggtgctccgagacgacaaccatcggatcaccaagcctgcgatccatacgatggataatatggatgatgtgaatcacatctccagtgtcatctacaagaagactcactacttgctcaagaactttcacgagaacgacatccgctacaccgacacctatgtcgagcacgacacgccgcaagaccgtgaccgacatgaatctcgactacgcgctcaagagccacggccgcatcctctacgggttcagagggtacgtgactcgcctcttcataatctgcgactggtcagaggacatgtctctgtgttgcgcattcggacgtaccatctgcgcgatagctgtagtatccatcgcttcatcaatgaaccgctttgaagcaagctactaatgcatgtgtcagtgggtgactgnattctctcggaagtacagagatgctgtcgtgacttgtggattaaaaaaaaaaaaaacgagacgctcgaggtaccaaatt

SEQ ID NO: 62419 - protein, 143 aa, Zea mays
  misc_feature: Ceres CLONE 1527558
MSERCKGGKGLGKDGTKRHRKVLRDDNHRITKPAIHTMDNMDDVNHISSVIYKKTHYLLKNFHENDIRYTDTYVEHDTPQDRDRHESRLRAQEPRPHPLRVQRVRDSPLHNLRLVRGHVSVLRIRTYHLRDSCSIHRFINEPL

SEQ ID NO: 62420 - DNA, 690 bp, Zea mays
  misc_feature: Ceres CLONE 1527561
  misc_feature: Encodes the peptide sequence at SEQ ID NO. 62421
aagctggagctccccgcggtggcggccgctctagaactagtggatcccccgggctgcaggaattcgtctcacccctagaaaaaacagcctccaccccatcaaccctacttaggcgccgtcgccgccgcgtgcggcccccgcatcgtcgagaagatgcatcatctttggtcgggactctgaccgggatcaccgtcactttgcaggtggagtcctcccacaccatcgacgatgaggaggcccacatccaggacaaggagggcctccccccggaccaggggcagctcctcttcaccggcaagcagctccaggacggtcgcaccctcgccgactacaacgtccagatcgagtccaacctccgcctggtgctccgcctccgcgggggcgccaagacgcgtaagagaagaacctccgccaggcccacgaccatcacgcgcgacacaatacggtgacgctctccgcgctggagatctgtaaggtggacgacaccgctacccatgtgaccttcctccgacgggagtgcacccactctgatgctgatgcggtggtcttctggggccatcactgcaaccggctctactgctccaagtgcggcctcacctatgtctacggcctgaatgcgtagccgcgtgccctgatctgctcctaccgcataaccgatgcagcatcgagctgttggttagtccaactgaa

SEQ ID NO: 62421 - protein, 148 aa, Zea mays
  misc_feature: Ceres CLONE 1527561
  misc_feature (57)..(125): Pfam Name: ubiquitin Pfam Description: Ubiquitin family
AGAPRGGGRSRTSGSPGLQEFVSPLEKTASTPSTLLRRRRRRVRPPHRREDASSLVGTLTGITVTLQVESSHTIDDEEAHIQDKEGLPPDQGQLLFTGKQLQDGRTLADYNVQIESNLRLVLRLRGGAKTRKRRTSARPTTITRDTIR

SEQ ID NO: 62422 - DNA, 656 bp, Zea mays
  misc_feature: Ceres CLONE 1527563
  misc_feature: Encodes the peptide sequence at SEQ ID NO. 62423
  misc_feature (545)..(545): n is a, c, t, g, unknown, or other
  misc_feature (551)..(551): n is a, c, t, g, unknown, or other
  misc_feature (557)..(557): n is a, c, t, g, unknown, or other
  misc_feature (558)..(558): n is a, c, t, g, unknown, or other
  misc_feature (593)..(593): n is a, c, t, g, unknown, or other
tggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctaccgcggtggcgggcgctgtgatggcggtggcggctacgggcgtgggcgcngctacngtggcnngcggcgctacggtggtggtgggcgcggctaccgcngtggcaaccgtggcggcggctacgggcactcccacgggaactggaggaactgaaccgtggggc

SEQ ID NO: 62423 - protein, 155 aa, Zea mays
  misc_feature: Ceres CLONE 1527563
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
  misc_feature (123)..(123): Xaa is any aa, unknown, or other
  misc_feature (125)..(125): Xaa is any aa, unknown, or other
  misc_feature (127)..(127): Xaa is any aa, unknown, or other
  misc_feature (139)..(139): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYRGGGRCDGGGGYGRGRXYXGXRRYGGGGRGYRXGNRGGGYGHSHGNWRN

SEQ ID NO: 62424 - DNA, 695 bp, Zea mays
  misc_feature: Ceres CLONE 1527565
  misc_feature: Encodes the peptide sequence at SEQ ID NO. 62425
ctggagctccccgcggtggcggccgctctagaactagtggatcccccgggctgcaggaattcgtctcacccctagaaaaagtgggttgtggcctcctataatcctgtcctcgcgttactactagttagttagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcgccggacctggagtggtggttccatggcccgcccaagcaccagcagcacatgatgcgcctcctgacaaccaccaccaccaccaccaccggcagcttccgcttcgtgccccgctccgtggacgccctcgccgcctcgtccggcaccgtcatcgccgagggccacgagaggggttgctactgggtgcacgcctggaccgtgggacccgatggggtgatcacccagctccgtgagtacttcaacaccgacctcaccgtcacccgcctcgccgccgccgtcgccgccaagtgcgtctggcagagccgccgccccgacagcgccaccaactcccctgccgggactcctgctcgccctctgatcactctgagggataaattaa

SEQ ID NO: 62425 - protein, 109 aa, Zea mays
  misc_feature: Ceres CLONE 1527565
  misc_feature (2)..(100): Pfam Name: WI12 Pfam Description: Wound-induced protein WI12
MMRLLTTTTTTTTGSFRFVPRSVDALAASSGTVIAEGHERGCYWVHAWTVGPDGVITQLREYFNTDLTVTRLAAAVAAKCVWQSRRPDSATNSPAGTPARPLITLRDKL

SEQ ID NO: 62426 - DNA, 652 bp, Zea mays
  misc_feature: Ceres CLONE 1527567
  misc_feature: Encodes the peptide sequence at SEQ ID NO. 62427
  misc_feature (564)..(564): n is a, c, t, g, unknown, or other
  misc_feature (582)..(582): n is a, c, t, g, unknown, or other
  misc_feature (583)..(583): n is a, c, t, g, unknown, or other
  misc_feature (593)..(593): n is a, c, t, g, unknown, or other
tggagctccccgcggtggcggccgctctagaactagtggatcccccgggctgcaggaattcgtctcacccctagaaaaagtgggttgtggcctcctataatcctgtcctcgcgttactactagttagttagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcgccggacctggagtggtggttccatggcccgcccaagcaccagcagcacatgatgcgcctcctgacaaccaccaccaccaccaccaccggcagcttccgcttcgtgccccgctccgtggacgccctcgccgcctcgtccggcaccgtcatcgccgaggggcacgagaggggttgctactgggtgcacgcctggaccgtggaccccgatgggtgatcacccagctccgtgagtactttcaacacgacntcacggtcacccgcctcnngcgcggcgtngccgccaagtgcgttctgcaaaacccgccgccccgacacgcccaccattttcctggcgg

SEQ ID NO: 62427 - protein, 54 aa, Zea mays
  misc_feature: Ceres CLONE 1527567
MMRLLTTTTTTTTGSFRFVPRSVDALAASSGTVIAEGHERGCYWVHAWTVDPDG

SEQ ID NO: 62428 - DNA, 676 bp, Zea mays
  misc_feature: Ceres CLONE 1527568
  misc_feature: Translation starting site: 146
ggagctccccgcggtggcggccgctctagaactagtggatcccccgggctgcaggaattcgtctcacccctagaaaaatctcgacctccatcacccgcctccactcccccctcccaggtgctgcccaggtaagtcggcggcggtgatgacaacgcgcttcaagaagaaccgcaagaagcgcggccacgtgtccgccgggtacggccgcatcggcaagcacaggaagcacccgggaggtcgcggtaacgccggtggcatgcaccaccaccgtatcctcttcgacgagtaccatccgggctacttcgacaaggctggcctgcttcacttccataagctccgcaaccagttctactgccccgcggtcaacatcgagcgcctctggtccatggtgcccacccaccccccgcggaggccggccgcgacgaggccccgcacatcaacgtcacacagttccggctcttcaaggtgctcgggaagggggtgctgcccccaaagcccttggcggccagggccagcttcctctccaaggtcgccgagaataagatcaagggcgcaggcgggcgcccacaagcgtcccccgcctaggtttcaggccttgttccgccccccgggtttctaaattcaaattcccgcaccgggaagtgcttttccccggccccggccaatttgtggctaa

SEQ ID NO: 62429 - DNA, 622 bp, Zea mays
  misc_feature: Ceres CLONE 1527573
  misc_feature: Encodes the peptide sequence at SEQ ID NO. 62430
  misc_feature (482)..(482): n is a, c, t, g, unknown, or other
  misc_feature (492)..(492): n is a, c, t, g, unknown, or other
  misc_feature (493)..(493): n is a, c, t, g, unknown, or other
  misc_feature (502)..(502): n is a, c, t, g, unknown, or other
gcggtggcggccgctctagaactagtggatcccccgggctgcaggaattcgtctcacccctagaaaaattcctcatccagtgttgtgtcctagcgccgccgccgccccaactcgccttgcgtgactgaaagctcgtcggcttccgtccacgcgagaagcgagagcatggacacccaggtgaagcttgctgttgtggtgaaggtgatgggcaggaccggctccaggggtcaggtgacccaggtcagagttaagttcttggatgaccagaaccggctcatcatgaggaatgtcaaggggcccgtccgcgagggtgacatcctcaccctgctcgagtccgagagggaggccaggaggctgcgctgaagccctagcgttcttggtggggctctgtttgggtcttggtgtcttcgaatttgtgctatgtttgacttctgtgaccctgtcttgagagtagtaggcctggtgatagattgcagttttgnttatcctggnntgaaatggnaattggtgtgaagacatgggtatcccttgctaatttatctattaaacgacccctgcattgaattccaaaaaaaaaaaaaaacgagaccctcgaggtaccccattcccccctaaggggagc

SEQ ID NO: 62430 - protein, 65 aa, Zea mays; identical to SEQ ID NO: 5504
  misc_feature: Ceres CLONE 1527573
  misc_feature (1)..(65): Pfam Name: Ribosomal_S28e Pfam Description: Ribosomal protein S28e

SEQ ID NO: 62431 - DNA, 626 bp, Zea mays
  misc_feature: Ceres CLONE 1527574
  misc_feature: Encodes the peptide sequence at SEQ ID NO. 62432
ccccgcggtggcggccgctctagaactagtggatcccccgggctgcaggaattcgtctcacccctagaaaaaaaaccaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctccctgcactatagtgatcgtctatgctacatcatatttactcccctgtgctgaggccattccgcgaaagcacaactctttacatatgcatgccccgggcgaacaaaaacccgcgcttgctcttctggagcttctgttccagtgaagcatgttttaagggcccccctgggaagcttaacgaaattggcctaattaataaacccccggccaggaaacccgaaaaaaaggggggggtttttttaaattttaccccccctcgggggggcacaaaaagggggggaaaaatttttttttttttttttt

SEQ ID NO: 62432 - protein, 90 aa, Zea mays
  misc_feature: Ceres CLONE 1527574
MKGGKKEVAGAMVAILLVLQLMAAPPTAMAARSPHGAVPDGSLATTPKVTMLSATLCYTGETCKYIGCLTPACSLHYSDRLCYIIFTPLC

SEQ ID NO: 62433 - DNA, 723 bp, Zea mays
  misc_feature: Ceres CLONE 1527576
  misc_feature: Encodes the peptide sequence at SEQ ID NO. 62434
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (390)..(390): n is a, c, t, g, unknown, or other
  misc_feature (394)..(394): n is a, c, t, g, unknown, or other
tatcctggactccccncnngggcggccgctctagaactagtggatcccccgggctgcaggaattcgtctcacccctagaaaaagactatcccgccgggtagctaaccttatcttcccatggagccagcgaagctcgcagctttccttgccgtcgctgccgtcgcctacgctgttgccgtcgcaccggctgccgcggaatactccggcggcgcgaccgccccagaaagctgccagacgcaaatcatgtacttcaccaactgcctggcccgtgatgagatcctcgggcagtgctgtaggcgtggtcgagagccgcgagtgcctctgccagctgaagcgggaggtggcgctgccctgttttctgcctcgcccgggggagacgggggctcccangaangttctcctcctggccccccccaacttggacaagctgcatcgcctcccctggttggggacactcaagtgctgggatcctgtaacaaagtggccatatttgtttttggtacgcgtgtttctggtttgtttgcaaccgggtcccctggtaacggtataatcccctttcgggctggcgatgggaaggcggtaccttggtgccttggcctgggaaagaatcctatgggaggcctctgaaacgggtaaattaaggctgggggccgtcggaggttagctagtacgggtcttttgtgagggtgggtataaccctatgcgcacgggaccgtttggttg

SEQ ID NO: 62434 - protein, 169 aa, Zea mays
  misc_feature: Ceres CLONE 1527576
  misc_feature (91)..(91): Xaa is any aa, unknown, or other
  misc_feature (93)..(93): Xaa is any aa, unknown, or other
MEPAKLAAFLAVAAVAYAVAVAPAAAEYSGGATAPESCQTQIMYFTNCLARDEILGQCCRRGREPRVPLPAEAGGGAALFSASPGGDGGSXEXSPPGPPQLGQAASPPLVGDTQVLGSCNKVAIFVFGTRVSGLFATGSPGNGIIPFRAGDGKAVPWCLGLGKNPMGGL

SEQ ID NO: 62435 - DNA, 755 bp, Zea mays
  misc_feature: Ceres CLONE 1527577
  misc_feature (366)..(366): n is a, c, t, g, unknown, or other
  misc_feature (374)..(374): n is a, c, t, g, unknown, or other
  misc_feature (379)..(379): n is a, c, t, g, unknown, or other
  misc_feature (449)..(449): n is a, c, t, g, unknown, or other
  misc_feature (673)..(673): n is a, c, t, g, unknown, or other
gctctagaactagtggatcccccgggctgcaggaattcgtctcacccctagaaaaaagaagcttgcgctccgctgtcccgtctcctctccggcctccacccatggctcatcccctcctctcgtccgcgcttgtttgttcgcgtcttctccctgtagggaactccgttcccgggccccggctgtgagaggcgtcagcacgccccgcgggcagggaggtgaggctgctgagcgtgatgtgacaacagggactcaatggccgtggcggagtgaaagtgtagctgaaccgcctcgcaatgctcgggcttccccggcacgggtaggcggatgtattttatcacccccaaaggcggagggggggggtgtttntatttagncgcgnaagatcgccccccccccccaccggacgttctctcggaccgttcctttgccccccctcaatctaccccgantcttcccagtccgcgaacttcggcaaacgcgagcggtgtagactcatccaaggcccctctttccccaaaaccggcgcggagctttgtggaagacggccctctagcttattgcccatcgtccgtaatgccgtctcgggtcgcgcttccttgacttctctcacctataacccttcaaaagtactcaggcacgcccgagcgctttttttatatctccctcctcgccncgccgatgccaatccgattggcctctatttgtcccgaccttgcaacgcccccggtacccatccgaccctgcccgaatacccg

SEQ ID NO: 62436 - DNA, 745 bp, Zea mays
  misc_feature: Ceres CLONE 1527580
  misc_feature: Encodes the peptide sequence at SEQ ID NO. 62437
atacctttctcggccttttggctaagatcaagtgtagtatctgttcttatcagtttaatatctgatatgtggaccatgtgttcacttcgatattaaatttattttttgtgggggagggctcactacagtagcttgctactggggtcctcacgtgtcgcttgggcgttgcactatagctcaagsctggcgcaccccaaaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacaatatgcatgcgccggccgacgacgacgcgcgctgcctctcgtgagcttctgttcaagtgatgcatgtttcaaggcatccatggatgctttacgtatatgcgtattaattagccgtgtcagggaaccggacagaagggggtgttgttttatatttacgtcttctggtgatcaaataaaggggaaatatatgttggatgtgtacaaaaaaaaaaaaaaaaa

SEQ ID NO: 62437 - protein, 90 aa, Zea mays; identical to SEQ ID NO: 58696
  misc_feature: Ceres CLONE 1527580

SEQ ID NO: 62438 - DNA, 703 bp, Zea mays
  misc_feature: Ceres CLONE 1527583
  misc_feature: Encodes the peptide sequence at SEQ ID NO. 62439
  misc_feature (576)..(576): n is a, c, t, g, unknown, or other
ggagctccccgcggtggcggccgctctagaactagtggatcccccgggctgcaggaattcgtctcacccctagaaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttccctggatgtcatttgattaattataagcaagtacgtgaagaaacgagggccagacgactgtcgtccagcgattggttatttgtgaacttgtcgtttgtcttcttatttcaactttccaataagccccttcgtgaagtgtcatccccttcaaagtctgtcgactgttacgtatacaaatctatatatcaaataaagacggcngccgtacgtgtgtatatgtctctatttctgatcttgcagtcgtttgcttaatcaatttgtctgtcactattttatctaataaaattgcacgtacgcatgtatatgggttcacagcaaaaaaaaaaaa

SEQ ID NO: 62439 - protein, 90 aa, Zea mays; identical to SEQ ID NO: 53771
  misc_feature: Ceres CLONE 1527583

SEQ ID NO: 62440 - DNA, 640 bp, Zea mays
  misc_feature: Ceres CLONE 1527586
  misc_feature: Encodes the peptide sequence at SEQ ID NO. 62441
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (309)..(309): n is a, c, t, g, unknown, or other
  misc_feature (319)..(319): n is a, c, t, g, unknown, or other
  misc_feature (384)..(384): n is a, c, t, g, unknown, or other
ggcggccgctctagaactagtggatcccccgggctgcaggaattcgtctcacccctagaaaaaaggcaccagcatagatctcgtgctcgccactattattctgcacagcaacgcatcagccttctggaaccatctcgccgccgccacaccacaatccacaacccgtcgaagcgaagcaagcaatggccggagtcggatcgaaggccctcgccgttgccgccgttctggcggccgtctccttctcggtggccgccgcggccgaagcgcccgcgcccagccccgtctccgccgccgtcgcggggnnnncgngttccgtttncgggcccccttcgcccgcggttatttttcgtcgccttcgccgccggccttcctcttcgccgccgntccgccacttgagccgattgggggccctccgtgccttgcaaggcttacttaagcaagtaattttccccccggccggccgcccgcccgcccgcctaaaattcaattttattggggaaggccttttcccggaggttccctaataagtaaaggggagattttgttttccgggggcctttccccgggccccccccccccccactttttttgggcgccggaaaacccgggttttcccctttgggggccaaggagaaagggt

SEQ ID NO: 62441 - protein, 113 aa, Zea mays
  misc_feature: Ceres CLONE 1527586
  misc_feature (41)..(41): Xaa is any aa, unknown, or other
  misc_feature (42)..(42): Xaa is any aa, unknown, or other
  misc_feature (43)..(43): Xaa is any aa, unknown, or other
  misc_feature (46)..(46): Xaa is any aa, unknown, or other
  misc_feature (68)..(68): Xaa is any aa, unknown, or other
MAGVGSKALAVAAVLAAVSFSVAAAAEAPAPSPVSAAVAGXXXSVXGPPSPAVIFRRLRRRPSSSPPXRHLSRLGALRALQGLLKQVIFPPAGRPPARLKFNFIGEGLFPEVP

SEQ ID NO: 62442 - DNA, 681 bp, Zea mays
  misc_feature: Ceres CLONE 1527588
  misc_feature: Encodes the peptide sequence at SEQ ID NO. 62443
aagctggagctccccgcggtggcggccgctctagaactagtggatcccccgggctgcaggaattcgtctcacccctagaaaaaaccacaccatcattccgagcacactattcttccctgcgcttgctcgctccttcttgcccccatggcgctgctcgccatcaagggcatggccatgtcgaccgccgccgcggccctcccaactcacaaccacggcgccgtctcatcctacgtctccaactactcctacgcgctcgcagcctccgccgccttcccccgcgcccgagctgcgttcgccgtcggcgccgtctatgtcggacaccgtcactccagttcttgacgtctactgcgggacaggagacaagacaacgaataggggcaaaaggttcaaccatacatatggcaatgccaggtcgcgcaacaagaagaagggaactgggcctgcgcggctctttgctccctcagctcctccaggcaacgatcagttcgatgatggggagatcatttcaatcgagatcgacgagcacttcctgtatacgttgtccgacttctgcctagctttatatttgccctgagcctaaattgccctagtttgtaccaaatcaaatacctacgtatttaaagtaattatttcctcccctaaaataatccaaggggagggctgccacccttttcaattaaa

SEQ ID NO: 62443 - protein, 87 aa, Zea mays
  misc_feature: Ceres CLONE 1527588
MSDTVTPVLDVYCGTGDKTTNRGKRFNHTYGNARSRNKKKGTGPARLFAPSAPPGNDQFDDGEIISIEIDEHFLYTLSDFCLALYLP

SEQ ID NO: 62444 - DNA, 617 bp, Zea mays
  misc_feature: Ceres CLONE 1527590
  misc_feature (147)..(147): n is a, c, t, g, unknown, or other
  misc_feature (197)..(197): n is a, c, t, g, unknown, or other
  misc_feature (201)..(201): n is a, c, t, g, unknown, or other
  misc_feature (202)..(202): n is a, c, t, g, unknown, or other
  misc_feature (214)..(214): n is a, c, t, g, unknown, or other
  misc_feature (235)..(235): n is a, c, t, g, unknown, or other
  misc_feature (244)..(244): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (307)..(307): n is a, c, t, g, unknown, or other
  misc_feature (313)..(313): n is a, c, t, g, unknown, or other
  misc_feature (332)..(332): n is a, c, t, g, unknown, or other
  misc_feature (333)..(333): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (390)..(390): n is a, c, t, g, unknown, or other
  misc_feature (391)..(391): n is a, c, t, g, unknown, or other
  misc_feature (485)..(485): n is a, c, t, g, unknown, or other
gctctagaactagtggatcccctgggctgcaggaattcgtctcacccctagaaaaagctactagttgctagtgctaccaagaacaggaaggaaacaccgccgccgccgcgccttccattccagtactctcggaggagggggggccanccagcgccatggtcacgtcgacgaccgccgccgccgtgctgtccccgccntccnnggccgggcttcncctggcgccgtctccccgggngcgcttggnttttcttttgtcccggggcggggggggctnnnnnnnnnnttttttttttaacccctccttggnggctanccccaacattttttttccnnctatcccgggaaaaagaaaagggggannnnnnnnnnnnnnnnnnnnnnnnaaccccnntttccttttcttaaaaaaaaaacaaaaaatccccctttttccccctccttgctgggggtggggggccccttcccctttttcctttccttggttnggtctggtcttgtttttcgtccctccccttacggccgcctcccccgtccccttttgttcgcccccgtctcgcttttggtgggcggtttcctctcggtgtgtttcccaccccgtggctccgggacttcccgcg

SEQ ID NO: 62445 - DNA, 700 bp, Zea mays
  misc_feature: Ceres CLONE 1527592
  misc_feature: Translation starting site: 151
  misc_feature (304)..(304): n is a, c, t, g, unknown, or other
  misc_feature (334)..(334): n is a, c, t, g, unknown, or other
  misc_feature (346)..(346): n is a, c, t, g, unknown, or other
  misc_feature (405)..(405): n is a, c, t, g, unknown, or other
ctccccgcggtggcggccgctctagaactagtggatcccccgggctgcaggaattcgtctcacccctagaaaaagtacttactcactctccccccacccgcgccaggccagacagactaactgagcacccgctgcaaggagtccgcgcccatggcgagcaccaacatggcgtcggccacctcgcggttcatgctggccgcgggcgtgcccaccggcagcagcggcggccgcgtcaacttcgcctcggcgcccaaccggcttggcaggaggctcgtggcccgggccgacaacgaggccgccgcanctgaggcggcggaaggggagggtgccgtgnccaccaagtctnaggtcgagaagccgccgccgatcgggcccaaagagggcgccaagggtgaagatctttanggagggagtcctactggtacaacgggatcggcaacgtcgtcaccgtcgatcaggatcccacacccgctacccggtggttgggcggttcaacaggtgaaataccccggggtgtccaccaaaaaataccctttgaagaggccttaaaaggtaaaatgagtggggcccggcccgcttaaggggtccccgcctaacctcccgggggattagatttgaaaaaatttggaaaataaggcctttgaaacctccctttttttgttggataagcgccaccaaccctccccctcatggggaaaaa

SEQ ID NO: 62446 - DNA, 696 bp, Zea mays
  misc_feature: Ceres CLONE 1527594
  misc_feature: Encodes the peptide sequence at SEQ ID NO. 62447
ctccccgcggtggcggccgctctagaactagtggatcccccgggctgcaggaattcgtctcacccctagaaaaactccaagcccactcctctgctgccgcattccaacccattcccatcctcttcaacggtcaacccagcgccaccagcagctccgcaggagagagatcgccggagcccatgacgaggggcggcggaggcgacatgaagtccttcttccgtcagcagaagacgcacgccgccgccgccactaccaagcccactggcggcgtctccaagaaggcggcggctaaccaccacaagaaggccgcgctcgccaccaacgtccacccggccccagatcacggcgccggcagccgccagcaggaggaggcggaggcggagcatcgggagagggcggcccgcgagttcgacatggacacgcgctacgggccatgcctcggcgtcacccgcgcccagcggtggcgccgcgccgccgcgctcgggctcgcaccgccgccggggctcctcgccttctgcgccgacgaacagccctgcctctgggagggccgcgtctaggctactggcggcggcggggtgcacatttccccgcgtttcgccgacatggctccatcagggttcaaaactagctcttgtgttggaaaatgcgggggccccggtccatccgtttctgctcccggtctaaccggaatcttgg

SEQ ID NO: 62447 - protein, 125 aa, Zea mays
  misc_feature: Ceres CLONE 1527594
  misc_feature (19)..(122): Pfam Name: DNA_pol_delta_4 Pfam Description: DNA polymerase delta, subunit 4
MTRGGGGDMKSFFRQQKTHAAAATTKPTGGVSKKAAANHHKKAALATNVHPAPDHGAGSRQQEEAEAEHRERAAREFDMDTRYGPCLGVTRAQRWRRAAALGLAPPPGLLAFCADEQPCLWEGRV

SEQ ID NO: 62448 - DNA, 627 bp, Zea mays
  misc_feature: Ceres CLONE 1527596
  misc_feature: Encodes the peptide sequence at SEQ ID NO. 62449
  misc_feature (627)..(627): n is a, c, t, g, unknown, or other
ctccccgcggtggcggccgctctagaactagtggatcccccgggctgcaggaattcgtctcacccctagaaaaagcaccagtccataggccggcctcctctcttaccttcccacaccccttctcgaccgtacgtagcctagttgtgcttggtagccagccagaaggtcgtcggccgatgatgggaggaagaacagtggccccgccgctcgtcctcgcgctggtgaccatcatcgccatcgcggcggccgagggggacgaggtgaagtgtggcggtgctctcgtgcggcgcgccgactgcccgtgctgtaccgtcgcgcccccgccgcgaacactactacagccctccccaaccgggaactaacccggggaagtcctccgtaaataacaaccgccgcccccgggggcgtaaattccaaatcggggaccccccccccgggaaagggccccctttaacccccaggaacccagggttaattccccggcgggggccccccggcccccccccccccccctctgggggtttttttttttgccttcccccccgggtgtttggggggggccccagggggccctcattgggggccccccaatggggggtttaaatttgaaaacacgcgccggggcgn

SEQ ID NO: 62449 - protein, 61 aa, Zea mays
  misc_feature: Ceres CLONE 1527596
MMGGRTVAPPLVLALVTIIAIAAAEGDEVKCGGALVRRADCPCCTVAPPPRTLLQPSPTGN

SEQ ID NO: 62450 - DNA, 701 bp, Zea mays
  misc_feature: Ceres CLONE 1527597
  misc_feature: Encodes the peptide sequence at SEQ ID NO. 62451
  misc_feature (307)..(307): n is a, c, t, g, unknown, or other
  misc_feature (385)..(385): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (399)..(399): n is a, c, t, g, unknown, or other
  misc_feature (400)..(400): n is a, c, t, g, unknown, or other
  misc_feature (403)..(403): n is a, c, t, g, unknown, or other
  misc_feature (404)..(404): n is a, c, t, g, unknown, or other
  misc_feature (625)..(625): n is a, c, t, g, unknown, or other
  misc_feature (670)..(670): n is a, c, t, g, unknown, or other
tccccgcggtggcggccgctctagaactagtggatcccccgggctgcaggaattcgtctcacccctagaaaagtccccgccgccacgccagagaggagaggaagagcgcgcggagagtgagagcccgggagaagcagcggctgggagcaagatggtgcagcgcctcacctaccggaagcggcacagctacgccaccaaatcgaaccagacccgcgtcgtcaagacacctggtgggaaacttgtgtaccagtacaccaagaagcgcgcgagcggaccgaagtgcccagtcaccgggaagaagatccanggaattccacacctgagacctgctgagtacaaaaggtccttgttgccccccccccccggggggggggggggggccatntnnnnnnnnttctnnccnngacctgcatttagggagaggatcatcccgggcttttttggggcggggaaacaaaaaaattttgaaaaagggttttaaaaaatcccaaaagacccgggataaggccctcctaaagactaccccgaatacccccacaaagttttgaatcccttccaaattttttctccccgggaaattttccgggggggattggggaaatccttggaatttctcctcacgggngggggagaggcgggggggttaaaattttgaggggggatttctttntgggatggatggggagtgcgggggagtcgtt

SEQ ID NO: 62451 - protein, 109 aa, Zea mays
  misc_feature: Ceres CLONE 1527597
  misc_feature (5)..(105): Pfam Name: Ribosomal_L34e Pfam Description: Ribosomal protein L34e
  misc_feature (52)..(52): Xaa is any aa, unknown, or other
  misc_feature (78)..(78): Xaa is any aa, unknown, or other
  misc_feature (79)..(79): Xaa is any aa, unknown, or other
  misc_feature (80)..(80): Xaa is any aa, unknown, or other
  misc_feature (81)..(81): Xaa is any aa, unknown, or other
  misc_feature (83)..(83): Xaa is any aa, unknown, or other
  misc_feature (85)..(85): Xaa is any aa, unknown, or other
MVQRLTYRKRHSYATKSNQTRVVKTPGGKLVYQYTKKRASGPKCPVTGKKIXGIPHLRPAEYKRSLLPPPPGGGGGAXXXXFXPXPAFRERIIPGFFGAGKQKNFEKGF

SEQ ID NO: 62452 - DNA, 910 bp, Zea mays
  misc_feature: Ceres CLONE 1527703-R
  misc_feature: Pfam Name: Ribosomal_L17 Pfam Description: Ribosomal protein L17
  misc_feature (910)..(910): n is a, c, t, g, unknown, or other
gggcgtctcggcttctttttttctgtttgatgcccttggaagcacgaatttcaggcatcccctcgaatgatcttcatgtccctgaacaagctcatgtgtccgccttaggtgcattatcctccccgcctcgagaacatccggatgatccttgtgttgccaccttctctgtctctttacctgtctccaacccctgcaaagtaggcatggactatatgcttctcataaataaatgccacagcctgtctcctcttgtgtatagatccatcctttgccaacgtgatcatcttctcgacatacttcctcactgcctttgaccttgactgtgaagtatttgtccccccatgcttcagcacctgtgtggttagcccacacagcagtgctttcctttcttccggaggcctgttaagtttaggaacgcgtctcccatgtcgcatcgcaactatccttccacgggcatcaataccaaacaacctatgctcatagcttgagttctcagcgcccagggagaggagattcgagacgggcgcgaggccagataatgacccgaggcagccgaccgatgcagccgtggccgccgccgcgggcgagaacgactaacggagcctgccctcgggggacgggcgaattgcagggacggactttactgacggaagcattgctccaggtcgacgctgagatcaccggcgacagtgaggcttacgggtatgcaaccttggccgaagggcgatgagcaccggcgaccagccagctgggggaactggattgccggattggctgaaccccttttcaacggggaagtaaaattcctgcagcccggggggaccatttcattctagaaaccccgcccacccccgttgaagttcatgattctgccaccctctatggaaagactaatttcccctcttgtctn

SEQ ID NO: 62453 - DNA, 965 bp, Zea mays
  misc_feature: Ceres CLONE 1527703-R2
  misc_feature (670)..(670): n is a, c, t, g, unknown, or other
  misc_feature (672)..(672): n is a, c, t, g, unknown, or other
  misc_feature (791)..(791): n is a, c, t, g, unknown, or other
gagcgtctcgtttttttttttttttttgcattcgttgaaatgcttagcatacaatgcaattattattatcactcttttgaccttgctaatccaaagctctcgcccccccacaactgaccataatgtacctagtagcaattcgtccaccaccatgggaggagtatctaccctcctggagcacttcacggaacatccttgtatttccacatcctctgggtccttacataccccccagcccttgcaacttcgctctcggactattttcttcccatacatcaatgccacaactccgtctcctctcgtgtatacaccccccctttgcaaacctccccaacctcgggacggactccctagtctcctctctgacaatgaatgggaaggaaggtgtccccccacgcttcagtcagctgtgtggttagcccacacatcactgctttcctttcatccggaggcactgctaagtttaggaaagcctctcccatgtcgcatcgcaactatccttccaccggcatgaattccaaacaacctatgctcatagcttgagttctcagcgcccagggagaggagattcgatacgggcgcgaggccagagaatgaccccaggcagccgaccgatgcagccgtggccgcctccgctggcgagaacgacaaaccgagcctcccactgggnangggcggattttccagggaaagaacctttcctgaacggtagcccatggtccaagtcccacgcttgagatctaacgtcgaccatgacgcgctttccgggtatggaacattgttgatcccgnctgccaattccaacactagccttaccagcccggaaggcgtgaaacgggtaatggctggattgtgcctaatgccattttaccaaacccgccaataaaatatgccttgccgccccaccggggcagccttttccattccagggaaaaacccgtccttggccaggctgggaatttatt

SEQ ID NO: 62454 - DNA, 668 bp, Zea mays
  misc_feature: Ceres CLONE 1527703
aaagctggagctccccgcggtggcggccgctctagaactagtggatcccccgggctgcaggaattcgtctcacccctagaaaaaggatgaatgagggacagattgctccgtttcgccgcttactgcacaggaactctgctgcggccacaatcctgtagaacttcagctcacggtggccatggcctggcatgtcagcctgtctctgaatgttgaggacatacgcgtacctcttctgcccgtcctcccccgctagcgccccggcccggtagttcctgaataataactatggtgacatcaagggccgtgaacccctccctctcgccttccttgtcctctagtgctccggtgtccagtcccatctctgggcgctctaccatatgaactgtggatagatagcatcaacttgtatggtctgacgcacgcacagattgataagaagctggacgatcttgcacatggccggtgactctcttagaactcacaatatttttggaactcctagcgtgtcttgcttactgctccctactaatagatactccgaccatattggcggacacttgctactctgccattatctataattgcgcgaggatcataaccttcgattagcatagatcactgcgcaatagtaacatggtctgacatgctatgcttttacgatatccaca

SEQ ID NO: 62455 - DNA, 566 bp, Zea mays
  misc_feature: Ceres CLONE 1527708
  misc_feature: Encodes the peptide sequence at SEQ ID NO. 62456
agcagcgttcagagtttggaaaattcagacttgagctagaaccagaggaacaccaaacacgcacgcgcccaccccccgaaacggagagaactgaccccgcagagaagatggccggcgagatgagctgggtgggcaagaagatccacctctacaacgtcaccatgggcctctacatgctcgattggtgggagcggtgcctattcaacatattggtgctgatcctgctctggttcgtctgcttcaatggctcccgcttcgcttccgacgtcttcgaaagccacctgaaggcgcggattttccaaggctcaaattacggcctggcaattggcacgccctcctcataggccttcagcgcaacacacagaagcagcgaaatctgctggttctggaatgttaactagttcccacaaactttagcgctgtcgtgatgtgtatgatgtggttccaatatgtaagattttttttacagttattctctttattttcttgttttgtgttkgattacacgatatcacaccctgaactctactgtaattaaaaaccattttctggtaaaaaaaaaaaaa

SEQ ID NO: 62456 - protein, 78 aa, Zea mays
  misc_feature: Ceres CLONE 1527708
MAGEMSWVGKKIHLYNVTMGLYMLDWWERCLFNILVLILLWFVCFNGSRFASDVFESHLKARIFQGSNYGLAIGTPSS

SEQ ID NO: 62457 - DNA, 689 bp, Zea mays
  misc_feature: Ceres CLONE 1527745
  misc_feature: Encodes the peptide sequence at SEQ ID NO. 62458
  misc_feature (371)..(371): n is a, c, t, g, unknown, or other
aaagctggagctccaccgcggtggcggccgctctagaactagtggatcccccgggctgcaggaattcgtctcacccctagaaaaaaagaaccactttcacctgaactcctgaagcaatggccatgagagctctcccgctgaccccttccaggagctcctcgtttggagctcaccaaaccaggccgagcggcggcggccccagatcagtgagagcttatgcgaagggagacgaggagggcgacaagcagtccctgttcggaagcatcaccgaggcgctggacttctcgcaggtccggtcggagaaggacgccgagctgctgtacgaggccagggagtccaccaaaggtggaggggagatgacgagggagcantacggagcacttaggcggaagattggtggcacctaccaggatttcttcaagtcatatgttgaaagcgacgggccatacgtgggaggagggttgggtcaacaagacctgcaagatctgcaagaaggacacaagggggggagcccgaggcaggttgacaagcttaggaaaatcccctcacgttgccgggcctgggaaaaccccaaaccgacaaattttttccccaaattcttcgcccgaatgaactatctgcgtcccggcaaaagcgttgcctccctcccccgggggtaaaagaatacaatattaagggaaggggttgtt

SEQ ID NO: 62458 - protein, 180 aa, Zea mays
  misc_feature: Ceres CLONE 1527745
  misc_feature (85)..(85): Xaa is any aa, unknown, or other
MAMRALPLTPSRSSSFGAHQTRPSGGGPRSVRAYAKGDEEGDKQSLFGSITEALDFSQVRSEKDAELLYEARESTKGGGEMTREXYGALRRKIGGTYQDFFKSYVESDGPYVGGGLGQQDLQDLQEGHKGGSPRQVDKLRKIPSRCRAWENPKPTNFFPKFFARMNYLRPGKSVASLPRG

SEQ ID NO: 62459 - DNA, 583 bp, Zea mays
  misc_feature: Ceres CLONE 1527769
  misc_feature (150)..(150): n is a, c, t, g, unknown, or other
ggagctccccgcggtggcggccgctctagaactagtggatcccccgggctgcaggaattcgtctcacccctagaaaaaagccgcgtggacgcacaccagcacctgccctcctcgccgtcgccgcctccctccgcgcgaccgatctacccntccgccgccacccatgtccgcttgaattcgcccgggaggacttccgcatacctgcgtttgtgaacacaacgtgatgggaagcaaaaatcatgtttcccccttgaccctcatccagggtgtcggggccccttttccaaaattgtctgaaaaaaagcccacactcactttgaaaaaaggggccccgcaaatcttacaccctatttaatctgtgaccccccttaaaaagggtttggtggcccaacccccttgggcagttttaaagggtggggcccaaaatgtgtttccctccctccggggggggaaaaagggggtttttttccgggggggggcggggggggttttttttttcccaagggggggccctctccatttaaacttcttttttccttttcatttataaaaaaaaacctctccttccggggggacgccaaac

SEQ ID NO: 62460 - DNA, 767 bp, Zea mays
  misc_feature: Ceres CLONE 1527820
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (29)..(29): n is a, c, t, g, unknown, or other
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
nnnnnnnnnnnnnnnnnnnnnnnnttttnnttttnnngtgccccacggaccaaagctggactccccgcggtggcggccgctctagactagtggatcccccgggctgcaggaattcgtctcacccctagaaaaaaagtgtccaatgcacgaactgatataagaaaccctagcggagccactaacacagtcgcctccttcctgcgccgccgcagccgccgccgctaccaccgcctcgcggtcgcctgcggctccgcgtttccgcacggaagttggtgaaggtttcttgaggctgagaacatgatgctgaagacggaactttgccgcttcagcggccagaagatttatcctgggaaaggcattagatttatcccgtgctgattctcaggtcttcctttttgccaactcgaaatggaaagcgctacttccacaaccgcctgaagcctgcaaagctttaccctggacaccaatgtacagggaaagcagcacaagcaaggatatccattgctgaaagccgggtaaagaaggagggcgtcccccgcccccccagaaagcccttactcccaggtcaaattggtggggggcttcccttgggaagtaattccaaaaagaagaagagctgaaaatagccagaaggtcccgcgcatgctgctaagagaaagcctggctcttttgtggagatcaaagggagcgctttcaaggaaaaactaagggattgaagaaaaaaagccgaaaaaaagggcggaaggtggagccaagtcccccgaaag

SEQ ID NO: 62461 - DNA, 758 bp, Zea mays
  misc_feature: Ceres CLONE 1527835
  misc_feature: Translation starting site: 234
  misc_feature (9)..(9): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (31)..(31): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (48)..(48): n is a, c, t, g, unknown, or other
  misc_feature (758)..(758): n is a, c, t, g, unknown, or other
ttttttttnttnntnnttnnntttttttatnatttnnngagaganaanattttaaagctggagctccccgcggtggcggccgctctagaactagtggatcccccgggctgcaggaattcgtctcacccctagaaaaacttcaacgaggaatgcctagtaaagcctctccgcctccgctcctcgcgccgccgccgcgtctcctcctgtacaggtaaggagaggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaaacatgaagtcaagggctgggagaggctttacccttgaggagctgaaggctggctggcatcccaaagaaagcttgctccaaccattggtatttctgttgatcacccgccgcaagaacaaatcccttgagggactgcaggccaatgtccagaaggctaaaaacatacaaggcccaagttggtttatccttccccaagggcgttggggtacaccaccaaaaggggggtgttttaataaacgcgcccctccgtcgcccctcttcaaattctcccattttttttttttttctttttctcttttctatcttttctttctttttttctttatctn

SEQ ID NO: 62462 - DNA, 764 bp, Zea mays
  misc_feature: Ceres CLONE 1527846
  misc_feature: Encodes the peptide sequence at SEQ ID NO. 62463
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (35)..(35): n is a, c, t, g, unknown, or other
  misc_feature (37)..(37): n is a, c, t, g, unknown, or other
  misc_feature (43)..(43): n is a, c, t, g, unknown, or other
tttttttttttnnntnnnnnntttntttttttttntntttttngcctttgttttcaaactggagctccccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacaaaacggtcgacatggctcgcacgcaatctgccgtagcggtcgccgtggtggccgcgttgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggggtcagcggcctcaaacgccggcaacgccccctggattcccctccaagtggcagggtcggcattccccctacaccaatcagcaccctccacccaatggctcccagggtgaactaaaaacctaaaaccaagcccggacaaacggcgcggcctgtaataaaatcgacccaaccctttcccgccccgtcccccggccgggcccggaaaacaaaccacaccgtcggccaagggagagaatatcctaattcaacctggaccgccgggggaaagaattccca

SEQ ID NO: 62463 - protein, 124 aa, Zea mays
  misc_feature: Ceres CLONE 1527846
  misc_feature (32)..(111): Pfam Name: Tryp_alpha_amyl Pfam Description: Protease inhibitor/seed storage/LTP family
MARTQSAVAVAVVAALLLLAAAATTSEAAITCGQVSSAIAPCLSYARGTGSGPSASCCSGVRNLKSAASTAADRRAACNCLKNAARGVSGLKRRQRPLDSPPSGRVGIPPTPISTLHPMAPRVN

SEQ ID NO: 62464 - DNA, 690 bp, Zea mays
  misc_feature: Ceres CLONE 1527892
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (255)..(255): n is a, c, t, g, unknown, or other
  misc_feature (269)..(269): n is a, c, t, g, unknown, or other
  misc_feature (270)..(270): n is a, c, t, g, unknown, or other
nnnnnnnnnnnnnnnnnnnnttttnnnnnnnccccttttnnnccccagttnnnnnnccaaagctggagctccccgcggtggcggccgctctagaactagtggatcccccgggctgcaggaattcgtctcacccctagaaaaaccccagccccactctctccatctagagctccctaactgcaccggccgccacaccaccgtaccccgacccctcgacaacaatggccaccgtcctaggcagcccccgcgcgccanggccttcttcttcnntcgccgtccttccccctccgtgcccgcgccgggcgcccaccgccggtggcgctgcctggccggccaaagggggggcattcatggggcccccgtaaccggccacgcaaacaaaggggggccaaggggtttggccccccccagggccaccctttaaaaaaggggaaaaatttaaaatacccccccggaaagggggggaaggggggaaaactttcaaggggggccccacaaaaaaaattgtacaacttccttggaaacccaagggcccaaaaaaagaaagagaggggtttaaaaaattgggcccatataattcttgtgtgtgcgagaggggggggggggcccccccgggggtccccccccctccccagtggggggggcgcggccgggtgggggggaagagagggagaggaggaggtgcgctcc

SEQ ID NO: 62465 - DNA, 664 bp, Zea mays
  misc_feature: Ceres CLONE 1527893
  misc_feature: Encodes the peptide sequence at SEQ ID NO. 62466
  misc_feature (664)..(664): n is a, c, t, g, unknown, or other
aaagctggagctccccgcggtggcggccgctctagaactagtggatcccccgggctgcaggaattcgtctcacccctagaaaaaagcagcagcagcacagtcatccacactaacgaacgaactcttgctccgatcacgagctagctgaggtcgacgatggcggctgtgctgaacagcacaaagacggcgcaggcggtggttgccgtgctggtggcggcggcgctgctggcttcgtccacttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcctgccgctgcctcaagagcctcgccaacagcgtcaagagcgtcaacatgggcaccgtcgccaccatccccggcaagtgcggcgtctccgtcggattccccatcagcatgtccaccgactgcaacaagatcatctaagttacgacaacaagcctaataggcctaccgaacgtacacgaacgtcccgcgcgctggcagagtgatgaagcccggggaaaaataaaaaaaacgcccctgtattgccaggaagcccctgcatttatttatcgatctn

SEQ ID NO: 62466 - protein, 123 aa, Zea mays
  misc_feature: Ceres CLONE 1527893
  misc_feature (34)..(119): Pfam Name: Tryp_alpha_amyl Pfam Description: Protease inhibitor/seed storage/LTP family
MAAVLNSTKTAQAVVAVLVAAALLASSTSAAITCGQVGSSLAPCIPYATGRASALPASCCSGVKSLNSAARTSADRQAACRCLKSLANSVKSVNMGTVATIPGKCGVSVGFPISMSTDCNKII

SEQ ID NO: 62467 - DNA, 604 bp, Zea mays
  misc_feature: Ceres CLONE 1527896
  misc_feature: Encodes the peptide sequence at SEQ ID NO. 62468
tccccgcggtggcggccgctctagaactagtggatcccccgggctgcaggaattcgtctcacccctagaaaaaaaaaccaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacaatatgcatgcgccggccgacgacgacgcgcgctgcctctcgtgagcttctgttcaagtgatgcatgtttcaaggcatccatggatgctttacgtatatgcgtattaattagccgtgtcagggaaccggacagaaggggggtgtttgtttatatttacgtccttctggggatcaaataaaggggaaatatatgtttg

SEQ ID NO: 62468 - protein, 90 aa, Zea mays; identical to SEQ ID NO: 58696
  misc_feature: Ceres CLONE 1527896

SEQ ID NO: 62469 - DNA, 844 bp, Zea mays
  misc_feature: Ceres CLONE 1527907
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (49)..(49): n is a, c, t, g, unknown, or other
nnnnnnnnnnnnnnnnnnnnnnnnnnnnnnngggcgggccccccccccnccaaattcttactcccctcggtggctgccgctctagaactagtggatcccccgggctgcaggaattcgtctcacccctagaaaaaactgcatccccgggaacagagcgaggcgacgccgaggcacctcatctccggcgaagggaaatggccagcgttctaggggatctgatctgggggattgtgaagaagaacattattgtcctggtgagacaccccgcccccccgccctgccccggctctgtgtcaccaacgagcccaccgacccggccaatttatgcggcggtcaagtactctgcttttcccctaccatcacgtttctattgatagctccccctctttatcctcgcaacttcggttgtgcgttctttttttttttttttttaccgcgcagggggggggggggggggcggcctacccctcggtctattagcgccctccccacgccggggggcgaggtggccgctcaggatgggccgaccgccgcgttgttatgttacttgtgtttttgccgtccccctcccttcctgtcggctccctagattgctatcccacttccccgccgtgctcgtccgtttctgccccttcctgttatgaacccccagactcccagtgacacacaccttttttctcctctttttatcatgttcccagaaaacagttctcatccgatcaccccccccctccccccccaagataccccccccccccccaccccaccacccccccaccacatctttatctcagtcccatcccctggctgtgttgatccagtttgcctccctctacattttctc

SEQ ID NO: 62470 - DNA, 802 bp, Zea mays
  misc_feature: Ceres CLONE 1527940
  misc_feature: Encodes the peptide sequence at SEQ ID NO. 62471
  misc_feature (19)..(19): n is a, c, t, g, unknown, or other
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (60)..(60): n is a, c, t, g, unknown, or other
ttttttttttttttttttnngggggcnntnnnnnnnnnnnnggaaaannnnnaaaattgnagctcaccgcggtggcggccgctctagaactagtggatcccccgggctgcaggaattcgtctcacccctagaaaaactcctgcagtccttctccacctagctcccccgcgccaagaacacgccagctagcaagcgcgctcgatcgaataccgttaccgtgtcgccatggccgccaccgcgtctctatcagccgtcgcggcgccgctgtcggtgcccgggctcaagaagccgctcggcccgtcgacgctccggcccctgcagccgagggccgggaggatcgacgacgacggccgggcgggcgtcgggcatccccctacgccacgtccatcaaggggaaagggtggcgggcccggttttcaccccccccggcccgggggggggggggggggggggttctttccccgaaggtcctccgaagccccgcgcacgcctggccggggcttgccctcccccccgcctgctaagaaagcgtggctccgcacgccccacgagggagcccgcgcggggcgccgcgcgccccccccgccgatgtttgctaatgagccccatataagcccgcccatctaccgcggactgcgaagggcgcgccgaagagggggggcagcggacgcggggagcccccccagaactagggcactccgccatgcgcatcgccggactcggaggcgggacgccggcgggcgggcgaacgcctagcagcccgctcgcgccgtccgacgttgttgggcctccttgcgtgccc

SEQ ID NO: 62471 - protein, 33 aa, Zea mays
  misc_feature: Ceres CLONE 1527940
MRIAGLGGGTPAGGRTPSSPLAPSDVVGPPCVP

SEQ ID NO: 62472 - DNA, 885 bp, Zea mays
  misc_feature: Ceres CLONE 1527942
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
nttttttnnnnnnnnnnnnnnngggtgtnnntgtggggggnnnggtgtgnnnnnnnncaagctggagctccccgcggtggcggccgctctagaactagtggatcccccgggctgcaggaattcgtctcacccctagaaaaatctaccggagcgcgtctcggggaggagagagaagtcagatccgtgttccgtgtccgcgtccagtgtgtccgctactcggctccccctcagtcctaagttcctcacctaggggtagcgtgcgcgcgggagacgtaaatggcggcttccgaggcggcagcggcggcggcaaccccggtgacgccaacagaggggacggtgattcgccatccacaccctggaagaataggaccatccggatcggaggagggccaacagcgcccaaaaaggtggggggaggattggccccccccccggcgctggggggggggggggcgggggccgacccccttgggcctcccaatttgttggggtggtgtggggggggaagggggggtgcccccaaatggcgttggtcattccaccggaaaacaacccgacgctctcccaattagaacacttcgccggcgccgcttcttggcgtgggagccaaactgttctgtgggcgaggagtgggctggagtggcctccattgtgtttcctgggcccccctcccccatgggtccccgcgttggccgtgggccgaggcagccgcggtttcctcttgtgccgccctgcgcgaatggagaggagagcggggcgggacggagggggcgacggcagacgtggatggggggggtgacccgccctttatatagagataatacctccccagggcgggacgggggacaccgcccgacacggagaggcagcaccggctcctacccc

SEQ ID NO: 62473 - DNA, 807 bp, Zea mays
  misc_feature: Ceres CLONE 1528243
  misc_feature: SWISSPROT Homolog: EC 3.6.3.6 Proton-exporting ATPase
  misc_feature (5)..(5): n is a, c, t, g, unknown, or other
  misc_feature (21)..(21): n is a, c, t, g, unknown, or other
  misc_feature (46)..(46): n is a, c, t, g, unknown, or other
  misc_feature (57)..(57): n is a, c, t, g, unknown, or other
  misc_feature (59)..(59): n is a, c, t, g, unknown, or other
  misc_feature (60)..(60): n is a, c, t, g, unknown, or other
aaaanccgggaagggcggccncccccacaatttaatcgggcatgtngtgtgaaaaanannaaaaaactgagaatcaacgaggaggaggaggctctttcctaatggatcccccgggctgcaggatttcctctcacccctagaaaaaacaagaacagctaccgcgagctgtccgagatcgcggagcaggccaagaggcgcgccgagatcgcgaggctgcgggagctcaacaccctcaagggccacgtggagtcggtggtcaagctccagggcctggacatcgacaccattccacagaactacccggtgtgagatgtgtgccgtgatgtccattaaaaaggcgttggggcatggaaccctaagaagaaccagctaaaaaccggaggcccgctgagtggcgcccgacaaaaaaaaaaagaatgggggcgtccccccccccccccccccaagtggggggggggtaattgaggtcatgaaaaataattttttttcacccccgtggggggtgggtggttaagggtggcgcgagaactcggggaaaaaaccctccgggcgctccccctctattctgggtggcgtgccactatcgcggggcctgccccacccgctgtggcgcctctacttgcagctggctgattcggggggagggggctccacgcgcgcgggccgcacacatctccacaacagatttgatcgcgcgtcgtgatttgggggctaaagctaagtgttgcgggcggccgggggccaactcttctgacatgcccgggtggccgggtagcgggtttcgcaccacaaactagccggtggagc

SEQ ID NO: 62474 - DNA, 658 bp, Zea mays
  misc_feature: Ceres CLONE 1528245
  misc_feature (363)..(363): n is a, c, t, g, unknown, or other
  misc_feature (632)..(632): n is a, c, t, g, unknown, or other
  misc_feature (636)..(636): n is a, c, t, g, unknown, or other
tcccccgggctgcaagaattcgtctcacccctagaaatttagctagcacgagcctttggaggaaccggaagtttcttatctggagctactgaagaaggcaggaatcatgccataaataagaaggcctgttcttcttctgttgttgtaatgtttttgtttttaaacttcgccgtatctgtagctgtttgtttcattccataggtatgaactgtttatgttcctcattaaaatttccggaagtctccccccaaaaaaaaaacaaacaacacaccctccccctattctctcaaggtcacccaattcgccctaaaactttttttttcccccccccaaaaaagagggaggggggagttaataacatcnacaccccaccaccccccccggacgataacaaaaaaaaaaataaaccttggggggaaaaaacagcggtttacacccaacctcaccataaatatcgaaaaaagccccccccccccataaacccctctccccaaaaagggcgcctccagacagaaaaccccacaacgcgtgggctacaaaacgtcttataaaaatcaaaagtgaaaaccccaactcggaatctctccacctcaatacacaacgaacgcgccacaatccgcggacaaccaccnaaancagcgcgaatacataccgccgg

SEQ ID NO: 62475 - DNA, 823 bp, Zea mays
  misc_feature: Ceres CLONE 1528250
  misc_feature (17)..(17): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (358)..(358): n is a, c, t, g, unknown, or other
tttttttacccctgttnttttttnnnnnnnnnnnnnnnnnnnggggaggnnnnacataatggagctgcccgcggtggcggccgctctagaatagtggatcccccgggctgcaggaattcgtctcacccctagaaaaaccgagcatgacatcgtttctgttcacaactcttccgagcatgccgtcgtctcctttgtcatcatcatcagctcagatctagcaactgcgccttctcagagtgttaagtggaagcaacatatgaagctgacatggaaaaggaagatggaaccacactccccatgaagcttgtaaaaaaggagtcaaactcaatttattctaggggcaaaaaccaaaaccaangggacttgtcctcctgttccaaagacaaacgaggcgaggcgggacctgttttttttcccccccccccccaggggggggggggggggggggattacactttcccctccctcccccccccccccccccccccgttgtgggggttgaaaaacggcggcaccccgcgccgggcgggacgcaaaccgcggggggcgcttattcacccctctcgcgggggggctaaaatgtggggacccctagttacgggggggtggcccatacaatccctgacttggtgcgtctggggcgggtgaggtctctgtggccgggcgcggcggggcccaaaaacagaaaagcgcgggcgggaggaagccagccgccgcgttcaccacccgggtcgcgcgcagaccttgctctctgacattcgcgcgcggcgggcccggagggcgtacacgagtccgccaccacaacaacgccccgcgccccagt

SEQ ID NO: 62476 - DNA, 631 bp, Zea mays
  misc_feature: Ceres CLONE 1528265
  misc_feature: SWISSPROT Homolog: EC 1.18.1.2 Ferredoxin--NADP(+) reductase
ccgcggtggcggccgctctagaactagtggatcccccgggctgcaggaattcgtctcacccctagaaaaacttcgatggccgaaccggaagcttgtgtgtccgccgtgcagtttattatgatcctgagactggcaaggaggacccctcaaagaatggtgtcatctcatcatgtgtgtcaatctttttttcgtgtatagtgtcaatatgtacacatctatgtggcatcatttttgttttcaccctagagtttgctcttgatgtatcatttgcccttccttttggaatttttatgttgaaaagaccttattgaggtttcggaaaaaataaaaagattctagacgctcgaggtaacccaattcgccctatagggagtcatatcagcgcagcctcactcggctttcttttttcaaccttcttgaactggaaaaaacccttcggcttacccaatcttaaacaacctttgttttgaattgtcctcttttgcaaaaatggcctaaattctcctataaattctccacttctttttagcactttttcccacaaaattttttcttcttcatatttgttttttttaaaatttggccagaacctcacaaatttgtgataaaaattccccgtgttatatatata

SEQ ID NO: 62477 - DNA, 643 bp, Zea mays
  misc_feature: Ceres CLONE 1528270
  misc_feature (469)..(469): n is a, c, t, g, unknown, or other
  misc_feature (643)..(643): n is a, c, t, g, unknown, or other
tctgaactagtggatcccccgggctgcaggaattcgtctcacccctagaaaaagagcgaccatgagcaatttcaattgtcactcttttggttagaaacagagggcccaagtagagtgttgagaggtttgtttttgtttcttctttctcctactagttctgctagagaagggtgtacctggtgtagtggtgagccgagtcatcaagtcgcgggttcgaagcatccagtctccgtatttgcgggagaaggtttgtctcggtttatctctttcccgctactcatatgggacaaatgtgggagcctcagtctggtcttttttttttccttactcccccccccactggggggggggggggacgtcctattcaaccacccccccccccccttggggttaataaaaaaactattatccaccctccttgcgatccagttcatcacatactcatatggtctaaactactataaccccncgctccaatccccccccccccgcccgctcattaaccatcccgcgctctcgggagtctaccccctcccccgcgcacaccctgctgggggcacacaacacacgtcaatcgcggcccccacaatatcagccacccctctcgatcccactcctctctgcgccttccacccaacacgcn

SEQ ID NO: 62478 - DNA, 666 bp, Zea mays
  misc_feature: Ceres CLONE 1528282
  misc_feature: Translation starting site: 197
  misc_feature: SWISSPROT Homolog: EC 3.2.1.23 Beta-galactosidase
aaagctggagctccccgcggtggcggccgctctagaactagtggatcccccgggctgcaggaattcccctaaccccgagaaaaatatatatatgagtagtatgcaatcacaaaactggtggtacaagcttccgctttccatttcctgttgggagtcgtgtagtgtaatcctggggtgtgtatttgtttcatcaaccatgcctgccgatttgaatctcgtttcaaaaaaaaaaaaaaaaacgagacgctcgaggtacccaattcgccctatagtgagtcgtattacgcgcgctcactggccgtcgttttacaacgtcgtgactggaaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgtaaaatttttgttaaatcagctcatttttttaaccaataggtcgaaatcggccaaaatcccttataaatcaaaagaatagacccgagatagggtttgagttgttgatccaagttttggaaaaagcattccccctatttaaagaaacttggtactcccacctttccaaagggcctaaaaaaa

SEQ ID NO: 62479 - DNA, 736 bp, Zea mays
  misc_feature: Ceres CLONE 1528292
  misc_feature: Encodes the peptide sequence at SEQ ID NO. 62480
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (21)..(21): n is a, c, t, g, unknown, or other
  misc_feature (50)..(50): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (736)..(736): n is a, c, t, g, unknown, or other
ngggggtatttnnanaacttnccccttgtgtgttttatgtgttattttanggggggggnnnnnaatggtgggactcaccgcggtggcggccgctctttactagtggatcccccgggctgcaggaattcgtctcacccctagaaaaaacagcgctttcctgtccgactcccagccgtcgtctgctgcgtactccgcctccagtttggtctgtttcttgcaagttgctcttgcggtagttcccccaactgtcaccatgcagaacgaggagggtaagactgtggacctctatgttcccaggaagtgctcggccacaaacaggatcatcactgccaaggaccatgcctctgtccagatcaaaataggccacttggatgcgaatggcctgtatgatggtcacttcacaacatttgctctctccgggctcgccccagctcaaggggagggggacagctcccttggacaggctgtccccccacgaagagggctgaaatctaggcagcagaatttcccatccaggtttaccccaaaaattggacaccgggccctaacctattgtgtctggaattaagggccaccggaaccaaatgggtggcgaattttccactcgctacccttatagcctgtaagtatctcgctggtattgactctaagatccctcttccggaggagtgcgacgaggaacaaaataaaacatgtagctgctctcccgaatgaacccccaaattgcgcccccctn

SEQ ID NO: 62480 - protein, 104 aa, Zea mays
  misc_feature: Ceres CLONE 1528292
  misc_feature (1)..(82): Pfam Name: Ribosomal_S21e Pfam Description: Ribosomal protein S21e
MQNEEGKTVDLYVPRKCSATNRIITAKDHASVQIKIGHLDANGLYDGHFTTFALSGLAPAQGEGDSSLGQAVPPRRGLKSRQQNFPSRFTPKIGHRALTYCVWN

SEQ ID NO: 62481 - DNA, 520 bp, Zea mays
  misc_feature: Ceres CLONE 1528301
  misc_feature: Encodes the peptide sequence at SEQ ID NO. 62482
ggagctccccgcggtggcggccgctctagactagtggatcccccgggctgcaggaattcgtctcacccctagaaaaagatcgtcccgagacggatccatttggctctggtcgtcacaaagttgtttgtgcatcgcggcggcgacaagggggcgacgaggcaggcggagcgggcggcgactacagcggcagcagatctcacggaatggcggcgaaggcaatctcgagccccgtgccggtggagtggtacccgacgctggccgtcgtcatggtatccgtaggcctcatgttcaccgccctccttcttcatttatgaagcaacttcatcccggaagaccgtagctgtcaaggaatcgcacagcagtgttgctctgtttctgggcttgggtctctgtccggcctctgcaagtggtgttatgtctaagacctgctatgggcgttggggctgtgttctgcctccccagttggagacctgggtttgacaaatcccccaagccggtggccctaccaatattggagcct

SEQ ID NO: 62482 - protein, 36 aa, Zea mays
  misc_feature: Ceres CLONE 1528301
MAAKAISSPVPVEWYPTLAVVMVSVGLMFTALLLHL

SEQ ID NO: 62483 - DNA, 713 bp, Zea mays
  misc_feature: Ceres CLONE 1528312
tggcggccgctctagaactagtggatccccctgggctgcaggaattcctctcactccttggaaaaaaaaaaaccgagacaccgcgtgcgaaccaagcagaccacagcaagaagcgtagtcgtctccggaaggaaaggcgcggagcaagatgtcgtggcaggcgtacgtcgatgagcacctgatgtgcgagatcgaaggacaacatctcagcgccgccgccatcgtcggtcacgacggtagcgcttgggcgcagtccgagagctttccccattttacgcctgaggaggctgctggtatcccacatggatcttgtatgacctgggtttcccttgcaccaacctggcctttttttttcccccgtcctaacgcggtgggggggggccctttttcccccccctttaccccctctttctttctttcacccaatctcccacccgcgcgcgcattttttctcgtcccaaataatcccgcgcctccgcctcttttctttatctctcgtgcttccacgcacagtaccccccttggtcccccctttgccaccccccacacccccgcccacctcgctagagggccttctcctcctcctctcacccaacctcatcaccccgcctctcaacacaccctcccccccactgtttcgtttctcgggttgttgcactaccgtgacccccctccctctcccgctcctcataccctccccgccttttttcggc

SEQ ID NO: 62484 - DNA, 656 bp, Zea mays
  misc_feature: Ceres CLONE 1528313
  misc_feature: SWISSPROT Homolog: EC 3.2.1.23 Beta-galactosidase
  misc_feature (1)..(1): n is a, c, t, g, unknown, or other
  misc_feature (656)..(656): n is a, c, t, g, unknown, or other
naaaagctggagctccccgcggtggcggccgctctagaactagtggatcccccgggctgcaggaattcgtctcacccctagaaaaaatcatttccatcgcttgcatagagacaatggccgtttttaggatttgtaggattgccgtattgttctgttcgatttatatctaaccctgcctgaatcctattttgtaccgtttcttagctactaattggtgccaaacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccaacagttgcgcagcctgaatggcgaatggaaattgtaagcgttaatattttgttaaaattcgcgtaaaatttttgtaaatcaactcattttttttaacaataaggcgaaatcggcaaaaatcctttataaatccaaagaataaaccgagattaggtttaagtgttgttcccattttggaaacaagattcccttttttaaaagaacggggactccaaccctccaaagggcaaaan

SEQ ID NO: 62485 - DNA, 705 bp, Zea mays
  misc_feature: Ceres CLONE 1528314
  misc_feature: Translation starting site: 170
ccagctggagctcaccgcggtggcggccgctctagactagtggatcccccgggctgcaggaattcctctcacccctagaaaaagcaacaaagacgacgcaggccctcagcctgtcctcactcctaaccctcgcccgactcagatctatctgccccgcgccgccgtcgccatgccgttcactccgggtccctactctggcgtcagcaccctcgcccttgtagcgagggcatcggtcttcggcttcggtgtcgtctacgggagcatctacgctctcaatccttctacggccaccaaacccctaataagggaatgaacccgatggcctcttctcctaaaggacaacggggctccctaacccgtctaccttttctaccggtacccgcctccatatttcccccacctttgggcgtgtgtgattttttttctcattcaaaaccgtggcacattttgtattctcccccccctccggtggggcaatttcctcgcgtttcctaacacccccctccttgcccggtcaggcgttcctctttaaaccctatttgggggcccgaatcccgcaacccacaccctctaaagatgtctcgcggcccattcttagggggggtccccccactttcctcccccttctacatgcggttttctccctgacaggtccgccccacaatggggcccttcctattttttaacccctccccctttcacccg

SEQ ID NO: 62486 - DNA, 645 bp, Zea mays
  misc_feature: Ceres CLONE 1528315
tccccgcggtggcggccgctctagaactagtggatcccccgggctgcaggaattcgtctcacccctagaaaaaagaaaaatttattcttgttgaatctaggatgtcttctttggggtctcaactagactgctccgtatgtacttcaaaaaccatagttttgatgccaaagttgttgcctaggaatttggtactcgggaattggtagcggacgtgaacaatgttaagttttgagcatttaaatttacctttgtcatgataacatgttgcgagtttttattttaatgctgggactgtttcgaaaaaaaaaaaaaaaacgagacgctcgaggtacccaatttcgccctatagggagccccaattaccccccgctcaactgggccgtgcgttttaaaacggccgggaccccccaaaaccctgggggttaccccaaatttaatcccctttgaaaaaaaatcccccctttcccccagttggggtaattaccgaaaaaggcccccacccgattgcgcttccccaaaaatttccccaccccgaatgggggaaatggaaaatttgaacccgtaaatatttttgtaaaaattccgcggtaaattttctggtaaaaacacccactttttttaaccccataggcccaaaacccgcca

SEQ ID NO: 62487 - DNA, 790 bp, Zea mays
  misc_feature: Ceres CLONE 1528320
  misc_feature: Encodes the peptide sequence at SEQ ID NO. 62488
  misc_feature (32)..(32): n is a, c, t, g, unknown, or other
gccatcgtgcaaaaatgattaaaagggccgcntcgggaatgggggaaggaaggaggtgtggtggtttaaactggagctccccgcggtggcggccgctctagaactagtggatcccccgggctgcaggaattcgtctcacccctagaaaaaaaacaggcacgctactttggtcattttgaactctaaatccccaaagctttttggcaaagcttatcttgtgtatatggattaattccaaagcaacttattttgttgttgtcactgtaattttgctggaacttttattttaggcatttttcaaagaacattatgtgcgacatgcgttggctgcattgaattgcataaaaaagaaaaaaaaaaaaaaaaacgagacgcctcgagggtacccaatttcgccactataagtgagtccgtattcccgcgccgctccaccgggtcggtcgtttttaaccaacgtcgttgacttggggaaaaacccttgggtggtttccccaatctctaaaccggtctttgggaaggaatatccccccccctttcccccaagatggggcgtcaaataccctaaaaaaaggcccccacacaccggattcggcccctttccccaaaaatgtggccccgcccgccctgtaaagggggcgaaatgggcataatttggtgagagcggtttaatatttttttcgctcaaaaaaatctctgggttaaaaatatttagtgtataagaccaacgcactctatttgtttttgacaccttaattaggagccgtaaaattcctgcaaagaagccacccat

SEQ ID NO: 62488 - protein, 32 aa, Zea mays
  misc_feature: Ceres CLONE 1528320
HRAKMIKRAASGMGEGRRCGGLNWSSPRWRPL

SEQ ID NO: 62489 - DNA, 735 bp, Zea mays
  misc_feature: Ceres CLONE 1528333
  misc_feature: Encodes the peptide sequence at SEQ ID NO. 62490
  misc_feature (12)..(12): n is a, c, t, g, unknown, or other
  misc_feature (13)..(13): n is a, c, t, g, unknown, or other
  misc_feature (20)..(20): n is a, c, t, g, unknown, or other
  misc_feature (21)..(21): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (259)..(259): n is a, c, t, g, unknown, or other
  misc_feature (357)..(357): n is a, c, t, g, unknown, or other
gggggggggccnngggagtnnaggaaccccttctnnnnnnnnaaagaaannnnnnnaaaactggaactccccgcggtggcggccgctctagaactagtggatcccccgggctgcaggaattcgtctcacccctagaaaaatcaggcatccaagaagctcaaagcaagcagatctaagctccaggcagcgtcgcgacagagtgagtgagtagcacgacaacaacaatggcttccctgaaggccgcgaagcccagcggagnttgcggcgcagggcaaggagccggcgcccaagctcagcgagacggcgacgaagccgtcagccgcgaagagcggcggcgttaagaaggctgaacaaaanccccgggaaaccaaaaggaaaggtgaagaaccacaaaacggccggcgggcggcccaaaaatgtgtttttacaccccttgggggaggggaaaggggagccttccatggcatgaaacgaaacccccccccccggttactgaatcacaaggccctgccctttgctggggatcccggcccatagaggacgaccggcgtagattctttctcccccccggcgcaccgggacgaatcgcccccaaagaaaacaacctcccctgctttaaaggggagggtccgggttggggggcgacgaaaaaatgggtggggtactagaaacagccggaccagggcgtgggggttagacgtgtgttggcctggaaaccgggcgaatagcaggcag

SEQ ID NO: 62490 - protein, 38 aa, Zea mays
  misc_feature: Ceres CLONE 1528333
  misc_feature (12)..(12): Xaa is any aa, unknown, or other
MASLKAAKPSGXCGAGQGAGAQAQRDGDEAVSREERRR

SEQ ID NO: 62491 - DNA, 575 bp, Zea mays
  misc_feature: Ceres CLONE 1528338
  misc_feature (20)..(20): n is a, c, t, g, unknown, or other
  misc_feature (21)..(21): n is a, c, t, g, unknown, or other
  misc_feature (482)..(482): n is a, c, t, g, unknown, or other
cagagctgggagctcaccgnncggtggcggccgctctagactagtggatcccccggctgcaggaattccccacctccgggaaaaaaaaaggccaaaactcatcggcaatctcatctgaaattctctcgcctgaacgtccaagcacaatcccgaaccctaaccaggcgcccccagttcgccgttcggcatgtcccgccggttgctccgggagtcctccagagcgtgggccctccgcggaaacgagttcccaacaagaacaaccggtggggaggaggtttttcctctgccaatttcgggcggaactctttccatttcctcgacaaaggaaaatgccccccctttccccccaaattttattggccttccccctcccagcgggggggttctccctttatactctcctttcccgaatgagtaagtgttttcgtgggcccccaaaaaccaatggcaccgcccccccctgcgcgagaaaaaaaacattntgaagggttccccccattactagggaaaaacatccgtatgcccccctttggtaccctcgccgtattcccttttttacccccgcccttctcccc

SEQ ID NO: 62492 - DNA, 626 bp, Zea mays
  misc_feature: Ceres CLONE 1528748
  misc_feature: Encodes the peptide sequence at SEQ ID NO. 62493
  misc_feature (377)..(377): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (605)..(605): n is a, c, t, g, unknown, or other
tccccgcggtggcggccgctctagaactagtggatcccccgggctgcaggaattcgtctcacccctagaaaaaaggacgacccaagcaagcaagcaagcagcgagtatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctggctgcncaacggctggataccctgcctcgagttcagcaaggtcggcttcctgtacccgcgagaactcccccctccccgggctactaacaaggggcggtttatggggaaaaggtggggaaaccgccccccctggtttttgggggggaaaaaaaaaaacccccccccccggggtgtaacaaaaaaaaattcttnnnnggggggggtaatatattttctggggggggttttccccgnggttattggtttgtaaaaaag

SEQ ID NO: 62493 - protein, 108 aa, Zea mays
  misc_feature: Ceres CLONE 1528748
  misc_feature: SWISSPROT Homolog: EC 4.1.1.39 Ribulose-bisphosphate carboxylase
MAPTVMMASSATAVAPFQGLKSTASLPIARRSSRSLGNVSNGGRIRCMQVWPAYGNKKFETLSYLPPLSTDDLLKQVDYLAAQRLDTLPRVQQGRLPVPARTPPSPGY

SEQ ID NO: 62494 - DNA, 718 bp, Zea mays
  misc_feature: Ceres CLONE 1528758
  misc_feature: Encodes the peptide sequence at SEQ ID NO. 62495
tacccgcggtggcggccgctctagaactagtggatcccccgggctgcaggaattcgtctcacccctagaaaaagccaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggtatcttcatcccggagttcctgaccaagatcgggcgtctcaacacgcccttctggtacaccgccggcgagcagcattacttccacgacaccaccaccctcttcatcatcgagctcatcctcatcggctgggccgaagggcgccgttggggctgacatcattcagcccggaagcgtcaaccccgattccattcttccccagcaacaagttcaccggcaccgacgtcgggtaccctgg

SEQ ID NO: 62495 - protein, 170 aa, Zea mays
  misc_feature: Ceres CLONE 1528758
  misc_feature (73)..(171): Pfam Name: Chloroa_b-bind Pfam Description: Chlorophyll A-B binding protein
MALVSASSSSTTAVAALPRNGQQRASSSLFSSSSSSSFLVGKTLLRQAEAARPSFAVRAAADSDRPIWFPGSTPPPWLDGSLPGDFGFDPWGLGSDPESLRWNVQAELVHCRWAMLGAAGIFIPEFLTKIGRLNTPFWYTAGEQHYFHDTTTLFIIELILIGWAEGRRWG

SEQ ID NO: 62496 - DNA, 714 bp, Zea mays
  misc_feature: Ceres CLONE 1528759
  misc_feature: Encodes the peptide sequence at SEQ ID NO. 62497
ggagctccccgcggtggcggccgctctagaactagtggatcccccgggctgcaggaattcgtctcacccctagaaaaaatcagcctcatcaacctcgacgaaggaggaacgaacggacaggttgttgcacagaaacgacatggctttcgcgcccaaaacgtcctcctcctcctcgctgtcctcggcgttgcacgcagctcactcgccaccactagctcctgcagacgagatgtcctctcaccgcaacaccgaaacggacgtacgacgcggccgtcgtcgacactaccaccaccactgctagagctgcggcggctgctgacacggttcccgccgacccgccggacgcggcggcgccggcgccggtgccaccaaagcaagcggcggcacccgccgagaggaggaaccgtacggtgtctgacaccatggcggcgctcaaggacgagggcaagacggcgtacatcccgtacatcaccgccggcgacccggacctagcgacgacagccgaggcgctgcgtctgctggactgatgtggcgccgacttcatcgagctgggggtacactgctgcggaccctacatcgacgaggaccacatccgggcgtctgtgcagcgggctctggacaacaacccagccatggacgacgtgctgcacatgctcaaggacgtgacgcccgagcagacgtgtgccgaggagctcctctcctactacaatccca

SEQ ID NO: 62497 - protein, 34 aa, Zea mays
  misc_feature: Ceres CLONE 1528759
  misc_feature: SWISSPROT Homolog: EC 4.2.1.20 Tryptophan synthase
MAALKDEGKTAYIPYITAGDPDLATTAEALRLLD

SEQ ID NO: 62498 - DNA, 818 bp, Zea mays
  misc_feature: Ceres CLONE 1528760
  misc_feature: Encodes the peptide sequence at SEQ ID NO. 62499
agggttttttgccaaatcgccgccgtcgctctgcccgcattcccttccacaacaccgagacgccaggatgacggcgcagactgcggaggagctcgccacccagatcgagcagcagaagctcgaggagcagaagaccgaggcagaggaggttgtggtggaggatgaggaggacgacgacgatgaggacgatgaggatgatgatgaacttgacggacaagaaggggatgccagcggcaagtcaaagcaaagcaggagtgagaagaagagccgcaaagccatgctgaagcttggcatgaagcccatcactggtgtcagccgtgtcactgtgaagaaaagcaagaatatactgtttgtcatctcgaagccagatgtgttcaagagcccgaactcagacacatacgtcatattcggcgaggccaagatcgaggacctcagctcccagctgcagacccaggccgcagaacagttcaaggcccctgacttgagccagatcacgagtccagagacttctggcccgggccaggaagacaatgacgaggaggtcgacgaaactggtgttgaggccaaggacatcgagctggtgatgacccaggcatgtgtttcgaggcccaaggctgtcagggccctcaaggcttctaatggggacattgtcactcgccattatggatccgacaacttaaaaccatttttttttctctctccctttggagtgccatgctatgcagcttgagtgttatctgtggaccatatggttagagatgttagcatgatggcttcttctgtcaaggtcattcaaacacggtttcatctttgctggc

SEQ ID NO: 62499 - protein, 220 aa, Zea mays
  misc_feature: Ceres CLONE 1528760
  misc_feature (62)..(121): Pfam Name: NAC Pfam Description: NAC domain
MTAQTAEELATQIEQQKLEEQKTEAEEVVVEDEEDDDDEDDEDDDELDGQEGDASGKSKQSRSEKKSRKAMLKLGMKPITGVSRVTVKKSKNILFVISKPDVFKSPNSDTYVIFGEAKIEDLSSQLQTQAAEQFKAPDLSQITSPETSGPGQEDNDEEVDETGVEAKDIELVMTQACVSRPKAVRALKASNGDIVTRHYGSDNLKPFFFLSPFGVPCYAA

SEQ ID NO: 62500 - DNA, 691 bp, Zea mays
  misc_feature: Ceres CLONE 1528762
  misc_feature: Encodes the peptide sequence at SEQ ID NO. 62501
gcggtggcggccgctctagaactagtggatcccccgggctgcaggaattcgtctcacccctagaaaaaattccccacatctcaagtgaagagaagtagaactagtagagagaggagaacaggagataagatcagctcgcacgcaagccaaaggaaaaggcaagatgcggagcccaaggggtggaggcggcctggagcacgtggatctgcttcccggcatccccgacgacgtcgccgtggactgcctggcccgcgtcccgcacgcctcccaccgcgcgatgcgccgggtctgccgcggctggcggagcgccgccgcggcgccggccttcgcgtcggcgcgcgccgcggcgggcgccaacgaggacctggtgtacctgatgcagttcgggaacccgtccgccgacgacgggcccaaggacggcgacgaggggccgggcaacaccccggcgtacggcgtggcggtgtacaacgtgacgacgggcgagtggcggcgggaccgcggcgcgccgcccgtggtgccggtgttcgcgcagtgcgcggcggtggggacccgcctggccgtgctgggcggctgggacccgctgagcttccagcccgtggcggacgtgcacgtgctggacgcggccacggggcggtggcgggccggccgcccatgcggtccgcgcggtccttcttcgctgcgccgaggcggg

SEQ ID NO: 62501 - protein, 176 aa, Zea mays
  misc_feature: Ceres CLONE 1528762
  misc_feature (14)..(61): Pfam Name: F-box Pfam Description: F-box domain
MRSPRGGGGLEHVDLLPGIPDDVAVDCLARVPHASHRAMRRVCRGWRSAAAAPAFASARAAAGANEDLVYLMQFGNPSADDGPKDGDEGPGNTPAYGVAVYNVTTGEWRRDRGAPPVVPVFAQCAAVGTRLAVLGGWDPLSFQPVADVHVLDAATGRWRAGRPCGPRGPSSLRRGG

SEQ ID NO: 62502 - DNA, 738 bp, Zea mays
  misc_feature: Ceres CLONE 1528770
  misc_feature: Encodes the peptide sequence at SEQ ID NO. 62503
aagctggagctccccgcggtggcggccgctctagaactagtggatcccccgggctgcaggaattcgtctcacccctagaaaaaatggccaaatttcggcaaactgcttctggggatactcttcgtgtcttctatgaacaactcagcaaggaccccaatagtctctccaatcttgatcaggatctcccgaattatgcccaacatacggtgcctatattctctcttcctcaagaatggctgtggtgtgaatcttggtgtggaaatgccacaaaagcaagagcaaagaccattgatctatgcaacaatccaatgacaaaggagccaaagcttcagggtgctagaagaatagttccggagtggactggtcttgacagtgaagcacggcagttcactgcacgaatcttgggtgatgatgaccaccccgcagatgccacacctccgccatcggaggcaccgaagcctgaaaatgatcacgatgtgaaagatgagctatgatcgcaagatgtttccaggcttggtcttactgaatgaaagtttggtgactcgacagtcatcagttcagaacacaggcacacagctagtggagcgcagagggatagtttaacgcatgtgcacatttgtcaaaacactacacctggaatcctggactacgttgattcaggtatttagattacagtaatacttttcagacctttaatcaaatcatatgggggggaagctgcctccagaaataggttaa

SEQ ID NO: 62503 - protein, 163 aa, Zea mays
  misc_feature: Ceres CLONE 1528770
AGAPRGGGRSRTSGSPGLQEFVSPLEKMAKFRQTASGDTLRVFYEQLSKDPNSLSNLDQDLPNYAQHTVPIFSLPQEWLWCESWCGNATKARAKTIDLCNNPMTKEPKLQGARRIVPEWTGLDSEARQFTARILGDDDHPADATPPPSEAPKPENDHDVKDEL

SEQ ID NO: 62504 - DNA, 698 bp, Zea mays
  misc_feature: Ceres CLONE 1528772
  misc_feature: Encodes the peptide sequence at SEQ ID NO. 62505
  misc_feature (79)..(79): n is a, c, t, g, unknown, or other
  misc_feature (80)..(80): n is a, c, t, g, unknown, or other
ccccgcggtggcggccgctcttactagtggatcccccgggctgcaggaattcgtctcacccctagaaaaatctctacannaatctctcttccgcatccgccgcaaaaccctaacctaagcggctcaaccctacgattaccgccgccgccgccccccgctcgcgcgcgcaagcttgggcagacctccctcagctcggccaagagcccgaccccctgctccggcaccagcgccgccaccgccatggatatggaagtgtacgagcgcctcaccgccgaaaccagtcactaccgtgggcacgcggtttcgatgcccctgatcggggctccgacgagggtggagccctatggcccagggaaaaggattgaggaaggaaaaaaaacccaaccggcggggggcccggggttgggaaacccaccccccctttgccccttttttgcacccaagaaacttggaaccccgggggggtctttggggggccctatttggggagaaaaaagcccccctggggttaggggtccattggcccgggggggggtggccccatttttgttcccaccaacaaataggaggggggaaataaacaaactcttgttttttggtcgcacctttattagttctcccaccaggggattgtagaggggtgttttcttttgtgcgaggggagaataatgtgggtggaagaaaatattcactccccc

SEQ ID NO: 62505 - protein, 131 aa, Zea mays
  misc_feature: Ceres CLONE 1528772
MDMEVYERLTAETSHYRGHAVSMPLIGAPTRVEPYGPGKRIEEGKKTQPAGGPGLGNPPPLCPFFAPKKLGTPGGSLGGPIWGEKSPPGVRGPLARGGVAPFLFPPTNRRGEINKLLFFGRTFISSPTRGL

SEQ ID NO: 62506 - DNA, 697 bp, Zea mays
  misc_feature: Ceres CLONE 1528773
  misc_feature: Encodes the peptide sequence at SEQ ID NO. 62507
gctctagaactagtggatcccccgggctgcaggaattcgtctcacccctagaaaaaattcccaagcaaacagccaaacacacgcgaagaaaaggaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaggcggtgtggttcaaggccggcgcgcagatcttctcggagggcgggctggactacctggggaatccctatctggtgcacgcacagagcatcctggccatctgggcgtgccaggtggtgctcatgggcttcgtcgagggctaccgcgtcggcggcggccc

SEQ ID NO: 62507 - protein, 174 aa, Zea mays
  misc_feature: Ceres CLONE 1528773
  misc_feature (59)..(174): Pfam Name: Chloroa_b-bind Pfam Description: Chlorophyll A-B binding protein
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPYLVHAQSILAIWACQVVLMGFVEGYRVGGG

SEQ ID NO: 62508 - DNA, 622 bp, Zea mays
  misc_feature: Ceres CLONE 1528775
  misc_feature: Encodes the peptide sequence at SEQ ID NO. 62509
  misc_feature (426)..(426): n is a, c, t, g, unknown, or other
  misc_feature (470)..(470): n is a, c, t, g, unknown, or other
cgcggtggcggccgctctagaactagtggatcccccgggctgcaggaattcgtctcacccctagaaaaagagcagctcactcccgctgcccagtcctcgccaccgcccactccgtcgccaaccaatggcctccgccatggagctctcgctcctcaaccccgccgcgacgcaccgccaccgcggcggcctcgccggcctgcccctcgcgcggcgctccgtggtccgcttccgcgtgtccgcctccgccgcggccaccgcgccgcccaagtcctcgggccccaagaagcggggcaagacggagatccaggagacgctgctcacgccccggttctacaccacggacttcgacgagatggagcgcctcttcaacgctgagatcaacaagcagctcaaccaggcggaagttcggacgccgctgggtttttnccgaaggtttaaaaggggtaaaaccccaacccccttttgcgggncccccccccccaaaatttaaagagggtgtcccccccaaaaaagggaggggcccccccccccccaaattttcaaaggacctcggggcgctcccccccacaaaaaaactcggcttcctcctataaaaaaaaaaagcgccccgccggccaaaaaa

SEQ ID NO: 62509 - protein, 121 aa, Zea mays
  misc_feature: Ceres CLONE 1528775
  misc_feature: SWISSPROT Homolog: EC 1.14.13.81 Magnesium-protoporphyrin IX monomethyl ester (oxidative) cyclase
  misc_feature (101)..(101): Xaa is any aa, unknown, or other
  misc_feature (116)..(116): Xaa is any aa, unknown, or other
MASAMELSLLNPAATHRHRGGLAGLPLARRSVVRFRVSASAAATAPPKSSGPKKRGKTEIQETLLTPRFYTTDFDEMERLFNAEINKQLNQAEVRTPLGFXRRFKRGKTPTPFCGXPPPKI

SEQ ID NO: 62510 - DNA, 882 bp, Zea mays
  misc_feature: Ceres CLONE 1528779
  misc_feature: Translation starting site: 111
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (56)..(56): n is a, c, t, g, unknown, or other
  misc_feature (57)..(57): n is a, c, t, g, unknown, or other
ggcccctacccccccccgtccaaaaannnnnnnnnnnnngggtnnnnntttaaaannggggagtcaccggggtggggggagatttttcactaaaggatcccccgggctgcatgatttcgtctcacccctccaaaaaagatttacaaaaaatggttcaggctcttccacagtacagtgatcaaattgataagctttccctgcatgttgagattgcccgaaaactcactaaacataataagggaaccatgtcttcgggatgttggacaactacagcaagatcttgtgtttggcgatgctggaaccaaaaaagtaatccactttttgacaacacaattggtttgaagttcgtgaaaataaattacccttgctgatgatttatgcaggacttaggacaaaaaaacatgaaaaattatatagccgccccattaagggcggggggggaaggaaacactgactaaaaaacccaccccccgtgaaataaaatgccgttagcttatagtggactgtacaacgaccaaacgcctttaccttaaggggggtacctacaccctgaaatttttaactgtagcaagaaaagaaaatacaacgacgtaaaccataatcaaaacacaaaaaatgtagaaaacaaatccaaccctggacgaacacccacacctaatttaatccgaacactctacacgacaagaaagacatataaaaatccaataacaataaagcgtataataagtctagtcgccacaaaaacatcacatctcgccgaaaaaagcgtgaaattaactaaaacctttcaaaataagagcagccatcgagctaactacagggggggagaaccttactcaccaaagaattaagttgctccacatcaagaacaacacccaccag

SEQ ID NO: 62511 - DNA, 775 bp, Zea mays
  misc_feature: Ceres CLONE 1528788
  misc_feature: Encodes the peptide sequence at SEQ ID NO. 62512
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttctggcagcccgcccgctgtgcatgtataaatnnnnnnnnnnnnnnnaaaagatggagctccccgcggtggcggccgctctagaactagtggatcccccgggctgcaggaattcgtctcacccctagaattctctaaccttggctcccgctccctccgcaggagcatctcaacaccgccttgaggaccccccaactcgccggctgcagccatggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttccgcaggtattgtggcggtgttggacgtactgctcaggctaagtctcgtcactcaaatggacaggcacactggcctgtcaaatctgctagattcattctagaccttctccagaatgctgagagcaatgctgacgtaaaaggtcttgatgtcgataccctctatgtgtcacacattcaagtgaaccaggctcaaaagcagcggcgcaggacctaccgcgctcatgggcgcatcaacccttacatgtcctccccgtgccacatcgaactcatcttgtcatagaaggaaaaccccgtgaagaaaagaggctgagtctcagatcgcaacccagtaatgctttagagaatggcgaacctaacccttctaatgatttggctgaattgaaga

SEQ ID NO: 62512 - protein, 152 aa, Zea mays
  misc_feature: Ceres CLONE 1528788
  misc_feature (17)..(153): Pfam Name: Ribosomal_L22 Pfam Description: Ribosomal protein L22p/L17e
MVKYSTEPTNPTKSTKAMGRDLRVHFKNTRETAFALRKLSLTKAKRYLEDVIAHKQAIPFRRYCGGVGRTAQAKSRHSNGQAHWPVKSARFILDLLQNAESNADVKGLDVDTLYVSHIQVNQAQKQRRRTYRAHGRINPYMSSPCHIELILS

SEQ ID NO: 62513 - DNA, 766 bp, Zea mays
  misc_feature: Ceres CLONE 1528790
  misc_feature: Encodes the peptide sequence at SEQ ID NO. 62514
aaagctggagctccccgcggtggcggccgctctagaactagtggatcccccgggctgcaggaattcgtctcacccctagaaaaatccaaacctgcaactccgagtcgtctcccgccaacccaatttcgcttcccgccgctccccatctcatcccacaccgtcaaaccgcccgaaaggccgctagaaatccgatcccgagccgccgcgtctcgctcgcgtcttttcccctctgctcgagcacgcgcggctgctcccggcggcggcggcgatgagcgcggtgaacatcaccaacgtggcggtgctggacaaccccaccgccttcatcaacccgttccagttcgagatatcctacgagtgcctcgtgcccctcgacgacgatctggagtggaagcttatatatgttggaccaccccaagatgaaaactacgaccaacagcttgagagtgtgcttgttggccctgtcaatgttgggacctaccgttttgtcctccaggctgatccaccggatccctcaaagatccgtgaggaagacataattggtgtgactgtgctgctattgatgtgctcttacatgggccaggagttcctgagagtacgctactattgtgaacaatgattattgacgatgaaccgttgagaagaggaacctcccagcaaaagtgcctaatcgaatgggtggcagagaaattattctgggccgaacaagcccccggggttaaccaagattccctaatcaaacttctcattcctgaacacaaatgtacga

SEQ ID NO: 62514 - protein, 115 aa, Zea mays
  misc_feature: Ceres CLONE 1528790
  misc_feature (1)..(115): Pfam Name: Anti-silence Pfam Description: Anti-silencing protein, ASF1-like
MSAVNITNVAVLDNPTAFINPFQFEISYECLVPLDDDLEWKLIYVGPPQDENYDQQLESVLVGPVNVGTYRFVLQADPPDPSKIREEDIIGVTVLLLMCSYMGQEFLRVRYYCEQ

SEQ ID NO: 62515 - DNA, 729 bp, Zea mays
  misc_feature: Ceres CLONE 1528802
  misc_feature: Encodes the peptide sequence at SEQ ID NO. 62516
aagctggagctccccgcggtggcggccgctctagaactagtggatcccccgggctgcaggaattcgtctcacccctagaaaaaatcagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaaaaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaaggcgccgccgccaagtcaaagaatgcagcggctgccaagccaaagaaagccgctgctgctgggaccaagcgcaaagtggccgaaaaaaaaagtcgtggcgaaaccgaaaaaagtcccccgcccccaagggccaaagccaagccgaagaacgtggaa

SEQ ID NO: 62516 - protein, 185 aa, Zea mays
  misc_feature: Ceres CLONE 1528802
  misc_feature (35)..(105): Pfam Name: Linker_histone Pfam Description: linker histone H1 and H5 family
MPALAKPASRTAKPAAAPKPKPAAAKPKAATAGASHPPYFEMIKEAITALKERTGSSSQAIAKYVGDKHGASLPANFKKMLSIQLRGSAAKGKLVKVKASYKLSDAAKKASPKTKAKPAKAAAAKTTAPKPAKGAAAKSKNAAAAKPKKAAAAGTKRKVAEKKSRGETEKSPPPPRAKAKPKNVE

SEQ ID NO: 62517 - DNA, 712 bp, Zea mays
  misc_feature: Ceres CLONE 1528803
  misc_feature: Encodes the peptide sequence at SEQ ID NO. 62518
  misc_feature (542)..(542): n is a, c, t, g, unknown, or other
  misc_feature (619)..(619): n is a, c, t, g, unknown, or other
  misc_feature (640)..(640): n is a, c, t, g, unknown, or other
tccccgcggtggcggccgctctagaactagtggatcccccgggctgcaggaattcgtctcacccctagaaaaatcttgtcttgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagcaggcgtcccacctgctcaagtacgactccacgctcggcatcttcgatgccgacgtcaagcccgtcggcgacaacgccatctccgtcgacggcaaggtcatcaaggtcgtgtccgaccgncaccccagcaacctgccgtggggcgagctcggcatcgacctcgtcatcgagggcaccggcgtcttcgtcgaccgcgnaggcgcggggaagcacatccnagcggcggcctagaaggtgctcatcacggcgcccgggcagggcgacatctccacctacgtcgtcggcgttaa

SEQ ID NO: 62518 - protein, 183 aa, Zea mays
  misc_feature: Ceres CLONE 1528803
  misc_feature (68)..(183): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
  misc_feature (173)..(173): Xaa is any aa, unknown, or other
  misc_feature (180)..(180): Xaa is any aa, unknown, or other
MASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRHPSNLPWGELGIDLVIEGTGVFVDRXGAGKHIXAAA

SEQ ID NO: 62519 - DNA, 711 bp, Zea mays
  misc_feature: Ceres CLONE 1528805
ccccgcggtggcggccgctctagaactagtggatcccccgggctgcaggaattcgtctcacccctagaaaaaacttcattgtatccaatcctaagagctcggacacctcttatcagctcgttcttgttccatgggtctaggctacgtctgccttggctcttcttttgttctggatgcaacttcccctttcgaatacagtggccgcgaagaacccatggtcgtcgtcctcctcctcgactacttctcaccctccccagaacgtcggcctgtgcagaagacccctgcttctggtcctggggctggaggcaacagccaccctgcctgattcaaacctttcgcctccgcttcaccacttccacgagatacttgcgacggaggcgactaccccctgcagctggcgccgtccgggctctgctgctgcaaccgacctgtaggatcaggcgtgcaccaccaggatctacctgtctgggaaaacattaagtactgagtgtacaagaagaccaggtgcaactgcttcgtgctgatcgctagagcgctgtccatctcttggtgcgactatcccagatactggatctaggataccgtcatatagccaatgacgacgagatcctccaatctgcgccgctgctaaacgtatgctgactgtacctcgcacgctagctagagctatcacagctcatgctgagagaactacaacctgcccttgcagta

SEQ ID NO: 62520 - DNA, 754 bp, Zea mays
  misc_feature: Ceres CLONE 1528806
  misc_feature: Encodes the peptide sequence at SEQ ID NO. 62521
  misc_feature (391)..(391): n is a, c, t, g, unknown, or other
ctccccgcggtggcggccgctctagaactagtggatcccccgggctgcaggaattcgtctcacccctagaaaacgattccgcccgcgtccgcggacccagatctggcgcccgcgcccatggcgacgcgcaggcgaatgctcctcaaggtcatcatcctcggcgacagcggggtcggcaagacctcgctgatgaaccagtacgtcaacaacaggttcagcaaccagtacaaggccaccatcggcgcggatttcctcaccaaggaggtccagatcgacgaccgcctcttcacactgcagatatgggatacggcaggacaggagcggtttcaaagtcttggtgtggcattttatacgccagctgactgctggggtcttgtatataatgtcaacntatccaacccctttgaaaagctcaccaactggcgggaggaattcctaattcaagccagcccatcagacccaaagaatttcccatttggttgggcttgggaacaagatccatgttgatggttggaaacaccccgactgttttctgaaaagaaaggctaaagcatgggggggttccaaaggaaaacctcccccaattttgaaaagtcgggctaaaaaagggtttccatagtaaaaggcctggcatttggattggataggcggcagaatgcgcttaaaaaatggaatcccataaataacaattgttttcctccctggatacccattggatgttgtggggggcccctagaaagcaaacacacctggc

SEQ ID NO: 62521 - protein, 129 aa, Zea mays
  misc_feature: Ceres CLONE 1528806
  misc_feature (10)..(129): Pfam Name: Ras Pfam Description: Ras family
  misc_feature: SWISSPROT Homolog: EC 2.7.11.1 Non-specific serine/threonine protein kinase
  misc_feature (92)..(92): Xaa is any aa, unknown, or other
MATRRRMLLKVIILGDSGVGKTSLMNQYVNNRFSNQYKATIGADFLTKEVQIDDRLFTLQIWDTAGQERFQSLGVAFYTPADCWGLVYNVNXSNPFEKLTNWREEFLIQASPSDPKNFPFGWAWEQDPC

SEQ ID NO: 62522 - DNA, 696 bp, Zea mays
  misc_feature: Ceres CLONE 1528813
ggagctccccgcggtggcggccgctctagactagtggatcccccgggctgcaggaattcgtctcacccctagaaaaattgtgacctcaaaccctttcttggacagcgtccacatcaaggaagagagagcacatagagtggagtggtgagattaccatggaggtctgcgtgtctacagccctcatcctccgtccgcgcggccgcctgcacccttattcttcgcgcctcccctacgtgttcgcggctgcacgacattgccgtttcgccctcccgccgcatactaactcaaggctggcgctactccttcgcggtctcgcctgttccggcgccctcccaagatcctggagatccgcctcctacgccgatctgcgtcactgacaaggacgatacgtctgcctacgacaaagacgacgaggttaccgccgatcctaatggctcctctcaggtgactatcgaagagatagtcgtcgcatagacgtcctcgtacccacatgatgacgtcctggatgagattccgagcgtctcgagattgaggtctctcttacttaactcctgcctgtgataggtgcctatcatccatataaggaacaagatatcgctgtcgaggcattcgtgctcggatgctgacttcgagtatgcaggactcgtaggtaatgcatagcaacttcgttcatcacaggggactgcattgtcagac

SEQ ID NO: 62523 - DNA, 727 bp, Zea mays
  misc_feature: Ceres CLONE 1528817
  misc_feature: Encodes the peptide sequence at SEQ ID NO. 62524
  misc_feature (296)..(296): n is a, c, t, g, unknown, or other
  misc_feature (375)..(375): n is a, c, t, g, unknown, or other
  misc_feature (383)..(383): n is a, c, t, g, unknown, or other
  misc_feature (385)..(385): n is a, c, t, g, unknown, or other
  misc_feature (537)..(537): n is a, c, t, g, unknown, or other
  misc_feature (588)..(588): n is a, c, t, g, unknown, or other
ccggtggcggccgctctagaactagtggatcccccgggctgcaggaattcgtctcacccctagaaaaagacgacgcccccatttcgaagctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagccngagcaggcctatttggctgcctcctccaccgatagcattgtttatgtttccccccccgggagggaaagtcaggggggtnccaactgnangtctgccaccctcctcaggtcgaggaaacagactataccccggcagcctatgcctgtccctaaacccgggcaggtcgccggctggaaacggcaacgccaggtacgcccccaattcggtggcccccctgcaagatagcccgttgggggccccntggtttaaggtggcccaaggcggacccctcccgggttcctggacctccttngggggcccgagccagatgccccttggatcccccactctgccccccccgggggctagcctcccgggggccctaaggcctcgcccaagggccgcacatggggcccccgccctctcccctggcgccccagtcggggagcccc

SEQ ID NO: 62524 - protein, 118 aa, Zea mays
  misc_feature: Ceres CLONE 1528817
  misc_feature (14)..(38): Pfam Name: zf-A20 Pfam Description: A20-like zinc finger
  misc_feature (71)..(71): Xaa is any aa, unknown, or other
  misc_feature (73)..(73): Xaa is any aa, unknown, or other
  misc_feature (74)..(74): Xaa is any aa, unknown, or other
MEHKEAGCQQPEGPILCINNCGFFGSAATMNMCSKCHKEMIMKPEQAYLAASSTDSIVYVSPPGRESQGGXNXXSATLLRSRKQTIPRQPMPVPKPGQVAGWKRQRQVRPQFGGPPAR

SEQ ID NO: 62525 - DNA, 717 bp, Zea mays
  misc_feature: Ceres CLONE 1528820
  misc_feature: Translation starting site: 149
  misc_feature: SWISSPROT Homolog: EC 5.3.1.1 Triose-phosphate isomerase
gcggtggcggccgctctacactagtggatcccccgggctgcaggaattcgtctcacccctagaaaaagctaccccctcgcctcgccctcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccggccactcccaccgtcccacagcagcttcgcgtcggcttctcgcgccgccgcgcccagcgcgtcgtcgccatggctggatccggcaagttcttcgtcggaggcaactggaagtgcaacggaacacccgactccgggtggggggcttgtctctgaattgaatgctgctaccctccattctgatgtagatgttgtgggggctcctccgttcatctatatcgatcaagtccagaagttcctaacgggtcgcattgagggtttctgctcccaatgtgtggattgggaaaaggaggaaccctaccccgggaggtcaggtgcgaacacactgggggaccttcggctggtcatggggttattccggggacccttccagggttaaacttttcattcggctaaataggaaccgtcttcttgggggaggagtgcttggtagtggcttccccccgaaacgggtagcggttttcggccggcacatgagcagcttctgcgcaatcagg

SEQ ID NO: 62526 - DNA, 691 bp, Zea mays
  misc_feature: Ceres CLONE 1528827
  misc_feature: Encodes the peptide sequence at SEQ ID NO. 62527
ggagctccccgcggtggcggccgctctagaactagtggatcccccgggctgcaggaattcgtctcacccctagaaaaaatacataaccctgcaactgcaagctaaggagagtgtgatcaccaacagctagtgctagtcccccttccttccatccatccatggcatgcgtcagcaccttccacagctgccccattgccagaagagcaaagatcaacaccaggtccaggggcagcagcagtagcgtggcgaaggggtcaccaccaccagccttccagttccagtgcacggcgtcgactttcgcgacggacaccaccctccggctcgagctggacgagaaccacgaggcgatcatctcgggggcgtggcccgggaactgctccctcctcagatacaacgacctccgcgcctacctcgagtcgcatgagacggcggcccatgcagacgatcatcgcggcgtgacgctcctgagcgagaccatgtccacacccgtgctggtggccacagcagaccaaaccctggcagacgtcgagtgcctcttcgaagccatgtccgggcttccggtcgtcgacaacagcctcaaatgcttttgggtgatcgtcaagaaacaaccggcaacaagcctctcgtggggtccagaaccaaaatatctagaagtgaagaacatctcaacgtttcagacgaatcgaacaga

SEQ ID NO: 62527 - protein, 177 aa, Zea mays
  misc_feature: Ceres CLONE 1528827
MACVSTFHSCPIARRAKINTRSRGSSSSVAKGSPPPAFQFQCTASTFATDTTLRLELDENHEAIISGAWPGNCSLLRYNDLRAYLESHETAAHADDHRGVTLLSETMSTPVLVATADQTLADVECLFEAMSGLPVVDNSLKCFWVIVKKQPATSLSWGPEPKYLEVKNISTFQTNRT

SEQ ID NO: 62528 - DNA, 719 bp, Zea mays
  misc_feature: Ceres CLONE 1528828
  misc_feature: Encodes the peptide sequence at SEQ ID NO. 62529
ccccgcggtggcggccgctctagaactagtggatcccccgggctgcaggaattcgtctcacccctagaaaaaaggcaccaccaccagctagctctctgtctgctgctcctctcaaaagagtcgcagttcactttgttgtactagagcgctgagcagatctttccttgtttctccattccggtacgaaggggtggggtccaagtgaagggaagggaagggaagagaaggcctgctgcgagcgatgggcatcgtcgacgtcgtctccgagttctgctccttgccgaggactcgccggcatctcaagaagaggaagcagttccaggtatatataaaccatcttcttctgtttctgttcggggtcttatcccagccagcccaacagctgaactggactcgccgcagacggtggagatgaaggtgcgcatcgactgcgaagggtgcgagcgcaaggtgaagaaggcgatggagggcatgaagggcgtgagctccgtggaggtggcggccaagcagaacaaggtgacggtcacgggctacgtggacgccgccaaggtcatgcgccgcgtcgcctacaagacgggcaagcgggtggagccctggccctacgtgccctacgagatggtgcagcacccctacgcgccgggcgcctacgacaagaaggcgcccgccggctacgtccgcaacgtcgtcgccgaccccaccgccgcgccgctcgccagggc

SEQ ID NO: 62529 - protein, 102 aa, Zea mays
  misc_feature: Ceres CLONE 1528828
  misc_feature (1)..(61): Pfam Name: HMA Pfam Description: Heavy-metal-associated domain
MKVRIDCEGCERKVKKAMEGMKGVSSVEVAAKQNKVTVTGYVDAAKVMRRVAYKTGKRVEPWPYVPYEMVQHPYAPGAYDKKAPAGYVRNVVADPTAAPLAR

SEQ ID NO: 62530 - DNA, 689 bp, Zea mays
  misc_feature: Ceres CLONE 1528835
  misc_feature: Encodes the peptide sequence at SEQ ID NO. 62531
tccccgcggtggcggccgctctagaactagtggatcccccgggctgcaggaattcgtctcacccctagaaaaaaccagcaagaccaaccaacccacttctgactgaccactgtgccgcgccgtgctcaccgaacgggcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaacgcgggcctctcggccgacccggagaccttcacgcgcaaccgggagctagaggtgatccactcccggtgggcgatgctgggggcgctgggctgcgtgttcccggagatcctggctaataacggcgtcaagttcggcaaggcggtgtggatcaagggcggcgcgcacatcttctcggagggccggctggactacctggggaaccccaacctggtgcacggacaaagcatcctggccatctgggcttcgcaagaggtgctcatgggcttcttcaaaggctaccgcgtcggcggctgcccgctcggagaa

SEQ ID NO: 62531 - protein, 178 aa, Zea mays
  misc_feature: Ceres CLONE 1528835
  misc_feature (59)..(178): Pfam Name: Chloroa_b-bind Pfam Description: Chlorophyll A-B binding protein
MAASALHQTTSFLGQALVARAAGVDAGGRITMRRTVKSVPQSIWYGPDRPKYLGPFSEQTPSYLTGEFPGDYGWDNAGLSADPETFTRNRELEVIHSRWAMLGALGCVFPEILANNGVKFGKAVWIKGGAHIFSEGRLDYLGNPNLVHGQSILAIWASQEVLMGFFKGYRVGGCPLGE

SEQ ID NO: 62532 - DNA, 706 bp, Zea mays
  misc_feature: Ceres CLONE 1528838
  misc_feature: Encodes the peptide sequence at SEQ ID NO. 62533
aaagctggagctccccgcggtggcggccgctctagaactagtggatcccccgggctgcaggaattcgtctcacccctagaaaaagtgctgtgctatgtaatccttcattcatgcacttgccgttcttcgaattgcagccgccttctcctcctcgtccttgtccgggcacttacctacgtaagaatactgtactgcacctcaacaggcccgccataatccagtagtggaggtacatgcttgctacaactatggcttcctacctgcagacagaggcaggtaccaaccaccacctgcaccacatgccacccttcctcacactgcaaaggatgcaggtgacctgtggcattacttcccttgccccttttgctacatcgaggtggaggtgcccttcgtctgctaccaccttcaggaggaacattgctttgacaccaggaatgctgtttgccccatctgcgccaacaatctagggaaagacatggctgcacatttcagactgcaacacacgcatcttctcaagaggaggaagccctacaggtcaagctcatgccctgcggctgacactggcccagcaacataccaagtgaactcttactatggagtagcagaaccacagcatactacttcccgccgtaccaagatcctgagcgtgccccatgctctccaagttcatctagaacgtcgatgggatccctgatgatgacaacgc

SEQ ID NO: 62533 - protein, 72 aa, Zea mays
  misc_feature: Ceres CLONE 1528838
MAAHFRLQHTHLLKRRKPYRSSSCPAADTGPATYQVNSYYGVAEPQHTTSRRTKILSVPHALQVHLERRWDP

SEQ ID NO: 62534 - DNA, 704 bp, Zea mays
  misc_feature: Ceres CLONE 1528845
  misc_feature: Translation starting site: 184
  misc_feature (704)..(704): n is a, c, t, g, unknown, or other
agtggatcccccgggctgcaggaattcgtctcacccctagaaaactcgtttttctctctcctgcgctgcgccgtccttcacctccgccgccgaatccgagactctgatctcgggttcaccgcagcgcacagagcacccccgactcccgtcccgatccgcgctctcctctacgacgcttcagtcatggcaggaatggcacccgagggttctcagtttgatgctaagcactatgattctaaaatgcaggagctgctgagcactggtgagactgaggagttcttcacttcatatgatgaagtttttgaaagttttgatgactctgcccttcgggagggggggggggggagggatttatgcatatggttttcacacaccatctgcaattcagcagagaggaattgttcccttctggcaggggcttgatgtctttcagcaagcacaatctggtacggaaaaaaagcacccttctgttctgggatcttgccccaccttgactatgggtctggtgaatggcccagccctggtttttggtcccacccgggaacttgtccacccaatttacaaaagttttcctccccacttggcgactccccttgggggcaaacgcccctggcggccgttcggagaaacatttgcttcggcggcgactcaggggtttccccgcccgcgctggccccactttgtttgagagggccccccggccn

SEQ ID NO: 62535 - DNA, 693 bp, Zea mays
  misc_feature: Ceres CLONE 1528849
  misc_feature: Encodes the peptide sequence at SEQ ID NO. 62536
tccccgcggtggcggccgctctagaactagtggatcccccgggctgcaggaattcgtctcacccctagaaaaaaagctctcctcccctcttcctaccattatcagtagctacagccagaacaccagcagacagcagcatcagcagggaggaacacgatgagcggcgccggtccggatctgcgactgccaccggggatccggttccacccgacggacgaggagctggtgatgcactacctctgccgccgctgcgccggcctgcccatcgccgtccccatcatcgccgagatcgacctctacaaattcgaaccatggcagctcccaaggatggcgctgtacggcgagaaggagtggtacttcttctccccgcgggagcgcaagtacccgaacgggtccaggcccaaccgcgccaacggggctgggtactggaaggccaccggcgctgacaagcccgtgggcacgcccaagccactggccatcaagaaggcgctcgtcttctaagccggtcaggcgcccagaggcgagaagaccaactggatcatgcacgagtaccgactcgccgacttcgaccgatcggcgcgcaagatgaacagcctcaagttggatgactgggtcctgtgccgcatctacaacaataatggctgcgggctggagaatgcggcggcgccggcagccggaggagaccactagcct

SEQ ID NO: 62536 - protein, 114 aa, Zea mays
  misc_feature: Ceres CLONE 1528849
  misc_feature (10)..(115): Pfam Name: NAM Pfam Description: No apical meristem (NAM) protein
MSGAGPDLRLPPGIRFHPTDEELVMHYLCRRCAGLPIAVPIIAEIDLYKFEPWQLPRMALYGEKEWYFFSPRERKYPNGSRPNRANGAGYWKATGADKPVGTPKPLAIKKALVF

SEQ ID NO: 62537 - DNA, 790 bp, Zea mays
  misc_feature: Ceres CLONE 1528852
  misc_feature: Encodes the peptide sequence at SEQ ID NO. 62538
  misc_feature (790)..(790): n is a, c, t, g, unknown, or other
attataacttactttatattattagataagagcgatgcgcgtcggagtcggcggtgggtttctccgaggtggcggccgctctagaactagtggtacccccgggctgcaggagttcgtctcacccctagaaaaagttttctgctacgccagggcgcaaccatgggtcagcagcagcaagggccggcggccaggcggatggccacgctcgcctcccacctgcgccatccctccgtctctcaccctcagatggaagatgttcccctcttgaggggatccaattgccgtgcaaaaggtgcggcgccaggcttcaaagtcgcgatcttgggtgcagcatgtgggattgggcagccacttgcgctattgatgaagatgaaccctcttgtttcggtgctccatctatacgatgtcgtcaacgcacctggtgtcacagccgagatcagtcacatgagcactggtgctgtggtacgtggcttcttgggccagccacagttggaaaatgccctggctggaatggatcttgtaataattcctgctggtgtccctcggaaacctgggatgacgagggatgatttgttcaacataaatgctgggaatagtccgtaccctgtgtgaaggaattgcataatgctgccctaatgcaattggtaatgtgatcagtaatcctggtcgaatcttaccgtccacattagctgctagaagttttgcaagagaagctgggaacctatgagccctaaggcgggcttattagggggtgaaccccagttaagaacgtactggagagcaaaatatn

SEQ ID NO: 62538 - protein, 150 aa, Zea mays
  misc_feature: Ceres CLONE 1528852
  misc_feature (50)..(151): Pfam Name: Ldh_1_N Pfam Description: lactate/malate dehydrogenase, NAD binding domain
  misc_feature: SWISSPROT Homolog: EC 1.1.1.37 Malate dehydrogenase
MGQQQQGPAARRMATLASHLRHPSVSHPQMEDVPLLRGSNCRAKGAAPGFKVAILGAACGIGQPLALLMKMNPLVSVLHLYDVVNAPGVTAEISHMSTGAVVRGFLGQPQLENALAGMDLVIIPAGVPRKPGMTRDDLFNINAGNSPYPV

SEQ ID NO: 62539 - DNA, 718 bp, Zea mays
  misc_feature: Ceres CLONE 1528853
  misc_feature: Encodes the peptide sequence at SEQ ID NO. 62540
aagctggagctcaccgcggtggcggccgctctagaactagtggatcccccgggctgcaggaattcgtctcacccctagaaaaaatttctcatcttacacctcccttttctagttttcattatcatttcaacttagcaaaaaatgtaacacattgatcagatggcctccacctccaccttcctgttcaccctcgccatcgagtgcgcggaaaccaatatcctgcacagcgtgctgccgtccttcgccaagatcgtgagggtgttgcccgcgcacgtccacatcatcagcaggctgcacgaggtggtgctgcccacgccgagggcggcggagtcgggcatctacaaggggccgtccagcaaccacgagcacgtggtcagggtgcacagcacccagtagttcgacgacgcgcgtcaaagccgccaagaaccggctggtggtggtggagttcgcggcgagcgacagcgaggacagcagccagatctacccgaccatggtgcagctcagccgcacctgcggcgacgtggacttcctgctggtcctgcgcgacgacgagtcagaggccaccgaggagctgttccgccgggagggcgtcacgaaggtgcctcacttcaacttctacaagggcgccgataaggtgcacgaagaggaggccatcggccccgagcggctcgcgggcgacgtcctctactacggcgacagccactcggcggtggtgcac

SEQ ID NO: 62540 - protein, 76 aa, Zea mays
  misc_feature: Ceres CLONE 1528853
MVQLSRTCGDVDFLLVLRDDESEATEELFRREGVTKVPHFNFYKGADKVHEEEAIGPERLAGDVLYYGDSHSAVVH

SEQ ID NO: 62541 - DNA, 499 bp, Zea mays
  misc_feature: Ceres CLONE 1528855
  misc_feature (145)..(145): n is a, c, t, g, unknown, or other
  misc_feature (146)..(146): n is a, c, t, g, unknown, or other
  misc_feature (193)..(193): n is a, c, t, g, unknown, or other
  misc_feature (199)..(199): n is a, c, t, g, unknown, or other
tccccgcggtggcggccgctctagaatagtggatcccccgggctgcggattcgtctcacccctagaaaaaaccgccaccacacagctcccacgctcaccgacgcacagcttgtgcgcgcgcatggcactcgtggtcgctctcgtnnctcacacgcgtcgcgggctccccagaatgggcagcaaccggcgtccncccccnttgtttacctcctccctccctcttcctcttccccggaggaaaaaacttgcttaagcaagcccaaggaaccccggccctttttttttcccggggcgcccccggggaaatttccaaagggggaatttgtttccccggaaaacccccctccccccggggttttaaaaaggaggcttttccccgggagaaaatatcggtttttttaaaccccggggggcccccttttatttttcccccccaaaaaaacccccctttgggaaaaaaaaaaaagggggaaaattttgtggttccccttcccccggg

SEQ ID NO: 62542 - DNA, 722 bp, Zea mays
  misc_feature: Ceres CLONE 1528858
agtggatcccccgggctgcaggaattcgtctcacccctagaaaaaaacatcagccatccccttttgctgcaaatctttccctgaattgtgggtctccgacaatggcagcgctcgatccatccaagatgctgggcacccagctcaacttcacgggctcctcccgctaggccaccgaagcgcccagcgtcgggcgtcagaatattgtcccccttttgaccaagaagcctggccagaaccccaagccgcttcgcgtatgctcgtcttctcaagacttaagccatcagctcccaaaacgtcatggtcctgactgaccgatttctctgggcccccgcccgcgggagagggcgcacgtgctaaagtacccctccacaacctctgcggaaaacccgtcttccagccctccgtcaacgaagagaacgccaagccagttatccaccaaccggccgatacttccaactcaccccaaggtgcgggcctgtgcacgccgccgagttctcctcgccgactaggaacagtatccccccgtgccggggctagaataggaaagtctccctcaaatgcaccctgagaaggtgcagcgcacttcaaagagcacgataattccgacagtcaacaaaggttctcctgacaggcctctcccctagtctggggttcgggccacccagatgcgattatccttcgtcaggccgacccccaagccctacattgggagaatgaggcgg

SEQ ID NO: 62543 - DNA, 727 bp, Zea mays
  misc_feature: Ceres CLONE 1528859
  misc_feature: Encodes the peptide sequence at SEQ ID NO. 62544
  misc_feature (399)..(399): n is a, c, t, g, unknown, or other
  misc_feature (404)..(404): n is a, c, t, g, unknown, or other
tacccgcggtggcggccgctctagaactagtggatcccccgggctgcaggaattcgtctcacccctagaaaaaataggggccatcagatccaagaagagggaagagcaccaaggaccttcggcgcccgttcaggatccacatcttcccgagcgagttcttggttgacctcttcccccttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgttcacgtgcgcatccagcagcgtaatggtcgcaaggagctgactaccgtccagggattgaaaaagganttcanctacagcaagatcctcaaagatctcaagaaagagttctgctgcaatggtacagtggtccaggacccagaacttggacaggtcctttcacttccagggtgatcagaaggaacaacgtctccgattttcctcgtccaggccggggttggtgaaaaaaggaccccttcccgattcagggtttccgaagcaaccccccgggtccttaacaaaccaacccgggttggcaggggccagctttattaattttaatattcggagggggggcatatcttttctgtgggggtgactggcaggcaggctctgtacccccgcctggggggttccc

SEQ ID NO: 62544 - protein, 89 aa, Zea mays
  misc_feature: Ceres CLONE 1528859
  misc_feature (27)..(90): Pfam Name: SUI1 Pfam Description: Translation initiation factor SUI1
  misc_feature (55)..(55): Xaa is any aa, unknown, or other
  misc_feature (57)..(57): Xaa is any aa, unknown, or other
MSDLDIQIPTAFDPFAEANAGDSGAAAGSKDYVHVRIQQRNGRKELTTVQGLKKXFXYSKILKDLKKEFCCNGTVVQDPELGQVLSLPG

SEQ ID NO: 62545 - DNA, 719 bp, Zea mays
  misc_feature: Ceres CLONE 1528860
  misc_feature: Encodes the peptide sequence at SEQ ID NO. 62546
  misc_feature (719)..(719): n is a, c, t, g, unknown, or other
aaagctggagctccccgcggtggcggccgctctagaactagtggatcccccgggctgcaggaattcgtctcacccctagaaaaaatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcgagacaatcacccttgaggtggagtcctcagacaccattgacaacgtcaaggcaaagatccaggactaggagggcatcccacctgaccagcaacgtctcatctttgccagcaagcacttggaggatgggaggacccttgctgactacacttccagaaggagagcaccctccacttggtgctgcgtcttaggggtggtatgcggatctttgggaaaacccttactgggaagaccatccctcttgaggtggagccttcgaatacctttgacgaggtcn

SEQ ID NO: 62546 - protein, 108 aa, Zea mays
  misc_feature: Ceres CLONE 1528860
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQIFVKTLTGETITLEVESSDTIDNVKAKIQD

SEQ ID NO: 62547 - DNA, 673 bp, Zea mays
  misc_feature: Ceres CLONE 1528864
  misc_feature: Encodes the peptide sequence at SEQ ID NO. 62548
gctcataactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccacccgagaagcggtggaggcgcccaaggggttcgtggccccgcagctggaccccagcacgccgtccccgatcttcggcggcagcaccggcgggctgctccccaagggcaggtggaagagtcctacttcatcccggggacttcccccaaggaccaggggttcaaaaatgcccaccggggggcccccattaagggggaagggcccccacccctcttaaactgggccccaagggaaaaatgccctgggcctccggccccaagtttgggccccccacaaaaaaaaaacccctacaaagttttaacccgggttttcccccaaaagggaagggggggataaacctcccccccccagagaaagggggccccccccccgaaaaaaagaaccccccccggcggggagggag

SEQ ID NO: 62548 - protein, 119 aa, Zea mays
  misc_feature: Ceres CLONE 1528864
MAMATQASAATRHLLAAAWAPAAKPRQLSSQLALPSSSSRGPAPLRASTREAVEAPKGFVAPQLDPSTPSPIFGGSTGGLLPKGRWKSPTSSRGLPPRTRGSKMPTGGPPLRGKGPHPS

SEQ ID NO: 62549 - DNA, 670 bp, Zea mays
  misc_feature: Ceres CLONE 1528865
agtggatcccccgggctgcaggaattcgtctcacccctagaaaaaaaatcttctggttctatgcttttcacctccgtccttcatcttccttatacgctaaccaagagtgatgctgcggagacggcgtcccatctccaccacatgcccttcccacatgagccgctgaagatcctcttcctcccgttcctcacgcctgggtacctcatcccaatcgcctagatggcaccgctcttcgctgcccgaggagtcaggtgctaccatcgtcaccacaccggggaatggcctaactcatctgctctgcgctacatccagctaactacgcctcccgctgaatctaggatgcactgggctatgaaatcgggatgatgtgtaccccccatttcagtctgccccccggcatctagtgagctccggagctctaatccttggactacccgggaatggttatcccgtaggagctaattaatgcccaagtcgtacaagcggttcttggctgcaacaccgtccagatgggaccctgaccgacatctactcaactgttcggcacaatcccccgctgattccttactcccagaaaaaactgttctcagtcatagttagttctggcggtgctaaagagaacctactctgctaaagcatcccgtggaagccccccaaagaaaccacaaaa

SEQ ID NO: 62550 - DNA, 646 bp, Zea mays
  misc_feature: Ceres CLONE 1528866
  misc_feature: Encodes the peptide sequence at SEQ ID NO. 62551
  misc_feature (55)..(55): n is a, c, t, g, unknown, or other
  misc_feature (339)..(339): n is a, c, t, g, unknown, or other
ggcggccgctctagaactagtggatcccccgggctgcaggaattcgtctcacccnctagaaaaaaagcggagccaaccatccccgcggcagtcaaccccccaactccgttcattgcggcagccaaatcgagatctcgcccgtgctcaatcccaccactctcgccgactcatccggccgcagcaagcgcagcgcatcgacaggagccgaagaaccgaagaggagatggcgtcggcgctgtcctccctgcgctacggcgacagcctctcggtggtgggcatctccgccgcgacggccgtgctctgcgaggccatgtcctggctcctcatctaacgcaccgncacctacaactcccctcgcgcctccattgagcgccactcccgcaggctagacgccctgaaggtcgggttcgactccggcatcttcgggaacgccggcttcccccgggaagccggaatcgtcccgggttaaaaaaaggaaccccttcaaacccaaccccaaaggaacttgcgccgggaaatctcggttccccaaagccaaaattgggggcccggcctcccccgtgatgggccctttagggattttgggcgggggtaaaaccccctttttaaggggccccaccggtggcacaaaggggcccttttcccc

SEQ ID NO: 62551 - protein, 35 aa, Zea mays
  misc_feature: Ceres CLONE 1528866
MASALSSLRYGDSLSVVGISAATAVLCEAMSWLLI

SEQ ID NO: 62552 - DNA, 816 bp, Zea mays
  misc_feature: Ceres CLONE 1528867
  misc_feature: Encodes the peptide sequence at SEQ ID NO. 62553
  misc_feature (745)..(745): n is a, c, t, g, unknown, or other
ggttgagtttgtttgagttggtatgtaggagaggtggtcaaacccacatataagatgaaccaaccaagcgtagggaggacacctctctaaagatagaggatcccccgggctagcaggaattcgtctcacccctagaaaaaagctgcagctaccggccttcctctcccccattccaattccagagaacaggggcgagcggagacaaccaggtacgatgtgctcggtagcgaggctggcgtttgtgcttgcactggccataaccgcctcatcaattacggttgcggagagcagagattttgatatctttgctcaaggcagcttgcctgatgcaaccaaggtatcgtcaggtctagctgcaaccagtggaaagttgtgtcatttatgcgagcagtactcatccgaggcgctcctccatctcacacagagcgagacccagactgagattcttagcattctacaccatgaattgtgccaagcctggccccactcgagcagcacagcatcacgcttggttgagtacaaggtaccccattttcatcttggaggtctccagggctacccacggaaaagtgccggcgagtcaatgcttccccttaagagaagggatttaagattacgcctacccacctcgggaggagtgacttgaggactaaagtgcccaccaatgtaaggaaggtagacgattaacctgtcgtggcagtaaaagaacccctaacaagccgtaatgagaagctaatacacaccntacgtctgtctttagaagtgccacgcaggggccgctcgtatacttataggagtcgagcagagtagagaagc

SEQ ID NO: 62553 - protein, 143 aa, Zea mays
  misc_feature: Ceres CLONE 1528867
  misc_feature (51)..(90): Pfam Name: SapB_1 Pfam Description: Saposin-like type B, region 1
MCSVARLAFVLALAITASSITVAESRDFDIFAQGSLPDATKVSSGLAATSGKLCHLCEQYSSEALLHLTQSETQTEILSILHHELCQAWPHSSSTASRLVEYKVPHFHLGGLQGYPRKSAGESMLPLKRRDLRLRLPTSGGVT

SEQ ID NO: 62554 - DNA, 727 bp, Zea mays
  misc_feature: Ceres CLONE 1528871
  misc_feature: Encodes the peptide sequence at SEQ ID NO. 62555
aagctggagctccccgcggtggcggccgctctagaactagtggatcccccgggctgcaggaattcgtctcacccctagaaaaagtccaaaaccctagccctcgcgccgccgccgccgtgcccagcgctcgagctcctcgcctgccgcgagctcgcgccgcaacgccaccatgaagttcaacatctgcgaacccgtctaccgggtgccagaagaagctggaaatcgatgacgaccacaaactacgtgccttttatgaccgaaggatctcccaggaggtcagaggagatgctctgggtgaggagtttaagggttatgtcttcaagatcatgggtggatgtgacaaacaatgcttcccaatgaagcaaggagttctgacttctggtcgtgtccgccttctgatccacagaagcactccctgcttccgcggttatggcaggcgtaatggtgagcgcaggaggaagtctgtccgtggttgtattgtgagccaagacctatctgttatcgacttggtaattgttaagaagggtgagaacgatctgcctggtttagatgacactgagaagccaacgatgatgggtcccaaaagggcctccaagatcaggaagctgttcaatcttgcaaaggatgacgacgtgcgcaagtacgtgaacacgtaccgcaggacattcactaccaagaatgtgaagaacgtgagcaaggcacctaacatccagcggcttgtgacccc

SEQ ID NO: 62555 - protein, 133 aa, Zea mays
  misc_feature: Ceres CLONE 1528871
  misc_feature (1)..(77): Pfam Name: Ribosomal_S6e Pfam Description: Ribosomal protein S6e
MGGCDKQCFPMKQGVLTSGRVRLLIHRSTPCFRGYGRRNGERRRKSVRGCIVSQDLSVIDLVIVKKGENDLPGLDDTEKPTMMGPKRASKIRKLFNLAKDDDVRKYVNTYRRTFTTKNVKNVSKAPNIQRLVT

SEQ ID NO: 62556 - DNA, 700 bp, Zea mays
  misc_feature: Ceres CLONE 1528874
  misc_feature: Encodes the peptide sequence at SEQ ID NO. 62557
  misc_feature (606)..(606): n is a, c, t, g, unknown, or other
gcggtggcggccgctctagaactagtggatcccccgggctgcaggaattcgtctcacccctagaaaaaactgaaaagaccccacgaacttttactctagccctcccggctcccagggtctctcttcggcggcggcgatgtctctccccccggacccggcgggcggcggcgccggcaccggcaccggcgacgactggttcctcgactgcggcatcctcgacgacctcccggccgcggcctgcggggccttcccgtgggacgcgtccccgtcttcttccaaccccagtgtggaagtgggcagctatgtgaacaccaatgatgttttcaaggagcccaatgatgtcttcaaggagcctggcagcaataagcgtttgaggtcaggatccaatgatgtgcatgtgccaacatctaaagcttctagggaaaaaatgaggaggaacaagctgaatgacaggttccttgaattggggtctacattacaaccagtgaagccagtaaaagctgacaaagctgctatcctaagtgatgctactcgcatggttattcagcttcgttcagaagcacagcagctgaaggaaactaatggtagtcttgaagagaagatcanagaactcaaggccgagcacgatgaacttcgtgatgagcagcagacgctgacattggagaaggagagtttagaacaccagatgaagctgatgact

SEQ ID NO: 62557 - protein, 188 aa, Zea mays
  misc_feature: Ceres CLONE 1528874
  misc_feature (88)..(139): Pfam Name: HLH Pfam Description: Helix-loop-helix DNA-binding domain
  misc_feature (157)..(157): Xaa is any aa, unknown, or other
MSLPPDPAGGGAGTGTGDDWFLDCGILDDLPAAACGAFPWDASPSSSNPSVEVGSYVNTNDVFKEPNDVFKEPGSNKRLRSGSNDVHVPTSKASREKMRRNKLNDRFLELGSTLQPVKPVKADKAAILSDATRMVIQLRSEAQQLKETNGSLEEKIXELKAEHDELRDEQQTLTLEKESLEHQMKLMT

SEQ ID NO: 62558 - DNA, 856 bp, Zea mays
  misc_feature: Ceres CLONE 1528876
  misc_feature (11)..(11): n is a, c, t, g, unknown, or other
  misc_feature (19)..(19): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (111)..(111): n is a, c, t, g, unknown, or other
  misc_feature (856)..(856): n is a, c, t, g, unknown, or other
ctcttcctctnttcctctnaaannnnnnnnnnnnaaaannnnnnaacccccttacctccacgaggtggcgggcgctctacaatagtggatcccccgggctgcaggaattcntctcacccctagaaaaaaccttcacaaacattggaaaaagcactccttctcttcgtcctctcccgtccctcctccatcccattccataccattccgccaaagaagaaccccagacgctcgctccccaactcccaagcccagcccggatcccaaaatcggctacagcgcaaccactccgctcagtacccttcgttcacccccatccatccagccgagcagtcatccacgccgcggaaggaatgcggcgaacttccgtaaggacgaactgatgtgagcgggtggggtcctgtttattttttttccccccccccgggggggggggggggggcggttcccatttacttcttataccccccccgggggtaccgcactcccatcccttcatccccggcgcggataggcgtaatgcctgtgaagcaacataatgggaggaacgttacggatccggtcctgcgaccagcttggacctgacctatcgtcgggtagtgacgtgatcgctcggctgatcctacgcgtctctgtcacgagtcatctcaggacctcgcacgtggctcccgtaagtacccccttatatatgacgcggtctaggtgttccccgtttccgccgggcccacttattggtaatctatgattacgcccgactacacgcgctctaggtacattaccaacccccgccactacttagaaaaagactaactcattctcgctatcgtcggtttcaccgacacacacggaagcccgctan

SEQ ID NO: 62559 - DNA, 794 bp, Zea mays
  misc_feature: Ceres CLONE 1528878
  misc_feature: Translation starting site: 207
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (605)..(605): n is a, c, t, g, unknown, or other
ggtggggtcgtatttagtgttgttggnnncggatggggggaaaagtggggggctccgcggtggggggcgctctctactagtggatcccccgggctgcgggagttcgtctcacccctagaaaaaagatgggccgctcttcttctgggtttaccggctaaggggtgagagtgtggtgggcgtgcgccttcttcgagaggcgcgtgaggatgcgcgctgacagcgcggaaagccaagcctcgggccggatcctggagagccctggtacgggccccaacgcgtggtgtacctggggccactggccggggaagccgcctagctacctgacgggcgagttcccgggcgactacggctgggacaccgcggggctgtcggcggacccggagacgttcgccaagaaccgggagctggaggtgatccactcccgctggggcatgctgggagcttttggctccctctttccggagctgctcccccgcaacggcgtcaagttcggcgaaggccctgtggtttaagggccggttcccagatcttcagcgagggtggaacttggactacctcggggaacccgagcctcatccacgcgcagagcatcctcgccatctggnccttgccaggtccgggctcatggtgcccgtcaaagggataaccagtatcgcggggcgccctgctcggcgaaggtcgacaaatccttatctatcgcggccggttgctatcgaactcggtttggcctgaggagaacgaaccccaaggccttacgcttaaagctcaaggtggaacggaacctctcaaaactg

SEQ ID NO: 62560 - DNA, 516 bp, Zea mays
  misc_feature: Ceres CLONE 1528881
  misc_feature (140)..(140): n is a, c, t, g, unknown, or other
  misc_feature (141)..(141): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (224)..(224): n is a, c, t, g, unknown, or other
  misc_feature (225)..(225): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
ggcggccgctctagaactagtggatcccccgggctgcaggaattcgtctcacccctagaaaaaacacccagattctttcgattctttcacggttccacctctcccctccctctcgtgctcgatccatcgccgctgcctannatccccatggcctcagcgaacaacgacaaccgcgaggcggcgggcatcctgcggctgctgatggggatggcggcnnngcggcnncccccgccctcggcatttgctcgggggggcggcgcggcggcggccggcgcctgatggtggtgcaacaccgtcattccctccaannnnnnnttcccaaaaggggaaaattgttttctgggggggggttccgggggggggggggtttccccccggggtttaaaaagcgccaaattcccccccctaaaaaaaggaaaaaaacccccgggggggggagagaagggcaaaaacccccaaaaaaaaaaccacccccccgggggggggagggggcccctccttcttttggggggaggg

SEQ ID NO: 62561 - DNA, 752 bp, Zea mays
  misc_feature: Ceres CLONE 1528884
aagctggagctccccgcggtggcggccgctctatactagtggatcccccgggctgcaggaattcgtctcacccctagaaaaaatcccctgcgcctgccctcccctcctgcagcgcccgtcgcctccctttgcccttccctccctccctctccccgcgggccgccagaggcaatttcgccctcgattcgaccccgattcgtgcgcccgcgaccggtattccatccgccaagcgcggatctgaacgctgcgctccgtgtcgccgctcctagccgccgtgaaaggggccaattccgcgggtggctgccaggccgatgccaagcacgctgcgaagagcgaggggggggagaagcccgctgatggcaggaaagggaaggccgcgtaggacccccacaagtgctaacaggtcttcctcgcgcttctctctccgtcgtcgcatgaatttcctcaggagctcctcgcaaacaggcctccgaacaagtctgtcccctcgggggggaacgctgctggagactctcttaactcccagagctactccgagaaaggtcaccacggaccaggggtttcactctccaagacgaggaccatcccggtcatcgctgtcgactgcaaggcgcgagagtgaatgccgtatcagaagcgctcctgtttaggacggaagaacgaggcaataggaaggaggactctcgacttgtaacttgttgggagggtccctgactgcagatgaagtagcaaggtcctccagagtcaagcat

SEQ ID NO: 62562 - DNA, 689 bp, Zea mays
  misc_feature: Ceres CLONE 1528885
  misc_feature: Translation starting site: 82
  misc_feature: SWISSPROT Homolog: EC 2.7.11.1 Non-specific serine/threonine protein kinase
  misc_feature (689)..(689): n is a, c, t, g, unknown, or other
tggcggccgctctagaactagtggatcccccgggctgcaggaattcgtctcacccctagaaaaatttttcttaacttagtgatggagtttgttcctgagtcactacatcgtgtgctgaagcactacagcaatatgaaccagaggatgccgcttatttatgttaaattatatacctaccagatatttcgaggtttagcctatattcacacagtacctggtgtttgccacagggatgtgaaaccacagaatcttttggttgatccattgactcaccaagtgaagatatgtgattttgggagtgccaaaatggtggtcagaggtgaagcaaacatttcatatatatgctcacgttattaccgtgctccgcagctcatatttggggcaaccgaccacaccacatcaattgatatttggtcagctggatgtgttcttgctgagctgcattcttggccaccctctcttccctggcgaaagtgctgtgcatcaacttgttgagatcataacggttcttggtactcccccacgcgacgaaatccgttgtatgaatcccttctacgccgagtttatatttcctcagatcaaagctcacccatggcacaagattttccaccagcggatgcctccaaaaactatacatctcgcttccacctttgctccagtactcaccaaatcttaagatgcccctgctn

SEQ ID NO: 62563 - DNA, 740 bp, Zea mays
  misc_feature: Ceres CLONE 1528891
  misc_feature: Encodes the peptide sequence at SEQ ID NO. 62564
  misc_feature (740)..(740): n is a, c, t, g, unknown, or other
tggcggccgctctagaactagtggatcccccgggctgcaggaattcgtctcacccctagaaaaatcccttctcttgttcctttcttctctccgggctcacctaccggatcatcctccatggccaccctcgccttgccgccgaccaccaaggctgccggccaggacgccacccaggaaagcctagcagagaatcctgccaaggacgccgcagatccgggcagcatggagtccgagtgggttcttctcggaaaatcggacatcgtcccggccgatgtggccgccgccgccgccgcggggcaccaccacctcaacttcgcgccgctgccgatgatccctatctgctcgaccaattgcgatgtgggggactactctccatactatccacctgcgtaggaacagcgcccgcgcctctctttcccccaattgcgatgaatatcctttttgtaagactcccaactcttccaaaacccagggctccaataatccttcataggttcccctcaccaagcgtgcctaatgccttcccccggtcaccaagttataatcccggatatctccctaaccccaccaagatggacggcctcactattctccatggatgatccctcacgccgcaggaaagaaatcacgtcactgccagggtcgcctgtaattcctaaccctcccacgtggtacataataatatacttcacgacaccacctgacgacccgtccgcgcatagtttcttagaataggcccn

SEQ ID NO: 62564 - protein, 91 aa, Zea mays
  misc_feature: Ceres CLONE 1528891
MATLALPPTTKAAGQDATQESLAENPAKDAADPGSMESEWVLLGKSDIVPADVAAAAAAGHHHLNFAPLPMIPICSTNCDVGDYSPYYPPA

SEQ ID NO: 62565 - DNA, 702 bp, Zea mays
  misc_feature: Ceres CLONE 1528895
  misc_feature: Encodes the peptide sequence at SEQ ID NO. 62566
tccccgcggtggcggccgctctagaactagtggatcccccgggctgcaggaattcgtctcacccctagaaaaaaggtaggtgtactgtactgtagtaggttggttctccattcatcattcagctcacaggtccctccgcctccgccgtatcggagggagaggaagcggaaggcttggaaggagaagagaatggcggggcggcgcgcggaggaggagtacgactacctgttcaaggtggtgctgatcggggactcgggcgtcggcaagtccaacctcctctcccgcttcacccgcaacgagttctgcctcgagtccaagtccaccatcggcgtcgagttcgccacacggacactccatgttgagggcaagatcatcaaggcgcagatctgggacacggcaggccaggagcggtaccgggcgatcaccagcgcctactatcgcggggcgctgggcgcggtcctggtctacgacgtgagcaagcccaccaccttcgagaacatcagccggtggctcaaggagctacgcgaccacgctcaactccacaccaggatcatgctcgccggcaacaggacggacctgaggcacctccgggccgtcgcccccgactaccctcggagttcccctgaggcagaaggcctggcctttatcggaacgatcgcggcgggaggcacccccggtggaggaggcggtccgtcttccccg

SEQ ID NO: 62566 - protein, 171 aa, Zea mays
  misc_feature: Ceres CLONE 1528895
  misc_feature (15)..(163): Pfam Name: Ras Pfam Description: Ras family
  misc_feature (15)..(129): Pfam Name: Miro Pfam Description: Miro-like protein
  misc_feature: SWISSPROT Homolog: EC 2.7.11.1 Non-specific serine/threonine protein kinase
MAGRRAEEEYDYLFKVVLIGDSGVGKSNLLSRFTRNEFCLESKSTIGVEFATRTLHVEGKIIKAQIWDTAGQERYRAITSAYYRGALGAVLVYDVSKPTTFENISRWLKELRDHAQLHTRIMLAGNRTDLRHLRAVAPDYPRSSPEAEGLAFIGTIAAGGTPGGGGGPSSP

SEQ ID NO: 62567 - DNA, 708 bp, Zea mays
  misc_feature: Ceres CLONE 1528897
  misc_feature: Translation starting site: 276
  misc_feature: SWISSPROT Homolog: EC 6.1.1.11 Serine--tRNA ligase
  misc_feature (708)..(708): n is a, c, t, g, unknown, or other
agctccccgcggtggcggccgctctagaactagtggatcccccgggctgcaggaattcgtctcacccctagaaaacgtcttttgtatgtgttggcagccgcgtaagttgacgtgcccgaggccaaaagcaccctcggcgcccgcgtccccacgattggcaacatcacgcatgactccgtgccgctcgacgacgactatcctctcctctctcttggcggccatttggacagaagagcagtagagatattttgaagactcacgtgcacctttgcaagatgcttgatattgtcgcattgaaccaggctgctgatgtggctggtgccaggggtttctatttaaaggacgaatgtgtcctccttaacctgttgttgataaattttgggctaccttttctgagtaaccccccatttaaaccagtgcctgctccttttttcatgagaaaggagactatggctgaatgtgcccatttggcccagtttcatgaagatctttacaaagttacaggtgatggcgaggacaagtgtctcatagctacctcagagcagcctttgtgtgcttctcacctaagtgatcgaatctacgctgctggaactccgatcagatatgctgggtactccacctgctttccggaaggaagctggttctcatggaagggacaccgctggtatcttctgagtcccccaatttgaaataattgaacaattctgn

SEQ ID NO: 62568 - DNA, 633 bp, Zea mays
  misc_feature: Ceres CLONE 1528904
  misc_feature: Encodes the peptide sequence at SEQ ID NO. 62569
ggagctccccgcggtggcggccgctctagaactagtggatcccccgggctgcaggaattcgtctcacccctagaaaaaacccacagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgccagcatcccctccaagtgcggcgtcagcatcccctacaccatcagcacctccaccgactgctccagggtgaactaaaacctagaacacgcgcgacgaccgccgcctgatcgatcgaccaacatttccgccttcccccccgggccggataatcggggcggccccccgagggaaattcttccacccccccgcggggaaaacaagggggccctt

SEQ ID NO: 62569 - protein, 121 aa, Zea mays
  misc_feature: Ceres CLONE 1528904
  misc_feature (32)..(117): Pfam Name: Tryp_alpha_amyl Pfam Description: Protease inhibitor/seed storage/LTP family
MARTQSAVAVAVVAAVLLLAAAATTSEAAITCGQVSSAIAPCLSYARGTGSGPSASCCSGVRNLKSAASTAADRRAACNCLKNAARGVSGLNAGNAASIPSKCGVSIPYTISTSTDCSRVN

SEQ ID NO: 62570 - DNA, 800 bp, Zea mays
  misc_feature: Ceres CLONE 1528906
  misc_feature: Encodes the peptide sequence at SEQ ID NO. 62571
  misc_feature (41)..(41): n is a, c, t, g, unknown, or other
tccttttgtatatatacttttttatgtaggggagttctccnccaaactgggactccccgcggtggcggccgctctagactagtggatcccccgggctgcaggaattcgtctcacccctagaaaaactccgcatctccctttaccattgtctcccccctcgtccgtcctcctcgccgccgcagaccaccgccgccgccgccgctgccgctgcgaacccttgtgaatcttcgttgtccgggctgtggggggcaggcatggcgctccggaggctgctgcaggggagcgtcctgccgcggataatcggcagggatttggcaccggccgtggcgccgttttcaacggagtctggggagaccattcgtgccacgctctttcccggcgatggcatcgggccagagatcgctgagtctgtcgagcaggtattcaatgttgcatgggtaccaattgaatgggaagaacactatgtcagtacggaagttgatcccagaacacagagtttttttgacttggggaagccttggagtcagtgcgaaaaaaataaagttggcttgaaaggacctactggctaccccctattggaaaggggccattgaatcttttgaatcctaaacttatggaaaggaactttgggttctatgcccaatgtgtagaaccttgctaacatccttccagggttactaagaccctgattacgagggagggttataccttttgtcaaacattcctggaaaaataccggtaggggagaataatagttgggtcttgtagccatcaaggttgttgaaaagaagtctcctggg

SEQ ID NO: 62571 - protein, 112 aa, Zea mays
  misc_feature: Ceres CLONE 1528906
  misc_feature: SWISSPROT Homolog: EC 1.1.1.85 3-isopropylmalate dehydrogenase
MALRRLLQGSVLPRIIGRDLAPAVAPFSTESGETIRATLFPGDGIGPEIAESVEQVFNVAWVPIEWEEHYVSTEVDPRTQSFFDLGKPWSQCEKNKVGLKGPTGYPLLERGH

SEQ ID NO: 62572 - DNA, 1048 bp, Zea mays
  misc_feature: Ceres CLONE 1528907-R
tgtattaagactcctttttcttcttctttattccgtttctcacattggcgggttgtgcgcttgtgcccgctcgcacgtgctcgccggcgcacccgcaccggcaggccgcccgcgaacgtggcggtcagccccggcgcgaacctgggccggcgggagctccggccgaccgcctcgatgtcgaagccccggaccacggccacgatcacggccttcatctccatcaaggccagctccttgccgaagcacacacgcgggacgggctggagcactggctacctatacgggatctcacgcacgaagcgtccggtcatccacccatctcctgggcggagatcttggctttagtcctccccccacacggcactcaccctgcgccctgggttcgggcccgtggcccggcgcagaggtgtggtgtcgggctcctgtggatggaggcccggttccccagctccctcatccgcccgctgatagttgctggctttttgcttactgcggtttctgtggcctcgcagccgcgccccgctgctgcaactgcccagatggatccacttctgtgccacctgactcttgattctcgttcccctcttggtccccctcctcttatacattttagtggccgaatatgcgcctcgcgtctgatgtcgcgccgcggcatggagtggtgtcctctggcgggtcattgcttgatttgttgcccgcaccttccatgcctcctcgtccccttcacgagtgcggcgatgtacgccggctcttaccctacatctttgtatccccgccgccctgatgtctcccgcaccatcccacgctcgaaagcgcgcgtcgccaggctttaggcgacagccctactgctccacgccatccccaccgggcgcttgtcctacctttattggtatttgaggaagatcgcctcgctctgcgcgttccgccgcggacgaaacatgtcgcccccctatgacatacggcccagacgcgccctggttcttggtcgcgctacgctcgatgctgctccatgtctcccggcgaccgtcctcctttgtgtctctcagct

SEQ ID NO: 62573 - DNA, 728 bp, Zea mays
  misc_feature: Ceres CLONE 1528911
  misc_feature (20)..(20): n is a, c, t, g, unknown, or other
tcccccgggctgcaggaatntcgtctcacccctagaaaaaatatccgcatccgctgcctccgcctctcgagtctcgtccacccgtcgtcctcctagctcctctactcgccagtcgccatgggcaagattaagatcggaatcaacggcttcgcgaaggatcgagcagggctcgtgggccaggggtcggcccctcccagagccgaaggaaatggccaagtcgtccccggtcacgaccccttcatcccccggagttcttggaccttctggttctaagttaagaaaccccgtcccggggccattgggaaaaccccaaacgggggaatttccccccctcagggaaccccaagaaaccccttttctttttgggggaaaaaacggggcacaccccccttttttgggggcccaggggacacccccctggggaaaaaaaccctccccccctggggaggagaaaagaagaaattttcaccccctcctcttaaaataaaaagaaagtttcgctgccgggggaggaaaaccaccccccccccggtggggcggtttttttttttttctgttcgggtggtgagccgactgaatgattatggatggggggcgctcccccacccccccacgcggcggggggggcgccgcaaaaaaagaagtgtttttttttctctcccccccccccccccccaagaaaagagacaaacaccacccccccccgttgctgtgtgtatgttgggtgg

SEQ ID NO: 62574 - DNA, 690 bp, Zea mays
  misc_feature: Ceres CLONE 1528914
  misc_feature: Encodes the peptide sequence at SEQ ID NO. 62575
tcccccgggctgcaggaattcgtctcacccctagaaaaaaaccacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgccggaattttagactggtgcttgagaggaaggaatctgctgagagcaccatggtggccctataaggctgctcaggacattgcttctgggctgagctggcacctacccctccgataaggctgggaactgctccttattttttccagggtcctttaatgaaatt

SEQ ID NO: 62575 - protein, 171 aa, Zea mays
  misc_feature: Ceres CLONE 1528914
  misc_feature (3)..(172): Pfam Name: 14-3-3 Pfam Description: 14-3-3 protein
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAGILDWCLRGRNLLRAPWWPYKAAQDIASGLSWHLPLR

SEQ ID NO: 62576 - DNA, 859 bp, Zea mays
  misc_feature: Ceres CLONE 1528916
  misc_feature: Encodes the peptide sequence at SEQ ID NO. 62577
acatagagtaatattattgtatattgatatttattaacgcgacaaaaatactgaacctccccgcggtggcggccgctctatactagtggatcccccgggctgcaggaattcgtctcacccctagaaaaaaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggataaggtagcgaaaactgttgactctgaggagctcactgtggaggagcgcaacctcctgtctgttgcatacaagaaacgtcattggagcccgccgtgcctcatggcgcatcatctcctccatcgagcagaaggaggatggtcgaggcaatgaggaccgtgtaaccactcatcaagggactaccctggcaagtattgaatactgagcctccccaagtatcttgtggatggcatcccccaaggcttctcagaatcatagcctttgttgcccgtccttcccacacgtctccccgagtttctcaatgtactttcttaatctcatagaatggaaaggtgtgaacatacataccagtataaccctatgcttaaggtttcatggaatctggtatcctgtaacaataaatgggaccccttggcttgaagaaaccacccattgggtgtggcctaaccaaagtgctgcccccagggataatttgccttttgcgccggaagcatttgctacctagatacgaaccctatataatggcattggagaacgtgaaatcttcaaactgtggctt

SEQ ID NO: 62577 - protein, 81 aa, Zea mays
  misc_feature: Ceres CLONE 1528916
MASAELSREENVYMAKLAEQAERYEEMVEFMDKVAKTVDSEELTVEERNLLSVAYKKRHWSPPCLMAHHLLHRAEGGWSRQ

SEQ ID NO: 62578 - DNA, 832 bp, Zea mays
  misc_feature: Ceres CLONE 1528919
  misc_feature: Encodes the peptide sequence at SEQ ID NO. 62579
  misc_feature (162)..(162): n is a, c, t, g, unknown, or other
  misc_feature (163)..(163): n is a, c, t, g, unknown, or other
gtggctggtgcatgtccttcttgtctggggcgggcgctatctttcatagtggagctcccgcggtggcggccgctctagaactagtggatcccccgggctgcaggaattcgtctcacccctagaaaaacccccccccccatctctcctcccctccccatctcnngctcttgcggagatcgaagagaagctgaggcctagcgccgcacccgccgccgcatcagccatcagccatggcgatggccgctcgcctcgtctcgcgctcccgtcagctacattcggttcaagcagctttttgcgaatgggaggtggcccactcaaggtttccgcttccctttttggcaggggaggcagttcccacttgaaccgtccttcctggttggtgggggaatgaatcccccggaaggggccttttttttttggggggaaagaaaaaaaagtttgggaaacagttttttggggggttccttttaaaaaggggaaaaggattccctttctcccccccccaaaaggaccccccgcggggcgagtttttctctcaaaaatggctgctcaatggcctttggagaaacatctgttgtagggggaaaaaaggggggggaatcttttttttttctggagatattctccgaggcgggattgataaatatttccccctcttgggtggaaccctcccctcccccggggggggggtcccctccctggtgtggggggggggggttgttttgtgagaaaacgtccctgtctaggaagagctgggagaaaaaaaaaagaggggggggcgctttctgatgaaacaattgtggggggagaataggccctctctttcgggtgg

SEQ ID NO: 62579 - protein, 43 aa, Zea mays
  misc_feature: Ceres CLONE 1528919
MAMAARLVSRSRQLHSVQAAFCEWEVAHSRFPLPFLAGEAVPT

SEQ ID NO: 62580 - DNA, 920 bp, Zea mays
  misc_feature: Ceres CLONE 1528920
  misc_feature (1)..(1): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
nggtgagggggaaaaattcaaagagtgggtgtttggttggatgnnngtgggttttgtaataactgggactccccgcggtggcggccgctctagaatagtggatcccccgggctgcaggaattcgtctcacccctagaaaaaaagaacgtgatttgatccgcatatgtttggtaaaagaacaaatcttctcctttaatcataaatgggaaagtgttcaattagaacattgaaaacgtgactcaatttggtccttagttagtcttccggacggaatgggaagaaaggcggagactctctaaccaggaaaaggatccctttcaaagaaatgaaacaagaagccgtatgaagggaaaattctccttgttccggttctgttaaaggggaaaggtaaggattgaatttatttcttgttcagatttttccccctcataagacccccccaaaaaaacccccactctcttgcccttttgtgaaaaatttcccaccaaaaaaaaaattatacccctctggggaatttaaaaaaatcaaggcgggattaatataccccctgggtttattggggccccttatttttttctcaacaaacaagcggtttcggtgggtgttcactccccactttattataaagaagaaaagaggcggttatagcagtatttttttctccccgcgggggggtgggagaatacgctcgatcgttatttatcgggagggaagcccccgcataagtgtggccgtttggagcgcttaaaaaacaataaattcttatgatccgagggcgggcgtctcttttaatatatggtggcgggggcgcttataactacccacacaataaacaaaagaggtgtgtgtctgtcttgtttattattgtccctcattataaagaaaaaaacagattattattgttatgtttttcttccttt

SEQ ID NO: 62581 - DNA, 951 bp, Zea mays
  misc_feature: Ceres CLONE 1528922
  misc_feature: Encodes the peptide sequence at SEQ ID NO. 62582
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
ttctaattgtcctcgttgcgacccgccccggggggcgcncnnncgcataactggagctccccgcggtggcggccgctctagaactagtggatcccccgggctgcaggaattcgtctcacccctagaaaagtggcgtcgtctccgcttttactagatcatcagtagccagctcaggagccgagcctggtcagggtagccaagcccatcccggtcctctcccggcgtcttctccctccgcaccgcggctccggcgatggcgggcgtcggctccgcgctgcgtcggctctacctctccgtctacaactgggtcgtcttcttcggatgggcgcaggtgctgtactacgcgggtcttgaccctgcgtgttgagcggccacaagggtctcctacgcccgccgtcgagaggccgcttgcaatctcccgcaaacgggcgggcagcgatggaaaatccttcttggggtttcgtaaccccccggtggagggtctcccggtctttggcaaactcttcccgacgggatggggatcgccgcgtgggactcccttcccgggcgcggtcgtctggggtcggacgcttcttctaaacatcacctacatatgacccgtcgctaaccggtgcagagccaacgtctcacgacatcacgtccatccacggctccaccccgtatctattgaacatgcgagttgtatcaaggacttccattttcgacttctcgccgcggtgacttctcgcgttattcttgcgtgctgtgttccgcgccaacgcttcctatatgtcagctaattccgctgtttactctgcgtcgaggacgcggtgtgtcttcggtatctccgggcggttccggcgcgcgtgcgcgttgggtggctgaggacgaggttagcgctacgatcgcgggtgtcccgttgtgcggcgatacatgcgactatcgcctgttgggactgtgctggatgcacag

SEQ ID NO: 62582 - protein, 37 aa, Zea mays
  misc_feature: Ceres CLONE 1528922
MAGVGSALRRLYLSVYNWVVFFGWAQVLYYAGLDPAC

SEQ ID NO: 62583 - DNA, 593 bp, Zea mays
  misc_feature: Ceres CLONE 1528926
atgatcccccgggctgaggattctctccccctagaaaaaccaatccccgattccttacacgctaagccacgcaacgcaacgcaactagcctgacatgaatccagcagcggcggcggccatgtctcggggtcccggtcacctccaagcgcacggaagaggagtgtcaggatccgtccttcggcaaggcgcggcgacacctgccgtctcgtgacgcacccagccctaccgtcttttcgctacagccccaggcagcaaagccaggtgacccctgggtgacaaactaacaaaaggcccagggttccaaaagctttgaccttggggcccaaaacttccgaaacccgaaaaggaaaactaaaccctgggcccccgaaatctttaaggctcgccggggttgaaaacctttttttccccagggttttttctccccccccaaaaaaggggaaaaagggtttttcaaagggcctttaagtgcgtatattttaacccccgggggggggccccatccccgggggagtgttttttttttttccccaaaaaaaaggggcccttttttcggaaagaaaccccccccataaaggtggttctcccccccg

SEQ ID NO: 62584 - DNA, 715 bp, Zea mays
  misc_feature: Ceres CLONE 1528928
  misc_feature: Encodes the peptide sequence at SEQ ID NO. 62585
  misc_feature (715)..(715): n is a, c, t, g, unknown, or other
ggatcccccgggctgcaggaattcgtctcacccctagaaaaagattggcagaggaacatgggactcttgggtcatgcctcttcaacaacaggctgatataatctgcaacaaggtcaaggaaatgaaacaactgagaggtggctacaacatagttggtctgtctcaggggaacttgattggtcgagcagtggttgagtactgtgatgatggaccgccggtcaagaatttcatctctctaggaggtcctcatgctggtaccgcttcagtgcctctttgtggttctggatttttttgcattattgttgatgctctgatcaaattggagatctactcagactatgtgcaggaacatcttgcacctagtggctacctccaaatccccacctgatatggcagattatctgaagagttgtaggtttcttccacaacttaacaatgaaattccagatataagaaatgcctccttacaaggaaagattcgttagcttaaagaatttggttctgattatgtttcaagatgaatggcttcctgataccacgagaaaacgcatggtttggttactaccctgatggaagcctttgatccatgttctacatccttcgaaaaaccgaaacttgtatgaaggaaagactgggattggtttttgaagaaccctgaaatgaaaccacgggccggggcgaaagtcttgtgtcttgtggcccgtgagagggccan

SEQ ID NO: 62585 - protein, 104 aa, Zea mays
  misc_feature: Ceres CLONE 1528928
  misc_feature: SWISSPROT Homolog: EC 3.1.2.22 Palmitoyl-protein hydrolase
MPLQQQADIICNKVKEMKQLRGGYNIVGLSQGNLIGRAVVEYCDDGPPVKNFISLGGPHAGTASVPLCGSGFFCIIVDALIKLEIYSDYVQEHLAPSGYLQIPT

SEQ ID NO: 62586 - DNA, 717 bp, Zea mays
  misc_feature: Ceres CLONE 1528932
  misc_feature: Encodes the peptide sequence at SEQ ID NO. 62587
  misc_feature (717)..(717): n is a, c, t, g, unknown, or other
ccccgcggtggcggccgctctattactagtggatcccccgggctgcaggaattcgtctcacccctagaaaaaaccaccgcagccgcagcacaatcgcctcgccttcccttccccaccagcccccgtctctctctctctctttctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggacgggctgtcgctggccgagtcgggcggcttcgtcaaggtccccggcggcgcgcccgacaacgtcacctgcgccatcgccaaggtcggcgggtcctccgccttcgtcggcaagttcggcgacgacgagttcgggcacatgctggagaacatcctgaaacataacaacgtgaactcggaggggtgcctgttcgacaagcacgcgcggactgcgctggccttcgtgacgctcaagaacgacggggagcgcgagttcatgttctacaggaacccgagcgcggacatgctgctgacagaggcggagctggacctgggactggtgcggcacgccaggctgttccactacggctccatctcgctcatctccgagccgtgacgctcggcacacatggtcgccatgagcgcatccaaggccgcgggcgtgctn

SEQ ID NO: 62587 - protein, 157 aa, Zea mays
  misc_feature: Ceres CLONE 1528932
  misc_feature: SWISSPROT Homolog: EC 2.7.1.4 Fructokinase
MAPLGDGGAAAAAASNNLVVSFGEMLIDFVPDVDGLSLAESGGFVKVPGGAPDNVTCAIAKVGGSSAFVGKFGDDEFGHMLENILKHNNVNSEGCLFDKHARTALAFVTLKNDGEREFMFYRNPSADMLLTEAELDLGLVRHARLFHYGSISLISEP

SEQ ID NO: 62588 - DNA, 795 bp, Zea mays
  misc_feature: Ceres CLONE 1528935
  misc_feature: Encodes the peptide sequence at SEQ ID NO. 62589
atatgggtatggggagtaatagctaaaaaaaaggttttttcaaagctggagctccccgcggtggcggccgctctttactagtggatcccccgggctgcaggaattcgtctcacccctagaaaaaacgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgcgtacgccaagcagggcgccggcccgctccgccccggggtcgatcaggtcgagggcaccgtgaaggccgtcgtcggccccgtctacgaccgtttccacgccgtcccgctcgacctcctcaagttcatcgaccgcaaggttggtgagtccgttgaggagatagaccgccggcgtcctccagtggtgaaagaagccccaaccttggcccgctcggctgcaaaggaaggttcgcaggccgggcctggaggggcacggccactggggctttggcaagttcaagccatcggcccggggccgtagtccaaaagggccgggggaagtctctttcacccgcctaccgaatcctggggggccaaaggtgggcggtggcccgccattaaggtct

SEQ ID NO: 62589 - protein, 158 aa, Zea mays
  misc_feature: Ceres CLONE 1528935
  misc_feature (29)..(158): Pfam Name: REF Pfam Description: Rubber elongation factor protein (REF)
MADSATNDAPLVASNQPTEEEVTVERAAATEEQEEERLRYLEFVQQAAAQALVLAAAAYAYAKQGAGPLRPGVDQVEGTVKAVVGPVYDRFHAVPLDLLKFIDRKVGESVEEIDRRRPPVVKEAPTLARSAAKEGSQAGPGGARPLGLWQVQAIGPGP

SEQ ID NO: 62590 - DNA, 862 bp, Zea mays
  misc_feature: Ceres CLONE 1528937
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
gtggtgtgcgtgggttcgtgggattgcttnnnacntgtaacaacataacggaaattcgtcggggtggcggtggctttttactagtggatcccccgggctgcaggaattcgtctcacccctagaaaaagctctcgcctcgcctccccgacgcgagcgagcccaacacgcaaaacggaacgcttcctcctcgcacctccgccttatccgatggcgtccctcaccaccaccacgtcctcaccggccgccctcccggcggctaccaccgccaccgcggcatcgtccatatccccgctacgccggttcgaaacggccgctcctcgcgggggacgatgcgccctggcgcgccaccgctgccatcgccacggggtaggggatacaacacgtcccgcggatccaccatgccccccgccctccgcggttgcttacggcaggaaaactataccgtctacggctcttcgacaacatggtgtcgtcccaatcttcatatgggaagcggctgggccattggaaggtcatgtcgcccaaagcccgtggtggccggaagtgaatcatggcccggttcaggtagcgacttccttaatggctcaaggaggctcaataggttttgcgcacattgtgtatacgtgagactgaaagtggccaaaacgttctgtgtgagatcgggagtgatgcgttgatcgtgtagggaatagtagcgagcagaagatcatcagcgtctgtgtaagaggactactttttaagggggctgtcatatactatgccgaactgtgatcctcgattggctatccggagctggataagcaagcgtcttggtgtgaatagactaccatcgcggctagcacagatgaggtacgcagatacg

SEQ ID NO: 62591 - DNA, 801 bp, Zea mays
  misc_feature: Ceres CLONE 1528938
  misc_feature: Encodes the peptide sequence at SEQ ID NO. 62592
  misc_feature (1)..(1): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (488)..(488): n is a, c, t, g, unknown, or other
  misc_feature (636)..(636): n is a, c, t, g, unknown, or other
  misc_feature (637)..(637): n is a, c, t, g, unknown, or other
  misc_feature (641)..(641): n is a, c, t, g, unknown, or other
  misc_feature (642)..(642): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (695)..(695): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (717)..(717): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (786)..(786): n is a, c, t, g, unknown, or other
nataacataaagtgtttgcgccccgttnnnnntaataataataataaaactggagctccccgcggtggcggccgctctataatagtggatcccccgggctgcaggaattcgtctcacccctagaaaaatggtccgcgtcgtcacggggctcctccgtccgtaaggcaccgccgcagcgtctcgtctggatcaacaggccggccgatccgtcttcttcccctcctcctgcgggtcggcgtttggggatcatggcggcgcgggcggctgacgagaacaggataccggcggcagggaagcccgcgccaggcgtccgagacatggcgagccggcgcgcgctcacggacatcaagaacctcatcggggctgccccgtacccctacgccttcgccaagaagcccatgctgcagaagagcaaaagggacgaaaagcagccagcgttggcaagcagccggcccatgacaaggaaattccccggctccttggcgagnaagggccaacctgaaatgcagccgatcgtagctgatccagaaaacccgaagtttgtcaacagaatgaatcattatggatatggcaccgtttgatatttaatgtggaactctacgaactcggcgacccgggtgaacgcgcacatcgacnngggnngtcaattcagaaacaggttctttatgaannnattataaatctgctcatgggancttggnnnnttcataaatctgngagaaacccgactttgcttgctnnnngaaatatggttgtaaagataatcttnnnnncctttttagcaanagcaatcaacgcagc

SEQ ID NO: 62592 - protein, 110 aa, Zea mays
  misc_feature: Ceres CLONE 1528938
  misc_feature (80)..(80): Xaa is any aa, unknown, or other
MAARAADENRIPAAGKPAPGVRDMASRRALTDIKNLIGAAPYPYAFAKKPMLQKSKRDEKQPALASSRPMTRKFPGSLAXKGQPEMQPIVADPENPKFVNRMNHYGYGTV

SEQ ID NO: 62593 - DNA, 781 bp, Zea mays
  misc_feature: Ceres CLONE 1528941
  misc_feature: Encodes the peptide sequence at SEQ ID NO. 62594
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (83)..(83): n is a, c, t, g, unknown, or other
tttttttttcccgtgtgtcgggacggcccgggggggtnnnnnnttcatagctgtgactccccgcggtggcggccgctcttcancagtggatcccccgggctgcaggttttcgtctcacccctagaaaaattccgtcgtcgtcgtcagcagcttctgcttgctttgtgggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcctccgagccggccgtgtccgtgcagctcggcgaccacggccacctcgcttactcccacaccaaccaggcgctcctccgccccaggtcgttcgcggccaaggacgaggtgttctgcctgttcgaaggggtgctggacaaccctgggtcggctgagccagcagcacgggctgtccagcaagggcgccaacgaggtgctcctcgtcatcgaggcctacaagacgctgcgcgaccgcgcgccctacccggccagcttcatgctcgcccagctcaccggctccctacgccttcgtccttctttgacaggacccacaaactccctggttcgtcgcttccgacccccgaagggcaggggtgccccctcctcttggggggatctcccgcccgaaggggctgcgtctcccctttcctccgaagccacattccga

SEQ ID NO: 62594 - protein, 181 aa, Zea mays
  misc_feature: Ceres CLONE 1528941
MLAVFSGQVVEVPAELVAAGSRTPSPKTKASQLVGRFLAASEPAVSVQLGDHGHLAYSHTNQALLRPRSFAAKDEVFCLFEGVLDNPGSAEPAARAVQQGRQRGAPRHRGLQDAARPRALPGQLHARPAHRLPTPSSFFDRTHKLPGSSLPTPEGQGCPLLLGGSPARRGCVSPFLRSHIP

SEQ ID NO: 62595 - DNA, 789 bp, Zea mays
  misc_feature: Ceres CLONE 1528944
  misc_feature: Encodes the peptide sequence at SEQ ID NO. 62596
  misc_feature (30)..(30): n is a, c, t, g, unknown, or other
cggatgggtggtggtgggcgggggtggatngtagggaagatataacgccggaggacgaactcaacgtggtggcggccgctctagaactagtggatcccccgggctgcaggaattcgtctcacccctagaaaaaactccaaagccaacaaacagagctccaactcagaaagcatccgtcccttggcagcagcaacaagctactagctatgtgtgtttagagcgagcgaggggaaaaaaaaagaaaacatctaagatatactccatcatcttcgtttgattaacccgcccagtaaagccatgggtactaatgatagagcggtcatttctctagtactcctcgtgtgcatcgctagccgctcgtccttgggtgccgctgaaactgacgttgagcagaagcgctcgtcagtcccgttgatgtttgtgttcggtgattcgctggtcaatgtcagaaacaacaacatcctgccgccgcctgcaccccgtgctgcatctccgtacggcatcgaattccctgctggcacccccggcgccgtctcaggacggttcacgaaatggctacaaccttgcgcgatttaagccgcgcgacgcctgggggttcaagatgagtccccccggcttaacgtctcggtaaacaccgtaatcaagagttggacctggttcacttgtccgaaaatggggggcaaaataacgcggcgtggggagagtcggggcatacgtgaaaaccacgggggataaggggaccagtccaggctggagagaagcaaaaatcaggctgtgtttcttaatacg

SEQ ID NO: 62596 - protein, 92 aa, Zea mays
  misc_feature: Ceres CLONE 1528944
MGTNDRAVISLVLLVCIASRSSLGAAETDVEQKRSSVPLMFVFGDSLVNVRNNNILPPPAPRAASPYGIEFPAGTPGAVSGRFTKWLQPCAI

SEQ ID NO: 62597 - DNA, 890 bp, Zea mays
  misc_feature: Ceres CLONE 1528947
gtctggcattggattcttacgatattctaaaaaacttatctgtaatacctggactcaccgcggtggcggcggctctatactagtggatcccccgggctgcaggaattcaacacacccctagaaaaaaccccatcgcacgcactcctcatcttattatccgcctcctccggtcctcccgccgctgttgctcacttctgagtcccgacgcacgagctcccaatagctagccatggagtcgatcaccctctcctccgccttcagcctcctataccgcccctccaactccccgtgccccgccacctaactcctgaggtactcccacgccgcgccccaaatccgccggggtcgccgcgccatcaccgtctcgttgaatgacctccttatactcttagaaactggagattcagggacgacatctcacagtatcatcgtttggtaaatgtacaataaatattgtccccccccggggataaaatggttactggagtcttactgagctcgagcctatacctacaagtaatgtactacgatcagaagacattaaaatagatagtacagtgtggatattcgtcgttttttatggaggagtaaaccacgtccatttcaataaagaactggtgaatgttcatgcgcgtaagtaagtacagaataagatggagacagattaatcgtgatcgcgatatgtgccaagttattaaggctcgttggggccctcgtcttttagaaactcttcttatcctttccatacatagaaataatattaccatcgctacggtaaatctcaactataaagctttagacgaagtctctcctctctggagatgtgaagtatagtacataagctgtcatgtagaatatttatccaatgattattttctgtcacacctgtg

SEQ ID NO: 62598 - DNA, 964 bp, Zea mays
  misc_feature: Ceres CLONE 1528952
  misc_feature: Encodes the peptide sequence at SEQ ID NO. 62599
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
cttcttgtttctccctcctctaatttcnnccnnnnnnnnnnnnnnaaaaactggagctccccgcggtggcggccgctctagaatagtggatcccccgggctgcaggaattcgtctcacccctagaaaaagggccagttgtcgcccgcccgcgtcgtcgtctccgccggccggtcggcctcccaaaccctagcgagccgagcgagagagaaactagacgccatgttcgggtacaggaaggcggacccggacctcgaggccggcgggtcctcgctgctgtacccggggatgacggagagtcccgaactgcggtgggcgttcgtccgcaagatctacgtcatcctcgcggtccagctcgccatgacggcagccgttctcggccttcgtacgtcaagggtgcccgtccgtttccaatttttttccgtctccggcggagggggggggatcgcgccttctacattcttcctccaaccccccccgttcgtttttacgagcctggtgccccttctggcgctaacttagcccgcctgcaaatcgattccggacttcgtacccttgcctgtcttgttgtcgcgcctatcttgtctttcattctcgcccatgtcttggtttttcctcccgcgactgtggctatgaaccaattggccccctttactcttcgtagcgctggcgtagacatcttccagttattggggcagggcgtgtgcgtgtatagcgatggacgaagttgtgtgctggtggtcgtgaccccaccttttgtgtcgttgattttgatcaccctgtcccctgagtgccttgctgagaggcatggcgtttctctattgaacttcttttttattgttgtatctcggtccctgctcctgatgaaccaggctgacggactcattagagcgagccgaatggggagtgtgcacccttcgactcgaccttctcgtcacgtttccatgtgggccgcacgcgatccta

SEQ ID NO: 62599 - protein, 99 aa, Zea mays
  misc_feature: Ceres CLONE 1528952
MFGYRKADPDLEAGGSSLLYPGMTESPELRWAFVRKIYVILAVQLAMTAAVLGLRTSRVPVRFQFFSVSGGGGGIAPSTFFLQPPPFVFTSLVPLLALT

SEQ ID NO: 62600 - DNA, 766 bp, Zea mays
  misc_feature: Ceres CLONE 1528966
  misc_feature: Encodes the peptide sequence at SEQ ID NO. 62601
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (29)..(29): n is a, c, t, g, unknown, or other
  misc_feature (32)..(32): n is a, c, t, g, unknown, or other
  misc_feature (45)..(45): n is a, c, t, g, unknown, or other
nnnnnnnnnnnnnnnnnnnnnccccggcncanccaggggggagtntcaaactggagctccaccgcggtggcggccgctctagaactagtggatcccccgggctgcaggaattcgtctcacccctagaaaaactagccgccgccagaccattcgtttctcgcgagccatcgcttctgtgattctcaggcatccggaagaaatggccgagtcgaagaaccacgcggcgcacaaccagtcggtcgaggcgcacaataacggcattagaaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttacctcaggtccacctttacgacctggggttttgctgaagatggaacttaagtggtgctactgtatgatggcaaggaccttttgctgccgaaggttatgttttgaagctcatgctaccttctagagcacggattacctcgtccctatgttcatcatttccgcctccgacagctacttctgcattacgggattcgccggaaaaatcaaagaggcccccccgaagtctggtcgctttccgtttacatccctcggcgccgccctctcccagctctccctcccattcgacctccaccccccaagcgctcacccggaccccggctccttggcgcctgcctctccaacctacccgccg

SEQ ID NO: 62601 - protein, 60 aa, Zea mays
  misc_feature: Ceres CLONE 1528966
  misc_feature (3)..(42): Pfam Name: Ribosomal_L29e Pfam Description: Ribosomal L29e protein family
MAESKNHAAHNQSVEAHNNGIRKPKRHRQTSTKGMDPKFLRNLRYSRKGNKKSGEAEAEE

SEQ ID NO: 62602 - DNA, 836 bp, Zea mays
  misc_feature: Ceres CLONE 1528973
  misc_feature: Translation starting site: 275
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (37)..(37): n is a, c, t, g, unknown, or other
  misc_feature (50)..(50): n is a, c, t, g, unknown, or other
nnnnnttttnnnnnnnnnnnnnnnnnnnnnnnttttntcatatgtaaccnagtaattgagtcgggacaacggcggccgctctagtactaggggatcccccgggctgcaggaattcgtctcacccctagaaaaaccaggacacggccagccggaacaccccgacaacccaggaccagaacagccgcgtcgaggcggccctcgagacccccggccccgacccatcccaccaccacccccacccccacccccacctcgcctcccggatccgcacccgatgggcagcctcagaggaaacacggagacgcagggagcgaggcggcggccgcggttcctgtgcctgcacgggaaccgcaccagcggcgagatcatgcgcaagctggtgctccgggaagtggtccgccgacgtcacggcgcgcgcttacctcgtcttcgccgacgcgcccgttcccccgccgagggcagagtccgatggcgaagggagtcttacaacccgacccccaactacgatggggttccagaatctaatagtagtgttttaggggaggaacaggtgaatttgcgacaagaatgtcgtgagacctaacaagcggggaaggtgtattaataaaaggaacgggccccctacaaaaccggagaggaatgggattaccaccccgacaggttccacgtgcgtgacggggggccgcctccgggtgttttctcaatatcaacggggaatggtccctgaaaaagaaagatccttcaatggttgagggtatcttattcattcttcacatgggaggaccaaaattacaacctgaataaaacgagggcaccgactatggacgtgaagcgcg

SEQ ID NO: 62603 - DNA, 753 bp, Zea mays
  misc_feature: Ceres CLONE 1528976
  misc_feature: Encodes the peptide sequence at SEQ ID NO. 62604
  misc_feature (14)..(14): n is a, c, t, g, unknown, or other
  misc_feature (33)..(33): n is a, c, t, g, unknown, or other
  misc_feature (38)..(38): n is a, c, t, g, unknown, or other
  misc_feature (72)..(72): n is a, c, t, g, unknown, or other
  misc_feature (321)..(321): n is a, c, t, g, unknown, or other
  misc_feature (553)..(553): n is a, c, t, g, unknown, or other
  misc_feature (554)..(554): n is a, c, t, g, unknown, or other
  misc_feature (604)..(604): n is a, c, t, g, unknown, or other
caccggcgcccacntctacccgtcccttcccgnacccnacgcaaacttcaatcgggcgctgaccgaggtggntgccgctctagactattggatcccccgggctgcaggaattcgtctcacccctagaaaaaagctagacatcacacagcgagcgagcgagagcggtgagcccggccaccagcgccggaggccgtcgtcgtcttactagccgacgctcgacttgggcatgaattgctagccgggtgagagattgctaggtagccagctaggtacggtgtgggggagttgaatcggaggtctgccgctcgaggcggcggcggnagaaggccggtaggatgaagaagctccactggctggtgcggttcctgttcgggccggcgccggtctacttctcggcgctggccatccctcatcgcgctcaccaacgcgcagtacttcgggctggtgggcgtcggcgtggcgccgcgcaccgcgaagctggcctcctcaggcgcccgtggtcagcgtcatgaagtactgctacatcttccgcggcgagtgggtgcctgacgcnnaggcgccctactactaccactagacgtgccacatgatccaggagcaccanaactgcctcaagtacggccgccccgaactgggcttcctcaagtggcggtggcgcccctccggatgccagctgccgcgcttcgcaaccgatgcagttcctggatctcgcccgcgggaaagtcgctgggccttcgtccgggactcccctgg

SEQ ID NO: 62604 - protein, 55 aa, Zea mays
  misc_feature: Ceres CLONE 1528976
  misc_feature (6)..(6): Xaa is any aa, unknown, or other
MIQEHXNCLKYGRPELGFLKWRWRPSGCQLPRFATDAVPGSRPRESRWAFVRDSP

SEQ ID NO: 62605 - DNA, 751 bp, Zea mays
  misc_feature: Ceres CLONE 1528977
  misc_feature: Encodes the peptide sequence at SEQ ID NO. 62606
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
gacagcgacgaacaaggggaataataaatccaccctnaaaaaaaacnnnccaaaatggagctacacgcggtggaggccgctctagatctagtggatcccccgggctgcaggaattcgtctcacccctagaaaaagccgtctcctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagatcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcagccgccgtgttcgcctggaagggggagacccttgaaaagtactggtggtgcaccaagcgcctgccttgactggggcgaggcgggcggccccgacctcatcttcgacgacggcggggacaccacgctgctcatccactagggtggtaagggcccaagaggagtacgacaagaacgggtagatccccgtacccggtagtcaccctaatcacgctgaattttctataatcgcgcg

SEQ ID NO: 62606 - protein, 125 aa, Zea mays
  misc_feature: Ceres CLONE 1528977
  misc_feature (12)..(125): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEIGPSKPFAGARISGSLHMTIQTAVLIETLTALGAEVRWCSCNIFSTQDHAAAAIARDSAAVFAWKGETLEKYWWCTKRLP

SEQ ID NO: 62607 - DNA, 764 bp, Zea mays
  misc_feature: Ceres CLONE 1528978
  misc_feature: Encodes the peptide sequence at SEQ ID NO. 62608
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (764)..(764): n is a, c, t, g, unknown, or other
nnnnnnnnnnnnnnnnnnnnnnnnntttttttttatctatggttcaaaactggaactccaccgcggtggcggccgctctagatctagtggatcccccgggctgcaggaattcgtctcacccctagaaaaaacttcaccccagttcgccgtctacgcgctccgtctcccccaaaccccacctcctcgccggaaccctagcccccgccgacgcggcgccatgagggagatcctccacattcagggcggacagtgcggtaaccagatcggtgcgaagttctgggaggtgatctgcgacgagcacggcatcgaccacaccggcaagtatgccggcgactccgacctccagctcgagcgcatcaacgtctactacaacgaggccagcggcggccgcttcgtcccgcgcgccgtcctcatggaccttgagcccggcaccatggactccgtgcgctcggggcccttcggccagatcttccgccccgacaacttcgtcttcggccagtccggcgccggcaacaactgggccaagggccactacaccgagggcgccgagctaatcgactccgtgctggacgtcgtgcgcaatgaggccgagaattgcgactgcctccaagggttccaggtctgccactcactgggaggaggtactggttcaggaatgggcaccctggctcatctctaatatcaggggaggagtatcccggatcgggatgatggttaacaattctctgtttttcccagccgccccagggtgtcctgaatactgn

SEQ ID NO: 62608 - protein, 153 aa, Zea mays
  misc_feature: Ceres CLONE 1528978
  misc_feature (45)..(151): Pfam Name: Tubulin Pfam Description: Tubulin/FtsZ family, GTPase domain
MREILHIQGGQCGNQIGAKFWEVICDEHGIDHTGKYAGDSDLQLERINVYYNEASGGRFVPRAVLMDLEPGTMDSVRSGPFGQIFRPDNFVFGQSGAGNNWAKGHYTEGAELIDSVLDVVRNEAENCDCLQGFQVCHSLGGGTGSGMGTLAHL

SEQ ID NO: 62609 - DNA, 843 bp, Zea mays
  misc_feature: Ceres CLONE 1528984
  misc_feature: Pfam Name: UPF0051 Pfam Description: Uncharacterized protein family (UPF0051)
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (31)..(31): n is a, c, t, g, unknown, or other
  misc_feature (33)..(33): n is a, c, t, g, unknown, or other
  misc_feature (36)..(36): n is a, c, t, g, unknown, or other
  misc_feature (50)..(50): n is a, c, t, g, unknown, or other
nnnnnnnnnnnnnnnnnnnnnnnngggggananaancccccccccccccnaaaagcatggaactcccccaggaggcggccgctctagaatagtggatcccccgggctgcaggaattcgtctcacccctagaaaaactacgactcgaagcagctccatgctgcggttgtggagcttgtgtgtgaggagggggcagagatcaagtactccacggtgcagaattggtactctggtgatgaggacggcaaaggaggcatttataactttgtgacaaagaggggacggtgcaaagggcatggttcgaagatctcatggacacaggttgagactggatctgctattatctggaagcaccccagcgtcgagctcctcggggatgatagtgttggagaattctagtcgggtgggcccaccagagattgctttcaaccccacaccgggagcggggggggaggccacaatgtggaataattcccccccccccggatcatttcctgggggcatatcttgcaggggaagtcaaggggattggctcccggcgtcttgggtcccagataaaacccccaacgcccgaaacacgctttaaaaattactttcacgagtggggccctcattggcgggctccggggaaaaaaggtcggtttggcccaaaacgctattccctaccgattgcccaaggggttagccccctcacaaggcaccgggccggggcggcgacgcgcgggccacctctcccccgcacggtgcggggggtggagggacacttgtctgttccctttcccctaaaaaaccatccaattatggcctatcagccctgtttggcccccctttctcttcagtgaata

SEQ ID NO: 62610 - DNA, 827 bp, Zea mays
  misc_feature: Ceres CLONE 1528985
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (39)..(39): n is a, c, t, g, unknown, or other
nnnnnnnnnnnnnnnnnnnnnngggggggnnnnnaacgnaaaaataaagaaataaaaatccacgcagtgagggccgctctagaactagtggatcccccgggctgcaggaattcgtctcacctctgcaagaaagaagttccgcggactgcgtggcaagggccacactcaccacacgaacaggccgtccaggtagggccacctgcgaaacgcaaccagaccctttccctccgccgctaccgtagagcacacacatcttgatgctctgctacttgtggaacccgccccatgcaagctctctgatagaattaggtatatttgtgtcattgtcaaattttgctccctgtgtctacttttgagcaccttgaactccgttgtctgtaccgtggctgcaggtgacgcgtaccgaatcaaagaatatgattgtttagtagtgaattgctgtgtgaccccgaccttggcactcacttattcatgggtatgccccgggaaccatttcctttacaaaaccaacgtcttaattttacccctacccttaccactaagtttacagccataccccaaatacacaaagacgcagaccctcccaaggcaccaccatctccccccaactggtgaatacccacaataaacaactgcctacaagaaaggtgagatggtaaaagggaaaggagactgcgcgataacccatttaggtttaatccatttttatttaacacttaggtaaacattacaatctataacccaggctgggcgttgccgaacaaaacaacctccctccctctccacccttttataaaagttttggagaaacccggaaacggccagaa

SEQ ID NO: 62611 - DNA, 801 bp, Zea mays
  misc_feature: Ceres CLONE 1528987
  misc_feature: Encodes the peptide sequence at SEQ ID NO. 62612
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
nnnnnnnnnnnnnnnnnnnnnnnnnnnnnnnnnnnnnnngggggtgggnnnnnnttcacccgttttaaaaattggtggttccggcggtggcggccgctctagaactagtggatcccccgggctgcaggaattcgtctcacccctagaaaaagcccccgaggaaggaaccctagcctagccttgctccgaccggtcgccgcggcgactgcgacgatgatggactgcgctggaggccgagaccccgtggaggacttcctcctcggcggcgccggcgccggcgacgacggagatctcgtcgccgtcttctgcgacgacggaggacttgggattgagggtatccatggagatgcttgtggatttgagcaatctaatttggggaaaaggggtagagatgaaccatgttcatctggcccaacatccaaagcttgccgtgaaaaaatgaggagggacaagctgaatgacaggttcctggaattaagttcaattatgaatcctggtaaggaagcaaagttagataaagcaaatatattgagtgatgcagcccgtatggtggcacaacttagaggtgaggcagataagcttaaggaatcaaatgacaagttgcgggacaatatccaggatcctgaaggaggagaagaacgagctccgtgaaacagaaagtgacgactaaaggtacgaaaaagaataggctggagcagcaagtcaaaagctaatgaggtgtagcttccgtacaggatattgtcccccccttctccccttcatccaggcttccatacccatcccctgcttgccgtttcacct

SEQ ID NO: 62612 - protein, 145 aa, Zea mays
  misc_feature: Ceres CLONE 1528987
  misc_feature (66)..(117): Pfam Name: HLH Pfam Description: Helix-loop-helix DNA-binding domain
MMDCAGGRDPVEDFLLGGAGAGDDGDLVAVFCDDGGLGIEGIHGDACGFEQSNLGKRGRDEPCSSGPTSKACREKMRRDKLNDRFLELSSIMNPGKEAKLDKANILSDAARMVAQLRGEADKLKESNDKLRDNIQDPEGGEERAP

SEQ ID NO: 62613 - DNA, 776 bp, Zea mays
  misc_feature: Ceres CLONE 1528991
  misc_feature: Encodes the peptide sequence at SEQ ID NO. 62614
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (776)..(776): n is a, c, t, g, unknown, or other
nnnnnnnnnnnnnnnnnnnngggggggccccacccnnnnnttgcgccgannnngcgagactggagctccccgcggtggcggccgctctagaactagtggatcccccgggctgcaggaattcgtctcacccctagaaaaaagatcagatcacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgctcccggtgtgctctccatggccaacgccgggcccaacaccaacggctcccagttcttcatctgcaccgtcgcgaccccttggctcgacggcaagcacgtcgtcttcggccaagtcgacgaagggcatgggacgtccgtccaggccattcgagaaaggggggcaccccccaacgggatccaccctccaaggggggttcagggtctgctggacgggcgggaaaggggtctcccagagatccgctcagacacggggtcgggttccgggcccgccccn

SEQ ID NO: 62614 - protein, 192 aa, Zea mays
  misc_feature: Ceres CLONE 1528991
  misc_feature (5)..(170): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPKTAENFRALCTGEKGVGKSGKPLHYKGSTFHRVIPEFMCQGGDFTRGNGTGGESIYGEKFPDEKFVRKHTAPGVLSMANAGPNTNGSQFFICTVATPWLDGKHVVFGQVDEGHGTSVQAIRERGAPPNGIHPPRGVQGLLDGRERGLPEIRSDTGSGSGPAP

SEQ ID NO: 62615 - DNA, 779 bp, Zea mays
  misc_feature: Ceres CLONE 1528993
  misc_feature: Encodes the peptide sequence at SEQ ID NO. 62616
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
nnnnnnnnnnnnnnnnnnnnnnnnnnnnnnnnccaaaacccnnntgtgtgatnnnntgcaagctggagctccccgaggtggcggccgctctagactagtggatcccccgggctgcaggaattcgtctcacccctagaaaaaggttcgccggaaagccacgggttgggttcggcgggaggccgggaaacgggaatttatttcaccagtatgcaacagatggccatgccatcgttcgccgtaacctcacctccgacgcgtggcactaccttatgggcccctcatgctcgtcgtcctcaaagactgcacaggagacgcgtgcgcaaccgagtccgggcagaggctcaagcacagctgcagtaccagaagctgggggactcaaacctcctcatcggtgaggtcactcttggaacgatgacttttggcgagcaaaacacggaaaaggaagcgcatgacattatcgctgattctttcgatcaaagcgccaatatcctatgacacgccgagatttaccccaggtccgatgaacaaggaaactcaagggacaactgatctttatattggcaggtggatgcaatcccgaccgcgacaccaaaataattttggccacccaagatgcccgctaattcgaaaccggtctagcaattcctcccagacaaaggcacaagggcggtcgcgtccatgcggggcgatttgccaaaaaccgtgacgtcaaagagtcccaaaatccttggcccccagaattacccccgagcttcgcgtccaaaaaccgcggcgcaccc

SEQ ID NO: 62616 - protein, 95 aa, Zea mays
  misc_feature: Ceres CLONE 1528993
MQQMAMPSFAVTSPPTRGTTLWAPHARRPQRLHRRRVRNRVRAEAQAQLQYQKLGDSNLLIGEVTLGTMTFGEQNTEKEAHDIIADSFDQSANIL

SEQ ID NO: 62617 - DNA, 952 bp, Zea mays
  misc_feature: Ceres CLONE 1529007
  misc_feature (514)..(514): n is a, c, t, g, unknown, or other
  misc_feature (552)..(552): n is a, c, t, g, unknown, or other
  misc_feature (705)..(705): n is a, c, t, g, unknown, or other
  misc_feature (795)..(795): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
ccccgcgcgccgccccccccgcctacatattacaattatatattataaaaactggaactccccgcggtggcggccgctctagaactagtggatcccccgggctgcaggaattcgtctcacccctagaaaaaatgaaatggctgggaagtctgtttgtgctcaatagagtgtttcttctgtgaaataaaactggtctatgagatggtgtggcgagctctttgctttgctttgctctctgcaattcagttgtatcccattcttgctgtctttttctctgtaacataactttccgagtgactgaaattgctttggcatcgaaaaatattgaacgagacccttcgtggcgcccttttcgcctcttagggtgtctttttctcgcgcctgctatggctggtctaatttccgccttggccacagggaataaacacctggtcgtcacccaaattttatttctctcgcggcgggcgaccctccatttgggacgggcaccccgcacctccccaaaaaaaacccncacccccacacggcccctctcccacaaacagtgccacnacccccctttggcctctattagatcttctttccgaaggacaacaaattccaatagcgaagcgcccccctactcaaaacgttttacctctaatgtccactctcattccattccgctatccacgcgacaaccacactcctcttcgactattcctncccctgtgttgatcaccctaggcttactcccccgccttaccttgttggcccgcgccgctctccaccaccctctcaccatcgtatagacgntgcgcaattaaaagtggtctggaactaccccctaccgcggacggccattagcatgaggtaggaaagacagccgcgccgtcacaccacgaaatccaccccccgcgcccactcgctccccctcnnncccgccccttcgctgtctcgattccggtggtgt

SEQ ID NO: 62618 - DNA, 864 bp, Zea mays
  misc_feature: Ceres CLONE 1529024
  misc_feature: Encodes the peptide sequence at SEQ ID NO. 62619
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (729)..(729): n is a, c, t, g, unknown, or other
ccccnnnnnnnnnnnngggggcagcgcccccnnnnntgtgtttnnttaaactggactccccgcggtggcggccgctctagaactagtggatcccccgggctgcaggaattcgtctcacccctagaaaaattcacgcacctagggttttcgcgccgccgccgccgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggccctggcgccgcaccaagctcggcttccgagcggtcgggaattggcccgggctgcttgcggccgaaggctaggatctaagagcatttcttccttgacagttttgtcgatgtgtccaattttatcctggtacccaactaaggtggttgccttctgaccctctttatctaatctatcccccccccagcgggtgatgtccaggagaaaaatttgcacataagtgtgagagtacccccctataatttcccttggccggctatcatgttatattagtatattaaccagtgcgtctcttagtaggttacccctaaatcccccctcctacctctcttatcaccaatattaacatctctacccacctgggcccgtcgagtttgtacgccccgccgtgagcgcgggacagacccccggggctgtgggntcagaggcaatacccccgcctttgtagccaaaaccccccctttgtgggtcaattggcgcgaaaactaaaactcaaaaatgccccgcctcccttcacatccccttttcattccattttccgcggagaatgtgatgg

SEQ ID NO: 62619 - protein, 65 aa, Zea mays
  misc_feature: Ceres CLONE 1529024
  misc_feature (9)..(51): Pfam Name: Ribosomal_L39 Pfam Description: Ribosomal L39 protein
MPSHKTFRIKKKLAKKMRQNRPIPYWIRMRTDNTIRYNAKRRPWRRTKLGFRAVGNWPGLLAAEG

SEQ ID NO: 62620 - DNA, 737 bp, Zea mays
  misc_feature: Ceres CLONE 1529025
  misc_feature: Encodes the peptide sequence at SEQ ID NO. 62621
gctctagaactagtggatcccccgggctgcaggaattcgtctcacccctagaaaaaacaacaccgagaagcaacgaaaactagaaaaggctcctcccgaccgcaacgcaccctcatctccctcgaccccgacatccccgacccgatggcgcccaaggaggagaagaagccagcggagaagaagccggcggccgaggagaaagcggacaagacgaccgcagggaagaagcccaaggtcgagaagcggctgcccgcgtcaaagtcctccggcaaggagggcggcgaaaaaaaaaaaagaaagcgagacgctcgacgtacccaattcgccctatagtgagccgtatttcccgggctcactggccgacatggtacaaccgccccgactggggaaagctttggccccccccccaactttattctcccttgcaaccatttcccccctttcggcacccggtccccattcccgcaagagggcccgcgccccgattcgcctctctcccaaacaggtgtcccggccctcggaatggcggaatccccacattgtcccgcccccaacccctgttgcttaaaaacccccccgtctacattcccgggttaaccccccctcacattttttttaattcactaggggttgtaaacagagccagaatagccgtttttaaagcagaacccaaaagcctccgcctacagctgtctaccccggccatccacccttggcggataaaagactccccgccg

SEQ ID NO: 62621 - protein, 62 aa, Zea mays
  misc_feature: Ceres CLONE 1529025
MAPKEEKKPAEKKPAAEEKADKTTAGKKPKVEKRLPASKSSGKEGGEKKKRKRDARRTQFAL

SEQ ID NO: 62622 - DNA, 1395 bp, Zea mays
  misc_feature: Ceres CLONE 1529039
  misc_feature: Encodes the peptide sequence at SEQ ID NO. 62623
aaagcacactacagcaccgggcgaggcggctaggccccctcaccgtccaccggcgactgggccggccgtcgctgccgccctgcctctccaccgtcgccggcgacgagcaccactagctgttgttttgcctcccaggtgtttttgagtctgttgcgagtgttgtggccatgtccatgttcaataggatcttcgggaagcccaaggagcaggccaactccaatgctttggccactctggacaagttaaatgagacacttgatatgctggagaagaaagaaaaggtgctggagaaaaaagcaaacgctgagcttgagagagccaaggagttctcgaaagcaaagaataaaagagcggctatccaatccttgaagaggaaaaaactttatgagcaacaaattgagcagcttggaaattttcagttgagaatccatgatcagatgatcatgttagaagcagctaaagctacaacagagactgttgatgcattgagaactggagctgcagctatgaaagcaatgcaaaaagcaacaaacattgatgatgtcgacaagaccatggatgaaattaacgaacagactgaaaacatgaaacaaattcaggatgctttgtcagctcctcttggagcttttgctgatttcgacgaggatgaactggaagctgaacttgaagaactggagggagcagagttggaatctcagcttcttgagcctgttgcagctcctccggtgcatccagtgcatgtcccagccaacaagcaaccagctcgccctgccccacagaaagttacagctgaagatgatgaacttgctgcactgcaagcggaaatggcattgtgatcaggttctcatggagaggtgaaacatgtaaatgaagatgaaagctgagtcagctatactatatatttgccatgcgtgtacaaacttggccggatatttggcaaccgcagcagaaaaaagaggctgctccagcccagtgcttgtttcagtgactttggaatctgttgtcgatcgatgacagttcttctgttaatgtcgctcggttagctctacgctaattattcagatcacccaacgtgcattgtttcagtgttttgcttaattggcccatactgtctggagccgtgcatgtaaaagtgttgcagggttcacgtttgatgtggctgttcgcagcgctttcaacctcaggcaagatatgtttccttttatcagtactagagcaagactaataatacagtaggctactggctaaggatctttgtagtctctctcaacttactcgtatagcagttagctattcactgttaatatatggtctatttgtctcttataaagtttttacttatttattttaaaaaaaaaaaaaaaaaaaaaaaaaaaagaaaaaaaaaaaaaaaaa

SEQ ID NO: 62623 - protein, 222 aa, Zea mays
  misc_feature: Ceres CLONE 1529039
  misc_feature (21)..(189): Pfam Name: Snf7 Pfam Description: Snf7
MSMFNRIFGKPKEQANSNALATLDKLNETLDMLEKKEKVLEKKANAELERAKEFSKAKNKRAAIQSLKRKKLYEQQIEQLGNFQLRIHDQMIMLEAAKATTETVDALRTGAAAMKAMQKATNIDDVDKTMDEINEQTENMKQIQDALSAPLGAFADFDEDELEAELEELEGAELESQLLEPVAAPPVHPVHVPANKQPARPAPQKVTAEDDELAALQAEMAL

SEQ ID NO: 62624 - DNA, 698 bp, Zea mays
  misc_feature: Ceres CLONE 1529040
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaacttcctcctcatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcatggtttgtataaagggattctagatctaatcgactaaccagagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaag

SEQ ID NO: 62625 - DNA, 656 bp, Zea mays
  misc_feature: Ceres CLONE 1529042
  misc_feature: Encodes the peptide sequence at SEQ ID NO. 62626
atagctggagctccccgcggtggcggccgctctagaactagtggatcccccgggctgcaggaattcgtctcacccctagaaaaagccgcctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttgagccgcaccctcgacaagaacctcgctacgaacctgtttaagatgcttcccaagtaccggcctgaagacaaggctgccaaaaaggagaggcttctgaatagggcccaagctgagaatgaaggaaaaactgttgagtcgaataacccaattgttgttgaatcattggccctcaaccatgtggatttacctcgttggaccaaaacaaggcctcacccttggtggccatcgcttcacaacatggaactcccatccgaccttggttgtggcggcctc

SEQ ID NO: 62626 - protein, 167 aa, Zea mays
  misc_feature: Ceres CLONE 1529042
MAPKRGGRAPVPAKKKTDKVTNPLFEKRPKQFGIGGALPPKKDLHRFVKWPKVVRIQRQRRILKQRLKVPPALNQLSRTLDKNLATNLFKMLPKYRPEDKAAKKERLLNRAQAENEGKTVESNNPIVVESLALNHVDLPRWTKTRPHPWWPSLHNMELPSDLGCGGL

SEQ ID NO: 62627 - DNA, 718 bp, Zea mays
  misc_feature: Ceres CLONE 1529046
  misc_feature: Encodes the peptide sequence at SEQ ID NO. 62628
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
nnnccccaaccccnncanaatacaccatnnntnnnnnnntnnnggaaatnnnnnaaatactgggactcaccgcggtggcggccgctctagaactagtggatcccccgggctgcaggaattcgtctcacccctagaaaaagcctccccagcgtaacaagtgtccttcctccatcttcctcctccactccactcccaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctacagggaagagtgctgatggatcttggctctggggcaccacagaggatagcgtctatgacgctgtcaaatctatgactcagcacaacgtggggagctttggtgggtgccaaacctggacagaataaatccatccgctggcattggcactgaaaagagattacctccgggaaaatcatagtggcaggggaaagggccttcccaagtccaacttaagggttggggcgacttcctggaactggaaaaaaaaactaaacctg

SEQ ID NO: 62628 - protein, 103 aa, Zea mays
  misc_feature: Ceres CLONE 1529046
MQRAVQAVRSHGNVLKYAVLQHISAPKPAMLPAAFSRFMSVSSARLEDRGFETATVADVLKSTGKSADGSWLWGTTEDSVYDAVKSMTQHNVGSFGGCQTWTE

SEQ ID NO: 62629 - DNA, 622 bp, Zea mays
  misc_feature: Ceres CLONE 1529049
  misc_feature: Encodes the peptide sequence at SEQ ID NO. 62630
ggagctccccgcggtggcggccgctctagaacttgtggatcccccgggctgcaggaattcgtctcacccctagaaaaaattccctgttaatccaaatttctcacgaatcagatggtatccgtattccctgttgttccctctccgaattcgaccccgccgctaaaccccgcaccggttgccgaggcgtctcccgctccagctccgactctcacgcgactagggttctgtgcgtccacttccccgtcggcgcaatggaggtcgggggtcaagaagtgaagccaggagccacggtttcttgcaaagttggtgatggcttggttatccacctttcacaggctgcactgggggaatcaaagaaagcgagtgagaatgccattttgtctgttaatattgatgataagaaactagtgcttggaaccttatcagttgagaagcatcctcagatctcttgtgatcttgtatttgataaggattttgagctaccacacaattcaaaaacacgtagcgttttcttccgtggctacaagtcccctgttcctctgtttgagtctaattctggtgaagatagttccgatgaagagctaataaccgatcaaattccattgcagaataatgaaattaa

SEQ ID NO: 62630 - protein, 123 aa, Zea mays
  misc_feature: Ceres CLONE 1529049
MEVGGQEVKPGATVSCKVGDGLVIHLSQAALGESKKASENAILSVNIDDKKLVLGTLSVEKHPQISCDLVFDKDFELPHNSKTRSVFFRGYKSPVPLFESNSGEDSSDEELITDQIPLQNNEI

SEQ ID NO: 62631 - DNA, 874 bp, Zea mays
  misc_feature: Ceres CLONE 1529052
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (34)..(34): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (307)..(307): n is a, c, t, g, unknown, or other
  misc_feature (347)..(347): n is a, c, t, g, unknown, or other
  misc_feature (348)..(348): n is a, c, t, g, unknown, or other
  misc_feature (463)..(463): n is a, c, t, g, unknown, or other
  misc_feature (617)..(617): n is a, c, t, g, unknown, or other
nnnnnnnnnnnggggggggnncccccgnngnggnggggggnnnnnaaaagccgggcctcccgcggtggcggccgctctagactagtggatcccccgggctgcaggaattcgtctcacccctagaaaaagatatatttagcctctcatactagctgctcaacatcaccatgcccatgcatccatctcctacctacctctcaattgtactgtaatggagtatttcattggtttgtttatgctttggcttcctcttgaaaaagaaaaaaccaggaggcgctcgaggtacccaattcggcctatagggggncggatgaggcgcgttcacggcgccgggccttcgccccggnnggcgcggcgggaaagcccggggccttcccctcgcccccattcggcggggacccgcgccgccctttccgccctttttttgcgcgttcgccatccagggggggggggggggttgtanattacccgtggtcggtgggcgtatcaccacacccccggcctggatactagtgtcaatacacaacaagaattggttgtttaatacgtgaccggcatcccccccccctccgacccccttttgagaccatcaataaaatatcgcgggcggggggggnaaatgtggtggcgcctcgccccctacacccagcatattagaatctgcgtctccaatatatatttgacgccccctgctacacacacacgtgcaacccccgaggcgtacgcgcgcccatcggcgcgcccgggaacgcgccgccgtgccaaccaggcgtgagtggtggcggcggcacaagtcctcgcgccattttagatgttgacctcctctcagccgcgttcaacctaatgacaccccacccggtccgccgcggcccgg

SEQ ID NO: 62632 - DNA, 621 bp, Zea mays
  misc_feature: Ceres CLONE 1529060
  misc_feature: Encodes the peptide sequence at SEQ ID NO. 62633
aaaactggagctcaccgcggtggcggccgctctagaactagtggatcccccgggctgcaggaattcgtctcacccctagaaaaaatcagcctcatcaacctcgacgaaggaggaacgaacggacaggttgttgcacagaagcgacatggctttcgcgcccaaaacgtcctcctcctcctcgctgtcctcggcgttgcaggcagctcagtcgccgccgctgctcctgaggcggatgtcgtcgaccgcaacaccgagacggaggtacgacgcggccgtcgtcgtcactaccaccaccactgctagagctgcggcggctgctgtcacggttcccgccgccccgccgcaggcgccggcgccggcgccggtgccaccaaagcaagcggcggcacccgccgagaggaggagccgtccggtgtcggacaccatggcggcgctcatggccaaaggcaagacggcgttcatcccgtacatcaccgccggagacccgaacctagcgacaacggccgaggcgctgcgtctgctggacggctgtggcccccacatcatcgagctggggggtaccctgctcggacccctacatcgacggggcccatcttccaggcgtcggtgggcccgggttcc

SEQ ID NO: 62633 - protein, 158 aa, Zea mays
  misc_feature: Ceres CLONE 1529060
  misc_feature: SWISSPROT Homolog: EC 4.2.1.20 Tryptophan synthase
MAFAPKTSSSSSLSSALQAAQSPPLLLRRMSSTATPRRRYDAAVVVTTTTTARAAAAAVTVPAAPPQAPAPAPVPPKQAAAPAERRSRPVSDTMAALMAKGKTAFIPYITAGDPNLATTAEALRLLDGCGPHIIELGGTLLGPLHRRGPSSRRRWARV

SEQ ID NO: 62634 - DNA, 586 bp, Zea mays
  misc_feature: Ceres CLONE 1529063
  misc_feature: Encodes the peptide sequence at SEQ ID NO. 62635
  misc_feature (586)..(586): n is a, c, t, g, unknown, or other
ccgggctgcaggaattcgtctcacccctagaaaaaatccactgcggcacgcgtcccgcctctggtttgcttgcctcccagatcttgccaactaattggaggcagccgagctgatctcccatcccgcaacgcgccgtctcgacggcggatcgttttcttctgcttctactgcgtgatctttgggcaagaagataagacacgtccaagcgtcgccacagtcaagggcggcttggttgcagtcaagatggggaaggacagagaatctgccaagctgaaggaggagaaggggtccaaggatgagatccatatgaaggtcaagagcaagggcgagccgtccggcgaggaagacggcaaggaggaggtcgaggtagagattgaggccaagtttgttgagaaggaagaggtcacaggctcgggtgacggtgcgggaggaaagggtaccaggaagaaggataccaaggagatagacaagaaaaagaaggaaggtggtgacgattcagggaaggcagaggaagacaataaggggtaagcgaaagattcggagggcaatggccaattgaagaaggaaaaaaggatggtgctggggn

SEQ ID NO: 62635 - protein, 94 aa, Zea mays
  misc_feature: Ceres CLONE 1529063
MGKDRESAKLKEEKGSKDEIHMKVKSKGEPSGEEDGKEEVEVEIEAKFVEKEEVTGSGDGAGGKGTRKKDTKEIDKKKKEGGDDSGKAEEDNKG

SEQ ID NO: 62636 - DNA, 629 bp, Zea mays
  misc_feature: Ceres CLONE 1529064
  misc_feature: Translation starting site: 182
  misc_feature: SWISSPROT Homolog: EC 1.14.11.19 Leucocyanidin oxygenase
tccccgcggtggcggccgctatagaactagtggatcccccgggctgcaggaattcgtctcacccctagaaaaaaaataatccttaactgtctgatcatccatgttgcaacgattctcctgtactgtgatatggtataacaagtagtactgtacgattctcccggggagctcgacgatctagatggagatgacggggtctctccctgtgcccagcgtgcaggccatggtggccgctggtcgtcatgcaccagtgccaccaaggtatctccgtccagatctggccgcggatgtcgtcgttgccgacgacgcgacgaccatccccatcatcgacttccagcgactgctgctggtcgacccacaggaatctgcgcgcctgcctgcggcctgccaggactggggcttcttccagctgataaaccccggtgttccggacgatgtgatgggaggcgatgaaggccagcacccagtctttcttcgcgcttcctgcggaggccaagcagcagtaccgtcagcaggcaggacacctggaggggtacggccagctgttcctcctctccgagaacagaagctgggactgggccacttcctctaccttaacacgcagcccgccgaacaccggaaccctcacg

SEQ ID NO: 62637 - DNA, 640 bp, Zea mays
  misc_feature: Ceres CLONE 1529066
ggagctccccgcggtggcggccgctctagaactagtggatcccccgggctgcaggaattcgtctcacccctagaaaaagacgtaacactcctcagccgatattagtccgatccattccgccttccccatcgtctatcgaagtcctcgccgccgatctcatccccgacgatcgcactcgcgcgcgcgaggattcgcttctgggtgaataagccacccgagcctcgccggatacagaatcagcgacccctagccacgctgacactccactgcgccggcgatggaggtgaagcggcctacggcgggagcgggggatgcagaagcgcacaccatcgcgttgtccatgtcggtcatgtgggacacggtgcgcgccgccgtgatggaggccgaagcagcagaactggagccaactcaaatgtgaaatactcttccattggatcttgatctcgcttgtcacctctaaatcccctgcagaaacgacgccgctggtgtccctctcctgcgtggcgccgcagccattttcagctgtgtattagctgctcctgaggccatttcttctgatagagcccttccatctctgcacaatatgcaaccgtgcatggacggatcattcctgcggcgtatggagcatcgtgcctaactg

SEQ ID NO: 62638 - DNA, 747 bp, Zea mays
  misc_feature: Ceres CLONE 1529072
  misc_feature: Encodes the peptide sequence at SEQ ID NO. 62639
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (21)..(21): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
tttttttttttnnttgantgnagagacaaacagcttnnntnnnccgcctnnnnnaaaaactgcgactccaccgcggtggcggccgctcttttctagtggatcccccgggctgcaggaattcgtctcacccctagaaaaacccaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgctccccagagcatatggtacggccctgatcgccccaagtatcttggcccgttctacgagcagacgccgtcgtacctgaccggcgagttccccggcgacgaggggtgggacaccgcgggcctctcggccgacccgaagacattcgcccgctaccaggagttggaggtgatcccctcccggtgggcgatgctggacacgctgggctgcatgttcccagagtatcccgccccagaaacggcttcaaacttcagaaaaaggtgggtgcgttcatggcccggccgccgccaaatttttctcgttgagggcctggcttgtttacttacccccggggaaaaccccccacacctcgtgtggcaacgacctctatcaaaataccctcttgttacctattcctggggtccgcacagcaccag

SEQ ID NO: 62639 - protein, 175 aa, Zea mays
  misc_feature: Ceres CLONE 1529072
  misc_feature (59)..(169): Pfam Name: Chloroa_b-bind Pfam Description: Chlorophyll A-B binding protein
MAASALHQTTSFLGQALVSRAAGVDAGGRITMRRTVKSAPQSIWYGPDRPKYLGPFYEQTPSYLTGEFPGDEGWDTAGLSADPKTFARYQELEVIPSRWAMLDTLGCMFPEYPAPETASNFRKRWVRSWPGRRQIFLVEGLACLLTPGENPPHLVWQRPLSKYPLVTYSWGPHST

SEQ ID NO: 62640 - DNA, 631 bp, Zea mays
  misc_feature: Ceres CLONE 1529074
  misc_feature: Translation starting site: 70
  misc_feature (581)..(581): n is a, c, t, g, unknown, or other
gctcttcactagtggatcccccgggctgcaggaattcgtctcacccctagaaaaactccgccgcccgacatggcctccctcacctcggcctccacctcactcctcttcccgcaggcctcctcatccaggagccgcgtccggctctccacctccctgggcttctccgcgcagccggcgcgactgcagagccaggcggcggcaagagggcaacggcccgggagcctgctggtggtgcgcgcggcgagggaaaagtgcgagcgcaccaagccgcacgtaaacatcggcacgatcggtcacgtcgaccacggcaagaccaccctcaccgccgcgctcacgatggagctcgcctccgtcgggggcttcacgcccaataagtacgacgagatcgacgccgcccccgaagagcgtgcccgaggtcatcaccatcaactgcgccaccgtcgagtacgagaccgagacccggcactaggcgcacggagactgcccaggccaagccgactatgtcaagaacccgatcgccggacgctgcacatattggacggcgccacccttcatcggcatcaggcccccgactgctcccntagcatcaaaaaatttgagatacattcctccgtcggccacttaggaccgg

SEQ ID NO: 62641 - DNA, 643 bp, Zea mays
  misc_feature: Ceres CLONE 1529079
  misc_feature: Encodes the peptide sequence at SEQ ID NO. 62642
  misc_feature (619)..(619): n is a, c, t, g, unknown, or other
ggagctccccgcggtggcggccgctctagaactagtggatcccccgggctgcaggaattcgtctcacccctagaaaaaacactccacagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggacgtcagctccgcccggcgctcctcctacccgcggcgctgctcccttcgttgcagcccgccaggaggcacacgctgcagccgcccgccgcatccgccgagtccgcatgggaggccaagtctgtgggtttcctggacaagtacccggccctggtcaccggcttcatcttcttcatgtggtacttcctcaacgtcatattcaacatcctcaacaagaagatctacgactacttcccatatccatactttgcgtccttgatccatctagaactgagagtcgtatactgcctcatcanctggagtgtcggtctccccaagcg

SEQ ID NO: 62642 - protein, 161 aa, Zea mays
  misc_feature: Ceres CLONE 1529079
  misc_feature (154)..(154): Xaa is any aa, unknown, or other
MSALGTLSGGAAGVSGLLRLRRRAAPAPAIAAPSHLPAGTVKCAAAVPDAAPIVWGRQLRPALLLPAALLPSLQPARRHTLQPPAASAESAWEAKSVGFLDKYPALVTGFIFFMWYFLNVIFNILNKKIYDYFPYPYFASLIHLELRVVYCLIXWSVGLPK

SEQ ID NO: 62643 - DNA, 607 bp, Zea mays
  misc_feature: Ceres CLONE 1529080
  misc_feature: Encodes the peptide sequence at SEQ ID NO. 62644
ctccccgcggtggcggccgctctagaactagtggatcccccgggctgcaggaattcgtctcacccctagaaaaaatttagccagaggcttagcaggggtttcaatgatgctgtcaatgggtttccagatgatggttggtcactgatgagcagtgacggtgctgaggatgttactattgctatcaactcttctccaaacaaacttattggtcctcatgtcaactcctcccagctgtttactgcaattggaggaggtatcctgtgtgctaaggcatcaatgctgcttcagaatgtgccacctgccctactagtacggtttctgagggagcatcgctccgaatgggctgatcctggtgttgatgcttattccgctgctgctttgaaggctagtccatatgcagttcctggtttgcgtgctactgggtttacgggcagccaggttattctgccgcttgcacataccttagagcatgaggagttcttagaggttattaggcttgaggaacacagcctctgccatgatgaagttgttctgtcacgagatatgcatcttctgcagtggcatggatgaaaatgcagctggcgcatgtgcacagcttgtctttgca

SEQ ID NO: 62644 - protein, 141 aa, Zea mays
  misc_feature: Ceres CLONE 1529080
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 2 in US patent 7056739
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
MSSDGAEDVTIAINSSPNKLIGPHVNSSQLFTAIGGGILCAKASMLLQNVPPALLVRFLREHRSEWADPGVDAYSAAALKASPYAVPGLRATGFTGSQVILPLAHTLEHEEFLEVIRLEEHSLCHDEVVLSRDMHLLQWHG

SEQ ID NO: 62645 - DNA, 723 bp, Zea mays
  misc_feature: Ceres CLONE 1529082
  misc_feature: Encodes the peptide sequence at SEQ ID NO. 62646
ggtgagaaaggggaggggccacccaacaatagccatccgtgtcttactattttttttaaaagctggagctccccgcggtggcggccgctctagaactagtggatcccccgggctgcaggaattcgtctcacccctagaaaaactcctctctctctctctctctctttttcgctcccgatttccaaatctcaaataataaataaccagaagggaagcgaatcttctccatcaacccagcaaatcgctcgttcgagcgtcccactcgacgagaaattctcacccatcacctccgcgtcgctccccccgttcgccgccaggggcccaatttcgtgtggacaggcacaggctgctgtgatcctttggtggatgggggcagcgcagctagccaccggaggttgcctagtttgaaatttaaccgcgttaccgaagtggtactccgtagttcttatggatcaacttgccctgcttgcgacggatctgggtgactcgtcagactttgaggtggagggcatccagaacctcactgagaacgatgtcagtgacgaggagattgagcccgaggacctggcgcggcgaatgtggaaggacagagtcaggctgaagaggatcaaggaacggcagcacaaagcttgccccggcttgcatgcagaagctgcagaaggtgaagggcccaagccccttattccgaacagggcccatggcacaaggaaaaaagttcaaggg

SEQ ID NO: 62646 - protein, 92 aa, Zea mays
  misc_feature: Ceres CLONE 1529082
MDQLALLATDLGDSSDFEVEGIQNLTENDVSDEEIEPEDLARRMWKDRVRLKRIKERQHKACPGLHAEAAEGEGPKPLIPNRAHGTRKKVQG

SEQ ID NO: 62647 - DNA, 676 bp, Zea mays
  misc_feature: Ceres CLONE 1529096
  misc_feature: Translation starting site: 118
  misc_feature: SWISSPROT Homolog: EC 3.2.1.23 Beta-galactosidase
cccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgtgtgccataaaaaaaaaaaaaaaaacgagacgctcgaggtacccaattcgccctatagtgagtcgaattacgcgcgctcactggccgtcgttttacaacgtcgtgactgggaaaaccctggcgtttcccaacttaatcgccttgcagcacatccccctttcgccagctggcgtaataccgaggaggcccgcaccgatcgc

SEQ ID NO: 62648 - DNA, 698 bp, Zea mays
  misc_feature: Ceres CLONE 1529099
  misc_feature (473)..(473): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (586)..(586): n is a, c, t, g, unknown, or other
  misc_feature (588)..(588): n is a, c, t, g, unknown, or other
  misc_feature (592)..(592): n is a, c, t, g, unknown, or other
  misc_feature (631)..(631): n is a, c, t, g, unknown, or other
  misc_feature (633)..(633): n is a, c, t, g, unknown, or other
  misc_feature (656)..(656): n is a, c, t, g, unknown, or other
  misc_feature (695)..(695): n is a, c, t, g, unknown, or other
gcggtggcggccgctcttttctagtggatcccccgggctgcaggaattcccctcacccctagaaaaataggatttaatttacggatggtttatgttttgttattgtccggttatacacttgtagtgatctggaactgaaaaaatataagggtaaacatagtatgatgaggctgtaccttgtgacaatttttttttgtggggctctatataaattcaattcattgtgatgacaaacaaagaaaaaacggagacgctcgagggaccctatttctctcctaaaggaggggggaattaccccgcgttcccctgggccctttttttttaacagcgtcggtgaactggggaaaacccccttgtttttttcctccaacccccacagcggggggggggagggggggagggaagacttcaccactgtatcctccatccgattagcgagtaatggacacacccccccccccccccccacgagnaacccccccccggacccccccacaacactatccnnntttctgcctgcccataatatagtttaagcctcatcacgtttgttgtagtgaaacgactacgtgttcgctagtccacnantgtngccggcggggttgaatggagaatcagacaaatcgagtgngnagaggccagtctgtatagcaggnttgtctgcgcaggtactcgtgcccaaagcccacggctcntcg

SEQ ID NO: 62649 - DNA, 670 bp, Zea mays
  misc_feature: Ceres CLONE 1529123
  misc_feature: Translation starting site: 374
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (414)..(414): n is a, c, t, g, unknown, or other
  misc_feature (417)..(417): n is a, c, t, g, unknown, or other
  misc_feature (418)..(418): n is a, c, t, g, unknown, or other
  misc_feature (420)..(420): n is a, c, t, g, unknown, or other
cccccgggctgcaggaattcgtctcacccctagaaaaatttcttaggactcctagtgatgtgtgcgtggctgctggtcttcaggacacagagactgctagaagtgaagttcagagttttggcttcatgttgataacgaaatatataagcataatctttacaaaaaaaacatagtttaggccagtcctgccaaatcgtatgagaacgcaaattacagggctcatttgtatgatgatttggttccacacaacgctgtaagtagaaagcaaatactgtttgttccatgctgagattttgtcaagcaaatactcccaggatgaaagtgaataaccgaattgttaggataaatttagtattataaaatatccatatgtatgaaactttatgctatcaagcacattgttacaaatnnngnaanngnaaaaaaaaataaaaaaaaaaatataaaaataaaaataataaaaaaaaaaaaaaaattttaaaaaaaaaaaaaaaccgggccccccggggaccccatttccccctatagggggtcatataacgcccccccccgggccgcctttttaaaacgcctggacgtggaaaaccctggggttccccaatttaaccccctggaaaaaaatcccctttctgccagtgtgggaaaaaccaaaaaggcccccccctatccc

SEQ ID NO: 62650 - DNA, 708 bp, Zea mays
  misc_feature: Ceres CLONE 1529132
  misc_feature: Encodes the peptide sequence at SEQ ID NO. 62651
  misc_feature (631)..(631): n is a, c, t, g, unknown, or other
ccccgcggtggcggccgctctagaactagtggatcccccgggctgcaggaattcatctcacccctagaaaaagacaagccagaatccattttacgaagtaactctgatgaagaagcacatcagtactggcagcaacagctccctgacgacatcacccctgatttcaaagtcctgggacaagacgaaagtcctggacctgacagtctatcactcacaggcctgtcgattaatgatggcattgacacatcaatattttctcctaaccatactctgttcctgcaaaataatgatttaccttttatcagggactattttaatatcccccccaagaataactttggttgggtttttttccccccccccccaggggggggggggggggggattattgtagcccaacctgccaagttccctctagtcccaaaaatgaataccaccctggggggaaaacaaccttggtgggcgggcgcacacttactatctttatgtccaaaaaggtaagatacattgtttctcgtactcccgccgtcccatcttgcgctacttatttccccctgccacatgttttacaccacacatcgtacctctatatcgccatcacctacttattatagatgtttaggacgagttncttacccactccatccttatccatcttttaagataacatgatctaactccaccgtctcttttttattacattctgtg

SEQ ID NO: 62651 - protein, 166 aa, Zea mays
  misc_feature: Ceres CLONE 1529132
PRGGGRSRTSGSPGLQEFISPLEKDKPESILRSNSDEEAHQYWQQQLPDDITPDFKVLGQDESPGPDSLSLTGLSINDGIDTSIFSPNHTLFLQNNDLPFIRDYFNIPPKNNFGWVFFPPPPGGGGGGIIVAQPAKFPLVPKMNTTLGGKQPWWAGAHLLSLCPKR

SEQ ID NO: 62652 - DNA, 640 bp, Zea mays
  misc_feature: Ceres CLONE 1529133
  misc_feature: Encodes the peptide sequence at SEQ ID NO. 62653
  misc_feature (323)..(323): n is a, c, t, g, unknown, or other
ctccccgcggtggcggccgctctagaactagtggatcccccgggctgcaggaattcgtctcacccctagaaaaaaaggccgcaacgcctccgctttcattcttctcttcccctcggcttcgagggttgtttttatttctttctttcctttttccgttttttattttctttttttcttttttcgttacttttctcgttccccccgttggggttttgagctccgacgaaccctaataatcgccggggaccggcggacgatcgcccgccggcatgcaccatcagcagcggatgaagcaggcggcggcggccgcggccgcggcgcancagcagcagctgatgcagcaggcactgctcctgcagcagcagcagcagtcgcaggcgcagccgcccttgttccccgggcaccacccgcaccccggcctcctcgccgcaccacagatagagcccatagtcaggggaaacctgcctcctgggtttgattcaagtacatgccgcaacgtgtatgttggcaatatccatcttcaagtgaaggacacagtactgcaaggaagtcttccaaagcattggtccaataaaaaggtggcagcctcatcaaaaaagaaaatccttccctttggtttcattggactactattaaccgg

SEQ ID NO: 62653 - protein, 123 aa, Zea mays
  misc_feature: Ceres CLONE 1529133
  misc_feature (18)..(18): Xaa is any aa, unknown, or other
MHHQQRMKQAAAAAAAAXQQQLMQQALLLQQQQQSQAQPPLFPGHHPHPGLLAAPQIEPIVRGNLPPGFDSSTCRNVYVGNIHLQVKDTVLQGSLPKHWSNKKVAASSKKKILPFGFIGLLLT

SEQ ID NO: 62654 - DNA, 648 bp, Zea mays
  misc_feature: Ceres CLONE 1529134
  misc_feature: Translation starting site: 232
  misc_feature: SWISSPROT Homolog: EC 1.1.1.195 Cinnamyl-alcohol dehydrogenase
  misc_feature (1)..(1): n is a, c, t, g, unknown, or other
  misc_feature (439)..(439): n is a, c, t, g, unknown, or other
  misc_feature (474)..(474): n is a, c, t, g, unknown, or other
naaagctggagctccccgcggtggcggccgctctagaactagtggatcccccgggctgcaggaattcgtctcacccctagaaaaacccagaaagatcgcactacccggcgctcgcgcggctttctttcccaactccgacgaaggctagctacaccacctggtgcgggctcgtctccatcgcccgccacccgctccgtcgtcgtcgtccccgccgcgccgatcccgaatcgaatggggagcctggcgtccgagaggaaggtggtcgggtgggccgccagggacgccaccggacacctctccccctactcctacaccctcaggaacacaggccctgaagatgtggtggtgaaggtgctctactgcgggatctgccacacggacatccaccaggccaagaaccacctcggggcttcaaagtatcctatggtccctgggcacnaggtggtcggcgaagtggtggaggtcgggcccaangtggccaagtacggcgtcggcgacgtggtaggcgtcggggtgatccgtgggtgctgccccgagtgcaccccctgcaaggccaacgttgacagtactgccacagaagatctggtcatacaacgacgtctacactgatggacggcccacccagggtggattccccttccccatggg

SEQ ID NO: 62655 - DNA, 897 bp, Zea mays
  misc_feature: Ceres CLONE 1529135
  misc_feature: Encodes the peptide sequence at SEQ ID NO. 62656
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
tgctgcgttataacaaannncccccnnnnnggnaaaatcttnnnatacgatattgtgttctttcgtgttagtcggtttttttatttgggaacccccgggctgcaggaattcgtctcacccctagaaaaagagtctgaaaccctagccgcctgtctccctgtccggtctccactcgtccgggcgacgagacgactactgatggtttctgcgggggatttgtttgtcgctgactcgcctgcgaccaagatgaggccggttttcgtggggaacctagactatgatacccgccactcggagctcgaccacctcttctaccgctatgtttgggtcgagcgcatcaacatgaggtcaggttgcccgcccttgctttcgctcaccccgtcgttttgactccttttttttcccccccccacgggggggggtgaggggggttttttttccttttctccctcttgggcccccccccatgtcttgaatatttcattgtatttcgaccggcaaaagaaggtgggggggaaatttctccccccctctctgtgctgttttaaaaatatctagcattccgtgtagtgggagtgccgtcggtggtgttctgtcaatttggtgtgttcttgtataaattctggttcgttccaactataatgacctgagagtttggcttcgttgcccgtctgtggggtaaaccatccttactattttctctcgccttcccaagggtttgtacgcctagggtcacgcaccatatgaggtatgtgtcctttgttttttgccgccgtctctcaccaccgtgcgcttcggtttgctgaatacgttgtaatggaatcgattgtttaagacttggtggggttggggcgcgagtctgtatgtgtgtttctgtactgcgccacgtgcccctct

SEQ ID NO: 62656 - protein, 47 aa, Zea mays
  misc_feature: Ceres CLONE 1529135
MRPVFVGNLDYDTRHSELDHLFYRYVWVERINMRSGCPPLLSLTPSF

SEQ ID NO: 62657 - DNA, 700 bp, Zea mays
  misc_feature: Ceres CLONE 1529141
  misc_feature: SWISSPROT Homolog: EC 3.2.1.23 Beta-galactosidase
gcggtggcggccgctctagaactagtggatcccccgggctgcaggaattcgtctcacccctagaaaaaacttacctggacggggtcgactagggatcaagaagcccagtggcctaggtcagtggcctgtattgcacatggcgggtgcgctggcttaccatcttcccaagtgggagagtggacgtcataatttgtgatagagggggtacgcgttcgcgcggcccctgcttaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaa

SEQ ID NO: 62658 - DNA, 666 bp, Zea mays
  misc_feature: Ceres CLONE 1529142
  misc_feature: Encodes the peptide sequence at SEQ ID NO. 62659
  misc_feature (1)..(1): n is a, c, t, g, unknown, or other
  misc_feature (177)..(177): n is a, c, t, g, unknown, or other
  misc_feature (371)..(371): n is a, c, t, g, unknown, or other
  misc_feature (409)..(409): n is a, c, t, g, unknown, or other
  misc_feature (412)..(412): n is a, c, t, g, unknown, or other
  misc_feature (502)..(502): n is a, c, t, g, unknown, or other
  misc_feature (584)..(584): n is a, c, t, g, unknown, or other
naaaactggagctccccgcggtggcggccgctctagaactagtggatcccccgggctgcaggaattcgtctcacccctagaaaactttccctgctctctccttcaactcttgtttctgcaacgccagggcgcaaccatggatcagcagcagcaagggccggcggccaggcggatggncacgctcgcctcccacctgcgccatccctccgtctctcaccctcagatggaagatgttcccctcttgaggggatccaattgccgtgcaaaaagtgcggcgccaggcttcaaaatcgcgatcttgggtgccacaggtgggatccgggcaccaccttgcgctattgatgaaaaaagaaattttttgcccccccccngggggggggggggggggcctccccccccccccttggtncancccccacatccccccccataaaaaacccgtgccgggggggacggggggcttccttgggcccaccccccatgtggaaaaaagccccgggcnggaaaacaatacccggaaaaaatacctccgcgggagggccccccaaaaaccccggagagaaaaagacacgacttgttttaanaaaaaaaggtggagataaaccccccccccccgctggaaaaacaaaataacaaatcgggccccccaaacgaaaaaaaaaaaaa

SEQ ID NO: 62659 - protein, 98 aa, Zea mays
  misc_feature: Ceres CLONE 1529142
  misc_feature: SWISSPROT Homolog: EC 1.1.1.37 Malate dehydrogenase
  misc_feature (14)..(14): Xaa is any aa, unknown, or other
  misc_feature (79)..(79): Xaa is any aa, unknown, or other
  misc_feature (92)..(92): Xaa is any aa, unknown, or other
MDQQQQGPAARRMXTLASHLRHPSVSHPQMEDVPLLRGSNCRAKSAAPGFKIAILGATGGIRAPPCAIDEKRNFLPPPXGGGGGPPPPPLVXPPHPPP

SEQ ID NO: 62660 - DNA, 684 bp, Zea mays
  misc_feature: Ceres CLONE 1529160
  misc_feature: Encodes the peptide sequence at SEQ ID NO. 62661
aagctggagctccccgcggtggcggccgctctagaactagtggatcccccgggctgcaggaattcgtctcacccctagaaaaacaggatgaaatggctgcgccccagcacgtccgcgccgctcccctcgcacgcgcgctccgcgctaccgccaccgccaccgccaccgcctccgtccccgtacccgttcccgtccccgccggcatcaagtctcaggggacttcccgccgcgcgctgctcggcctatcggagcctcagctccgccagcttgccatcgatctcggccagcaaagctaccggggcaagcagctgcacgacctcctctacaaatcaagagccaagcaaatccaagaattcaaccacgtgccccaggcgttccgggaggcgttgcttgacactggatggagtgttccccggtcgccagtgcaccacgccgtcacagcctcggatggtactaccaagatacttctcaagttggaagaaaacccgttgatcgagaacagggggattcctgcccatgaagacaaacaaaggctcttctagggtcaactgcctgtgctacatcccagaggcgggtgccccccttcctttgctcaattttgagccaccgtggaaaggggacggttctgacaggaacactttctcaccaaagtgccaagattgtcaaaccccggcgttaggacca

SEQ ID NO: 62661 - protein, 149 aa, Zea mays
  misc_feature: Ceres CLONE 1529160
MAAPQHVRAAPLARALRATATATATASVPVPVPVPAGIKSQGTSRRALLGLSEPQLRQLAIDLGQQSYRGKQLHDLLYKSRAKQIQEFNHVPQAFREALLDTGWSVPRSPVHHAVTASDGTTKILLKLEENPLIENRGIPAHEDKQRLF

SEQ ID NO: 62662 - DNA, 811 bp, Zea mays
  misc_feature: Ceres CLONE 1529161
  misc_feature: Encodes the peptide sequence at SEQ ID NO. 62663
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (31)..(31): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (54)..(54): n is a, c, t, g, unknown, or other
  misc_feature (55)..(55): n is a, c, t, g, unknown, or other
ttttttgttttnngcngcgcccacccccatnttataannnnnnnnncctcattnntttaatactggagctccccgcggtggcggccgctctatacctagtggatcccccgggctgcaggaattcgtctcacccctagaaaatttgatggatgctggaatgtgctcaatctgtggtgaagaaagctttggcactgggtctgaccacattcgtgagaaagatggcatctgggctgtgcttgcatggctttctattattgctttcaagaataaggacaaccttggaggagataagcttgtcactgttgaagatattgtccgtcagcattgggccacatatggtcttccattattacacacgctaatgaatatgagaatgtctatgcctggtgctggctaagagagctgatggcaaacccttttatttcctgcacacccttcattgggggggaggggggacaagtttattccaaggaagacccccggtcttgattttttcttgaaattaattttgcagcttaaaccaacttcgcaaatacaaaggatattcccagattacattggccttccgctttccacaaatcacccatctgccattccacatatcacttctttctctaatatgggataatatcctacttggtgcttttcctaatctaattcccgataactgtgtattattcttcgttaagccacctattcccgtgtgtgccatcttacagacgcaaaattttacgtatatatttttttccttttaccccagggcggtacttcccccccgcagtcccccttgcctcccaactggttcgtacgg

SEQ ID NO: 62663 - protein, 83 aa, Zea mays
  misc_feature: Ceres CLONE 1529161
  misc_feature: SWISSPROT Homolog: EC 5.4.2.2 Phosphoglucomutase
MDAGMCSICGEESFGTGSDHIREKDGIWAVLAWLSIIAFKNKDNLGGDKLVTVEDIVRQHWATYGLPLLHTLMNMRMSMPGAG

SEQ ID NO: 62664 - DNA, 657 bp, Zea mays
  misc_feature: Ceres CLONE 1529163
  misc_feature: Encodes the peptide sequence at SEQ ID NO. 62665
  misc_feature (378)..(378): n is a, c, t, g, unknown, or other
  misc_feature (381)..(381): n is a, c, t, g, unknown, or other
  misc_feature (383)..(383): n is a, c, t, g, unknown, or other
  misc_feature (390)..(390): n is a, c, t, g, unknown, or other
  misc_feature (402)..(402): n is a, c, t, g, unknown, or other
ccccgcggtggcggccgctcttttctcctccatcccccgggctgcaggaattcctctcacccctagaaaaactccagactctccaccatcactcgcgcgccggcgccgctcacacgcccatttccaccccacaagacccacacggaatcccggcaccctacctctccaacacgcaccagcatcatggcggtggcttcgacctcgaggctatccgccaagcccgccacggccccctcgccgcccgctccggtgtccgggttcctcgctctccccgcccgccgcggacgcgcaccgcgcctcggctccgccgccgcgtggaggaggcttcgcgtggaggcgatctgtttttcccccacaagcggcggggggaggggtccntcnanaaatccnccccccccaggnaagtcgccgcgcccctggacggagtccgagctgaagaccccatggtttccttcctcggacaagagcctggtggtcacgctcaaccatcggtcaacattttcctcgaggaagcggtgatcacactcctcattaccgcgtaccgccaaccagaactccccccggcttttttggggccgaaaaaaattgcctgggggccctattttccggccctaaccagcgccctcctcccggatcgaagccccctcgcacgcgggc

SEQ ID NO: 62665 - protein, 111 aa, Zea mays
  misc_feature: Ceres CLONE 1529163
  misc_feature (67)..(67): Xaa is any aa, unknown, or other
MAVASTSRLSAKPATAPSPPAPVSGFLALPARRGRAPRLGSAAAWRRLRVEAICFSPTSGGGRGPSXNPPPPGKSPRPWTESELKTPWFPSSDKSLVVTLNHRSTFSSRKR

SEQ ID NO: 62666 - DNA, 692 bp, Zea mays
  misc_feature: Ceres CLONE 1529165
  misc_feature (294)..(294): n is a, c, t, g, unknown, or other
  misc_feature (338)..(338): n is a, c, t, g, unknown, or other
  misc_feature (341)..(341): n is a, c, t, g, unknown, or other
  misc_feature (382)..(382): n is a, c, t, g, unknown, or other
  misc_feature (383)..(383): n is a, c, t, g, unknown, or other
  misc_feature (385)..(385): n is a, c, t, g, unknown, or other
  misc_feature (388)..(388): n is a, c, t, g, unknown, or other
  misc_feature (389)..(389): n is a, c, t, g, unknown, or other
  misc_feature (393)..(393): n is a, c, t, g, unknown, or other
acccgcggtggcggccgctctagaactagtggatcccccgggctgcaggaattcccctcacccctagaaaaaacaggacgcggacgcggacgcggctcacatcaaacacccccttcagctgtgctcagtgctcactgccgcaaaaccacagccacacaggcaacaagcgcccagcgccctttcacatcaccacatccaccgtccacgctcctccgttccatggccatgtcgagcagcccccgcaagaaacaagcccaggcccagaaggccgggcggagggcccccggggtgtcntcggccgctgtcgtttgatgcggaaatgcaaaaggttgttctcnccnatatttttttacccccccccgggggagaaagaaaggggganntngcnncctntttcttttccccttccccccgtccagaaaaacacccacacaagggaccgccaccaagaaggcgtgccattaaaaacaccaaccccgaataccttaccccggaaaggccttccaaggaaccctgaagccaatttcacagccaatatccacacaccaactacccttagatcgcacatccgaaaccaaccaactacaaacccgaaaccctcccctcacaccacaaacaccctacaaaaaaatcccaatatctcagcgccccactccccacccagccccgggccaggctacccaaaccttcac

SEQ ID NO: 62667 - DNA, 705 bp, Zea mays
  misc_feature: Ceres CLONE 1529171
  misc_feature: Encodes the peptide sequence at SEQ ID NO. 62668
  misc_feature (381)..(381): n is a, c, t, g, unknown, or other
  misc_feature (386)..(386): n is a, c, t, g, unknown, or other
  misc_feature (389)..(389): n is a, c, t, g, unknown, or other
  misc_feature (705)..(705): n is a, c, t, g, unknown, or other
ccccgcggtggcggccgctcttccctaccggatcccccgggctgcaggaattcctctcacccctagaaaaatccaccgtccacctcagctcccatatccgctcccctacctctccagcatctcccgtctccgtcgtctcgtctctgctcctcacttcgccgccagccatgggcaagatcaagaacggaatcaacggtttcggaaggatcggcaggctcgtggccagcgtcgccctgcacagcgaggatgtcgagctcgtcgccgtcaacgaccccttcatcaccacggattacatgacctacatgttcaagtacgacaccgcgcaccgtcaatggaagcatagatttcttccccccaaggagtggggggggggggtcttcnaccanaancccgtcccccccccccgcatcaggaacccccaagaaatcccctggggtgagggtggggcctaacaatgtcctggcatccccccggcgtctacaccgacaacgatcaggctcgctccaccaccttgatccgcggggggcctccaacgctcgttatcccccgcccccaagcaaaacattcctctcctggtttaattgtttaccgttctaatgtcagcacacagttccgacctcccgaaaggccagaccctcgcttacccgacggcccctcgtctgcagcatctcaaaactgccatgttcgtaccccccctcgcggtcn

SEQ ID NO: 62668 - protein, 94 aa, Zea mays
  misc_feature: Ceres CLONE 1529171
  misc_feature (4)..(94): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (72)..(72): Xaa is any aa, unknown, or other
  misc_feature (73)..(73): Xaa is any aa, unknown, or other
  misc_feature (74)..(74): Xaa is any aa, unknown, or other
MGKIKNGINGFGRIGRLVASVALHSEDVELVAVNDPFITTDYMTYMFKYDTAHRQWKHRFLPPKEWGGGVFXXXPVPPPRIRNPQEIPWGEGGA

SEQ ID NO: 62669 - DNA, 667 bp, Zea mays
  misc_feature: Ceres CLONE 1529180
  misc_feature: Encodes the peptide sequence at SEQ ID NO. 62670
atagctggagctccccgcggtggcggccgctctagaactagtggatcccccgggctgcaggaattcctctcacccctagaaaaattcacccgcagctcccatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaaattggtctgaccaactatgcagctgcctactgcactggccttctgttggctcgccgtgtgctcaaaatccgtgggttggatcaggaatacgagggccatggttgagcccctggttgaggaattccctggttgaacccgcttgataaaaaggaagccttttcccgtgctcctcttggaaagttgggccttataaagggcctacaaccgggggagccggggtcttttggagccccctccaggggg

SEQ ID NO: 62670 - protein, 124 aa, Zea mays
  misc_feature: Ceres CLONE 1529180
  misc_feature (27)..(123): Pfam Name: Ribosomal_L18p Pfam Description: Ribosomal L18p/L5e family
MGGFVKTHKTNAYFKRFQVKFKRRRAGKTDYRARIRLINQDKNKYNTPKYRFVVRFTNKDITAQIISASIAGDMVLASAYSHELPRYGLEIGLTNYAAAYCTGLLLARRVLKIRGLDQEYEGHG

SEQ ID NO: 62671 - DNA, 714 bp, Zea mays
  misc_feature: Ceres CLONE 1529183
  misc_feature: Encodes the peptide sequence at SEQ ID NO. 62672
  misc_feature (714)..(714): n is a, c, t, g, unknown, or other
catctggagctccccgcggtggcggccgctctagaactagtggatcccccgggctgcaggaattcgtctcacccctagaaaaagagaatggaaccgtacctccagtggttagggatacagctcatggagctcggcggtaccgcaatgtcgctgctgctgctgatcgtgctcaccgcgtcgacattgcatcatgccatggtggttggcggcgtcaggccgcgggtgccggccatcctggtgttcggccactccaacgtggacacgggcaacaacaacgccgtcctcacgctcaccaagtccaacttcaggccatacggcaaggacctcaacggcggcgtacccaccggacgcttttctttccgccccactccgacggagggggggtggttcctgctcgtcttaaaataactggttcccgcccatctcggaacccacctcggcgacgaggacgtctgaacggacgtcatcttcatattctgggataaccgattatttaaccaatttatttccaatcttcttgtaaattctagcttatgcccgatatatttcacctctgttctccagtattcatcaaagtaaaggtgtctacaaggctttccttccctataaactaagtaccccctcccctcaatgaaataattcgaccccaaaaaaaccctgctttcaacattaacttcgtcacctatgcatcacctctataatatctactacatn

SEQ ID NO: 62672 - protein, 106 aa, Zea mays
  misc_feature: Ceres CLONE 1529183
MEPYLQWLGIQLMELGGTAMSLLLLIVLTASTLHHAMVVGGVRPRVPAILVFGHSNVDTGNNNAVLTLTKSNFRPYGKDLNGGVPTGRFSFRPTPTEGGWFLLVLK

SEQ ID NO: 62673 - DNA, 698 bp, Zea mays
  misc_feature: Ceres CLONE 1529184
  misc_feature: Encodes the peptide sequence at SEQ ID NO. 62674
  misc_feature (379)..(379): n is a, c, t, g, unknown, or other
  misc_feature (698)..(698): n is a, c, t, g, unknown, or other
ccccgcggtggcggccgctctatcaactagtggatcccccgggctgcaggaattcctctcacccctagaaaaatccccaacacgccgacgccttccgcgattctgccgtttactcctccacttgggcctcctcacttgtaagccatggctaaggagaaggctcacatcaacattgtggttattgcgcccgtcgactctggcataaccacaacgaccggccacctgatctactaacttggtacggatgcccaacgtgtgatccaccggcttgaaaccgacgccggtgaaatcaactaccggccccttaattctccaggaggcctcgccccgctcaaagagtattttttttttcccccccccccggggaaagaaagggggnaactctccacccaccaaaaaacacccgaacctgtctagacaactcacaaaccaccttgacctttctctaagaaactactaacccgagctgcatacctgacgtagtccacgctgtttcattcccttaaggagccggcaacttccacggtaatcaaagcggccctcaacacccacagactcgcactctcacttatggcaaaggaccctcagtacaagggccgcgctcctccaccagaaacaacaatcacgctctgtctacctccgtacacaagagtaacggcgtttttcccttagggtaacattttcagggcacgattgtn

SEQ ID NO: 62674 - protein, 29 aa, Zea mays
  misc_feature: Ceres CLONE 1529184
MAKEKAHINIVVIAPVDSGITTTTGHLIY

SEQ ID NO: 62675 - DNA, 735 bp, Zea mays
  misc_feature: Ceres CLONE 1529193
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
tttttttttttnnnnnttttttttttttctgtgtctcccannnnngcttcttnnncaaaactggcgctccaccgcggtggcggccgctctataactagtggatcccccgggctgcaggaattcgtctcacccctagaaaaaagagccactgccaccactgctgcccacggccacccacaccacaccacaccaatacaccataccagaaggagcaaaaataagacgagatggcggacgagcgcttgcctcaaacggccggcgcccgcacggctctcgccagagctactggatccacggcacggaaacgcgcccgcgatagttaggtgcgcctgtgggcccggccggctcgtcacttacataggcgcacgcacccccgcctggtgcgtcgtcgatcgctgctttgctggcgcgcggcggccctgtgtggcacaggagaggtctgctgacgacgaccaccggaggcgtgctgcgtgaatggtcctcatggccggaatgctccccggcgtgaagtgcgcacggcagcaacggttccagcacgggtggccggagatggcagccgaagctgccggatgaagcccggggccggctcgcctacctcctgccggtatcacgtccggcccctgataccctccggaaaatctggacaaacataaaagattagttttgtttaaatcggtcacctttctgggaacccttgaaacacaccattgctccccgcgaagctccaacactact

SEQ ID NO: 62676 - DNA, 636 bp, Zea mays
  misc_feature: Ceres CLONE 1529200
  misc_feature: Encodes the peptide sequence at SEQ ID NO. 62677
ctccccgcggtggcggccgctctagaactagtggatcccccgggctgcaggaattcgtctcacccctagaaaaaactcctgactcctgcactttcactctatcatcacttaccaggctactagcataacaagtcgccaatccctcctcgagagagtcagaaatggcatcacctcataactgctttcgcggctggcagagcacgagccacgtcgcacttgcactggtgtccgtgctgatcctgagctcggcacgtctctccgcgggcggcaagaacctgctggagctgtacaagccgcaggccagcgcgctcctgacgtaccacaacggcgccgttctgcagggccacatcccggtgtccatcatctggtacggccgcttcacgccggcgcagaaagccgtggtcaccgacttcctccagtccctcaccaccgccgacgcctcgccgccggcaccgtccccgtccgtgtcgcagtggtgaagcaccatcgaccaactgtacctctccaaggcgcggggcaacagcagcagcggcagcgcgcggatggcgctcgtcggccaggccaccgacgaagggtgctcgctggggaagcgcctgacgctggcccagctcccgcagctggcggcgcgggccgggc

SEQ ID NO: 62677 - protein, 105 aa, Zea mays
  misc_feature: Ceres CLONE 1529200
MASPHNCFRGWQSTSHVALALVSVLILSSARLSAGGKNLLELYKPQASALLTYHNGAVLQGHIPVSIIWYGRFTPAQKAVVTDFLQSLTTADASPPAPSPSVSQW

SEQ ID NO: 62678 - DNA, 734 bp, Zea mays
  misc_feature: Ceres CLONE 1529204
  misc_feature: Encodes the peptide sequence at SEQ ID NO. 62679
  misc_feature (1)..(1): n is a, c, t, g, unknown, or other
  misc_feature (36)..(36): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ntgttcctttcctttcccccccctttttcttcctcnaaacacaacttnnntaaaactggaactccaccgcggtggcggccgctctataactagtggatcccccgggctgcaggaattcgtctcaccccctagaaaaaatgtatacgtgtgtgtatgcatgtgcttgtgtatgatcgtggtacgaggaccgaaaaaatgtatgcaactctgatttacttaaataattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctggtacattaccggcatccaaggcctgaatcagtactggagcaacatcaggtgccccagcaacaacgggcagagcagctggaagaacgcctgggaagaaagccggcgcctgctccggcctcagcgagaaagactacttcgagactgcccctctccttccgtagccggatcaaccccattcgttcgccctcaaagccaaaaggtaatctagcccggacttt

SEQ ID NO: 62679 - protein, 193 aa, Zea mays
  misc_feature: Ceres CLONE 1529204
  misc_feature: SWISSPROT Homolog: EC 3.1.27.1 Ribonuclease T(2)
MHVLVYDRGTRTEKMYATLIYLNNSPSTFHMASCRMALLLGLLLLVVASPAIADDDSGIYYQLALMWPGAYCEQTSAGCCKPTTGVSPARDFYITGFTVLNATTDAAVTGCSNKVPYDPNLVHYRHPRPESVLEQHQVPQQQRAEQLEERLGRKPAPAPASARKTTSRLPLSFRSRINPIRSPSKPKGNLART

SEQ ID NO: 62680 - DNA, 507 bp, Zea mays
  misc_feature: Ceres CLONE 1529205
  misc_feature: Encodes the peptide sequence at SEQ ID NO. 62681
  misc_feature (427)..(427): n is a, c, t, g, unknown, or other
  misc_feature (429)..(429): n is a, c, t, g, unknown, or other
tttaatagctggagctccccgcggtggcggccgctctagaactagtggatcccccgggctgcaggaattcgtctcacccctagaaaaaaccccatccccagtaccgccgcctctttatccacctccggcctccgccgtctctcctcccaccatcgcactccaccgccgctccgctcagcgaccaccggtgaagacgagtggaacgacgcgtgggagaccgcatggcttccaggcgactcccccgcctcctccccagcgcccgcctgcgccatgggggagtctccccgccctcggctttcggagtccgccatcccggtcatctccgccgaagtggatccagacactaaagccttcgtggcaaacatggacaaacgccggggccaaaggcccccattccccggtccaaggggggggccccagaaaacantnggggggggggtttcccccccggggggaaaaaggccgggggaaataggggggggcccctcccctcggggggcgaaaaat

SEQ ID NO: 62681 - protein, 79 aa, Zea mays
  misc_feature: Ceres CLONE 1529205
  misc_feature (53)..(53): Xaa is any aa, unknown, or other
MGESPRPRLSESAIPVISAEVDPDTKAFVANMDKRRGQRPPFPGPRGGPQKTXGGGVSPPGGKRPGEIGGGPSPRGAKN

SEQ ID NO: 62682 - DNA, 682 bp, Zea mays
  misc_feature: Ceres CLONE 1529208
  misc_feature: Encodes the peptide sequence at SEQ ID NO. 62683
aagctggagctccccgcggtggcggccgctctatactagtggatcccccgggctgcaggaattcgtctcacccctagaaaaaatccgaaagcccaagacactgagctggtctgtttagttggaaagccatctgtacgtttttcgccgatcatggaggatgagaggaacacccagcagcaccagggcggtgagcaggcccaggaccaggagaacgaggtgaaggacaggggactcctggacagcctactcggcaggaacaagcacgacgaccaggagaagaagaaccagcaggcggaggaggagctggcgaccggcatggagaaggtcacggtggccgagcccgaccacaaggaggagggacacgaggccgccgagaagaaggacagccttctcgccaagctgcaccgcaccacctccagttccagctcgtcgagcgacgacgaggaagaggaggtgatcgatgagaacggcgagattgtcaagaggaagaagaagaagggccttaaggagaaggtcaaggagaagctggcggcccccaaggcccacgatgaaggcgaccacccccagaacgcccgcgccgcccggtgggtgggggacacgcatggctcacccaccgggagggtagaacccttttcccgggcgaccgggcgccctccccccgttacgtgtgatgacgcctccc

SEQ ID NO: 62683 - protein, 177 aa, Zea mays
  misc_feature: Ceres CLONE 1529208
  misc_feature (35)..(158): Pfam Name: Dehydrin Pfam Description: Dehydrin
MEDERNTQQHQGGEQAQDQENEVKDRGLLDSLLGRNKHDDQEKKNQQAEEELATGMEKVTVAEPDHKEEGHEAAEKKDSLLAKLHRTTSSSSSSSDDEEEEVIDENGEIVKRKKKKGLKEKVKEKLAAPKAHDEGDHPQNARAARWVGDTHGSPTGRVEPFSRATGRPPPVTCDDAS

SEQ ID NO: 62684 - DNA, 755 bp, Zea mays
  misc_feature: Ceres CLONE 1529210
  misc_feature: Encodes the peptide sequence at SEQ ID NO. 62685
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
tttttgttgtggcggaggnnnnnnnnnnnncnnnnnntnnttttttcataactggaactccccgcggtggcggccgctctagaactagtggatcccccgggctgcaggaattcgtctcacccctataaaaagcgcatacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacaattgtggttgctggcacgatgtactatctcactattgaagtaaaggatggcgaagtcaaaaagctctacgaagctaaggtctggtagaagccatgggagaacctcaaggggctgcaggaattcaagcctgttgaaataggcgctaacgcctaaggatgtctcctttctccatgtgcgatcctgatgctcaaaacaaacttgctatattaaggagcccatgcctcccttgtggaaatttcataagaactacatcccctattaggggcttggtttggattgtgtcctgtaatccaaaggaaaccgcaaccgcgattaaaattttcccattcaatacactaaaaaaagggaatattaaatcctccactcccaataac

SEQ ID NO: 62685 - protein, 81 aa, Zea mays
  misc_feature: Ceres CLONE 1529210
  misc_feature (10)..(82): Pfam Name: Cystatin Pfam Description: Cystatin domain
MANNTGTLVGGIQDVPGSENDLHLQELARFAVDEHNKKANALLGFEKLVKAKTIVVAGTMYYLTIEVKDGEVKKLYEAKVW

SEQ ID NO: 62686 - DNA, 626 bp, Zea mays
  misc_feature: Ceres CLONE 1529212
  misc_feature: Encodes the peptide sequence at SEQ ID NO. 62687
ggatcccccgggctgcaggaattcgtctcacccctagaaaaaaccgtcgcctcccgcacacggcaaactcaccttattcctactcttcatccccctgccgctaggatctccctcccctcggtcgtagccatggagaccacttcccctgcctcttcacctgggtgcatatccctcccaactgctgcaggtaggactaactagtagatagccatatacataggttgagtggatcgatcatagacggtagccatatacgttcgagtactggatagtatacaataacggtagatacagggcaggagacatgatgctggaaaagagatctgggggcccgtccccggcgtctcggcagcacatgcggcggaccacgaccatgactgagttcgcggcaccgcacctgctggtacacgtcgcggacgaggaggaggacgaggagctgcaccttctgccggcacacgcctaggccgcaggggaggcggccgagcatgaggacccctactggagggccataggcggcgcctcggcggccgggcgcgcggactgtctggcggctcaccgcgcccgcgcggctgctggactggcgggtctaagccggaactcggccgacttctcggctgcctagaccc

SEQ ID NO: 62687 - protein, 52 aa, Zea mays
  misc_feature: Ceres CLONE 1529212
MMLEKRSGGPSPASRQHMRRTTTMTEFAAPHLLVHVADEEEDEELHLLPAHA

SEQ ID NO: 62688 - DNA, 787 bp, Zea mays
  misc_feature: Ceres CLONE 1529213
  misc_feature: Encodes the peptide sequence at SEQ ID NO. 62689
  misc_feature (21)..(21): n is a, c, t, g, unknown, or other
  misc_feature (23)..(23): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
tgggggggcccctcctccttntnatgtgttgcgttggggggttggcccccccnnntaatcactgggtctccccgcgactgtcggccgctctctttctagtggatcccccgggctgcacgaattcgtctcacccctataaaaaagcgactgccgactgctgttccatggcggacggcgacggcgcggcggcgacggggaagctcgcggagctccccagcggcgtcaagaaggggctccccaggaggggcaaggcttcttctgggaggacattaaacaccgcacagattccgcttgttgcgagccatccagatgtgtatgagccatgtgatgattcatttgcccttgttgatgcactactctcagacaaggcacaactcttgacacctacttctaaggttatgtatggaggtagggtctggtagtggttatgtttatctacacacttgcaatcatgctcaggcagtctaggctcctcgagccccagtacctaccaacttgacttcagcccacatgctgcccgagacaactcaagcgatccttgaagctcaatgggggtgcatgcacatgtgacctgtcacctgacatctttgcctgggtcttcggcaaaccgcctctgctgcatactgcttccaacgcccacacttcgtcaaccccctcccctaatgttgccaccaccccccggtgggaaacaaaatctagtaatgtcaataaggctatttgcctctccgttcctttgcggtccagtgactcatgttttgatacttggagtctccgctaccattatgaa

SEQ ID NO: 62689 - protein, 85 aa, Zea mays
  misc_feature: Ceres CLONE 1529213
MADGDGAAATGKLAELPSGVKKGLPRRGKASSGRTLNTAQIPLVASHPDVYEPCDDSFALVDALLSDKAQLLTPTSKVMYGGRVW

SEQ ID NO: 62690 - DNA, 710 bp, Zea mays
  misc_feature: Ceres CLONE 1529214
  misc_feature: Encodes the peptide sequence at SEQ ID NO. 62691
aagctggagctccccgcggtggcggccgctcttcaactagtggatcccccgggctgcaggtattcgtctcacccctagaaaaagactcagtggcacgggagcggacgctgccactcgcgatatttgcgagagagagagagagagagagggcccgagagccgaggacgagtgcagtctggctggcgtgatgctgcttcggagcgcgtcctcgccgctgctcaactgcgggcgcgcgccggctgccgcggcgtcggtcgagcacctcgcggtggtttcgccgttgttatcaccggcagtggcggcgcctaggaaggggccggtgctgtgccgcgccatgtccgagggggacctcgccgcgccgctcgtgccctagatggacgatggacacggtagggcgccgaggctgtcggcgtccttgtcctcgtccgcctccatcttcgtcgaggaggaggacggccaagggcgaggaggacgatgacgacctggtctcggtcgccggtgcccgctctgtacctgcctgctgccccttgcttctgcttgctgccgatcacctgtgctggcacttggtccccccgccctcctccctttgggttttccacgtcacaatgggtcttattaaggggcacatccccggggtgcttgctaacggccctgccccccctaccacccaccccgccactcggccggtggctccttctcctctcctccgc

SEQ ID NO: 62691 - protein, 61 aa, Zea mays
  misc_feature: Ceres CLONE 1529214
MLLRSASSPLLNCGRAPAAAASVEHLAVVSPLLSPAVAAPRKGPVLCRAMSEGDLAAPLVP

SEQ ID NO: 62692 - DNA, 774 bp, Zea mays
  misc_feature: Ceres CLONE 1529216
  misc_feature: Translation starting site: 215
  misc_feature: Pfam Name: Pro_CA Pfam Description: Carbonic anhydrase
  misc_feature: SWISSPROT Homolog: EC 4.2.1.1 Carbonate dehydratase
  misc_feature (22)..(22): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
tttttttttttctcttttcttnctctctcccccccccnnngannnnttntnntcaatgctgggactccaccgcggtggcggccgctctagaactagtggatcccccgggctgcaggaattcgtctcacccctagaaaaagtccaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtccccagcctacgacaagaccaagtacaccggcatcgggtccgccatcgagtacgccgtgtgcgctcttcaagtggaggtcctcgtggtcattggccacagctgctgcggtggcatcaaggcgctcctctccctccaggaaggtgcacctgacaacttccacttctttgagaactgggttaaaatccggcttcccctgccacagattaacggggaaaaaaagacccccgccatcgggtgcccggtttcgattgaaccaacggcctcctatttctaacaataaaaggtaagccccctctaaaaccttggttccccctggtgaaaaaacccttcaaagaacccttatcccg

SEQ ID NO: 62693 - DNA, 768 bp, Zea mays
  misc_feature: Ceres CLONE 1529219
  misc_feature: Encodes the peptide sequence at SEQ ID NO. 62694
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
gtttttcccccccccaccnnnagataaaaaaattttnntgggaannnnnnaaaaactggagctccccgcggtggcggccgctctagaactagtggatcccccgggctgcaggaattcgtctcacccctagaaaaagccactctccacttgctactactacacacaaacacagctagccggcgctgccaggttggctttggcgagcaacgacgacgacggcggcgctcaggactcaggtgctttcggttcaggcggaggagggcatggagcgcggcgactgccagttcacggtggtgccgccgcggcagtacgacgaggcccagttcatgcaccagctgatggcggccggcgaccagcaggaccccgcgggcgcgggccggggagctgccggcggcggcggggagaggaagcggcggcccccggaggagcgggggggggcgctggacaccacgttccacgcgcggccccccaatcttgatccccaggataaagcgggagctggcgcggggagcttggcctggaaaccccgcccaggagggccaccctggttccagcaaataaccgcggccccggtgggtccctcccatgcacccgggaaacatgaaataaccccccgactcccgggccccagttccaacaaccaaagaaccccccgcctatcaagctcactcccacgcaaggtaataagatcaatcgcttcgcctgcactagggacttacagaatcttcccacagacaagaatatacataacctcgacatataatcctg

SEQ ID NO: 62694 - protein, 168 aa, Zea mays
  misc_feature: Ceres CLONE 1529219
MERGDCQFTVVPPRQYDEAQFMHQLMAAGDQQDPAGAGRGAAGGGGERKRRPPEERGGALDTTFHARPPNLDPQDKAGAGAGSLAWKPRPGGPPWFQQITAAPVGPSHAPGKHEITPRLPGPSSNNQRTPRLSSSLPRKVIRSIASPALGTYRIFPQTRIYITSTYNP

SEQ ID NO: 62695 - DNA, 839 bp, Zea mays
  misc_feature: Ceres CLONE 1529221
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (832)..(832): n is a, c, t, g, unknown, or other
ttttttcccccccccccccannaaananaaaannnaaaaacgaannnnnaagaccatggaactccccgcggtggcgggcgctctattcctcctgcatcccccgggctgcaggaattcctctcacccctagaaaaaatcgaaaacccaccgcaccctttcatcagcctgcctgtccactgttggcttggtgacttcctccgctccgctccgctcccctccgctccggagaggtcgatctttgcatggaagcaataactggctccaaggggcgggcgatcgctggaagcttcgtcagccgcgtcctcgccggcaaggccgcctccccgaggagggccttgccccccctcggcggacgaaaaaaacctggtaggaacatgtgtctcccggcgttcgggcccaaagaatgtaattattttttttcccccccccccccggggggggagaggggggcccaaattcctataaaaattccctcctccccccctcctttgtttttgcgtgatcccccccccaccccaacctcggcggaggggggtcacgaatgttctgtcaacccaccgactctacctcacaccactcccaagccctttcagccctctattttttttcatctttttagtcccccctcccacgccctcttctacccctccctccttctctccctcacttccatgatatcccgacaatatcataatacaaatgccgctccacaaaccccctcatgggtagcgcgactcccataccgccctgtccttcgagacacgcttcacccgcaccccacaccacactccgacccccccgcaccccgaccaccccgccatcttcccccccnctcagcg

SEQ ID NO: 62696 - DNA, 728 bp, Zea mays
  misc_feature: Ceres CLONE 1529229
  misc_feature: Encodes the peptide sequence at SEQ ID NO. 62697
catagctggagctccccgcggtggcggccgctctagaactagtggatcccccgggctgcaggaattcgtctcacccctagaaaaaagtcgcccacaaaaacccagtaactcgcatcttcctccgtgatccaagttctagcagcgcagcgctcggtttcggcaatgtcggggcgcggcaagggcggcaagggtctgggcaagggcggcgccaagcgccaccgcaaggtcctgcgcgacaacatccagggcatcaccaagccggcgatccggaggctggctaggaggggcggcgtcaagcgcatctccgggctcatctacgaggagacccgcggtgtgctcaagatctttctggagaacgtcatccgtgacgccgtcacctacaccgagcacgcccgccgcaagaccgtcaccgccatggatgtcgtctacgcgctcaagcgacagggccgcaccctctacggcttcggcggctaggtcgcttcctcatctggtggcgaactgcatctgtgtcggcggtggtcgtgttgtgtgcctaatctagtgtagtccgttctctatatcgtcgctgtgttctgtggtgtcttgtatcccatttcctgcaataccaacttgccattatcaatggaaaaccctcgttttcaaaaaaaaaaaaaaaaacgagacgctcgaggtacccaattcgccctatagtgagtcgtattacgcgcgctcactggccgtcgttttac

SEQ ID NO: 62697 - protein, 103 aa, Zea mays; identical to SEQ ID NO: 6459
  misc_feature: Ceres CLONE 1529229
  misc_feature (25)..(94): Pfam Name: Histone Pfam Description: Core histone H2A/H2B/H3/H4

SEQ ID NO: 62698 - DNA, 742 bp, Zea mays
  misc_feature: Ceres CLONE 1529234
  misc_feature (401)..(401): n is a, c, t, g, unknown, or other
  misc_feature (403)..(403): n is a, c, t, g, unknown, or other
aaagctggagctccccgcggtggcggccgctctagaactagtggatcccccgggctgcaggaattcgtctcacccctagaaaaattgcctccactggatcccagctgtcagcagcacgctgaaaccctccatttgtgaaacttcaggtgcgcgtagtttaggaggttagattttacttaatcggcatttgcattggataatatgcctaacatggtggctttagatcgcttgttttctagcggcgatggacggtggtggtcggcctttgaacttcgcagccacgtattcagattttttttgagttattgtaatttatttacattccctctagatatgtgattatcaagacgtatgtcagaagacatgaatattccttgtttggattggcgtgtttgatccananaaaaaaaaaaaaaaaaaaaataaaaaaaaaaaaaaaaacaagacgctcgaaggaacccaattcgccctaataataagtcgtattacgcgcgctcactggccgtcgttttacaacatcttgactgggaaaaccctggcgttacccaacttaatcgccttgcgaaaatccccctttcgccagctggcggactcccaaatcacccccaaagggatgcctttcccaccctttcgcgccctgttgtcaaatggaaattgggaaaaacactggtttgtcaacattaaagtccaattgtaggaaaaccacctcatttttttggccaataagccgaaaacgcccccc

SEQ ID NO: 62699 - DNA, 751 bp, Zea mays
  misc_feature: Ceres CLONE 1529235
  misc_feature: Pfam Name: AIRS Pfam Description: AIR synthase related protein, N-terminal domain
  misc_feature: SWISSPROT Homolog: EC 6.3.3.1 Phosphoribosylformylglycinamidine cyclo-ligase
cagagctggagctccccgcggtggcggccgctctagaactagtggatcccccgggctgcaggaattcgtctcacccctagaaaaaaggggattagggatgggtgcgaacaatcagatagtgctctcctaggaggggagacagcagaaatgcctggtttctatgcagaggggcgaagtggaagatggtgaagagcaggcttgaaaacagtaccgatgacaagctgctgctgttgtgctctgttagtgttgtttaatttagtttaataccgtgtgcatgagatatggcacgcgttcatcaccatggcaatgtctgcaaatccatggattgatggatggatgttggttgtttcttaacattctggacatgttcatttgtttctttggttatgtatgttttagcagtccagccccccccatacaaaatatggcgtgctttgtcgaaaaaaaaaaaaaaaaacgagacgctcgaggtacccaatttcgccctatagtgagtcgtattacgccgcgctcactggccgtcctttttcaaccgtcgtgactgggaaaaccctgggggttacccaacttaaatcgccttgcaacacattccccctttccccagctggcgtaataagcgaaaaggcctccaccaatcgccccttcccaccgtttccccaacctgaaattgcaaaggaaaattgtaagcctcaattttttggtaaaattcccgtctaaatttttgttaaacccgccccattttttttacccc

SEQ ID NO: 62700 - DNA, 1171 bp, Zea mays
  misc_feature: Ceres CLONE 1529240
  misc_feature: Encodes the peptide sequence at SEQ ID NO. 62701
acagactccaaaccgaccgagcagcgatggtgtcggacttggagctggtggagcggctgcaggaggtgctgcggtcgtcggacctcaacaccacgaccaccgctgccttgcgccgccgcctcgaggaggacttcggcgcagacctctcccacaagaaggctttcatccgggagcaggttgacctcttcctcgccgaggtcgccgccaaggccgagccagaggagcccaaggaggaggaggagctcgaggacgcgccggtgcctaaagcggaggaggcggaggagggcgagggggtggaggaggagggcgagggggaggaggggggagaggaggaagaggaggaggaagaggaggaggtggatagcagcagcgcccggaagaagcagcggggtaatgatggcaagaaaaggggtggtggctttacaaaactatgcagtctttccccggcacttcaagagtttgtcggcgcctctgagttagccaggacagaggttgtcaagaagctttgggcatatattcgagaaaataatctgcaagaccaaaacaataggaggaagattttgcctgatgagagattgaagaagatcttcaatgtcaattccattgatatgttccaaatgaataaagctttgaccaagcatatctggccattgaattctgagggtcctgtctctcctgacagatcaacacccaaagagaagccacaaaagaaagacaggaatgaaggaaagaagcaaaagggtggctcttcaggagctggatctggtcttcttgtgccccttcaactttcggatgatttaatgaaatttatcggcactggtgagagcatgttatcacgatcggatgttgtgaagagaatgtgggactacataaaagagaacaacctgcaggatccttctgaccggaggaaaataatctgcgatgagaaactgaaggacctattaggagttgaaacgttcaccggctttactgtttcaaagctgcttgccccccattttaccaagacgaagtagcaacccgccatccagatcttctaaacccccaaaaggctgggtgatcatgttttgcagaatgtgtaatcatggaacagttaggagctatgtgagtggtgtgaaatttttttacatgtgggagtcggtggcactttccgaatgttaccagtaaagtaggt

SEQ ID NO: 62701 - protein, 328 aa, Zea mays
  misc_feature: Ceres CLONE 1529240
  misc_feature (132)..(207): Pfam Name: SWIB Pfam Description: SWIB/MDM2 domain
  misc_feature (248)..(325): Pfam Name: SWIB Pfam Description: SWIB/MDM2 domain
  misc_feature (3)..(56): Pfam Name: DEK_C Pfam Description: DEK C terminal domain
MVSDLELVERLQEVLRSSDLNTTTTAALRRRLEEDFGADLSHKKAFIREQVDLFLAEVAAKAEPEEPKEEEELEDAPVPKAEEAEEGEGVEEEGEGEEGGEEEEEEEEEEVDSSSARKKQRGNDGKKRGGGFTKLCSLSPALQEFVGASELARTEVVKKLWAYIRENNLQDQNNRRKILPDERLKKIFNVNSIDMFQMNKALTKHIWPLNSEGPVSPDRSTPKEKPQKKDRNEGKKQKGGSSGAGSGLLVPLQLSDDLMKFIGTGESMLSRSDVVKRMWDYIKENNLQDPSDRRKIICDEKLKDLLGVETFTGFTVSKLLAPHFTKTK

SEQ ID NO: 62702 - DNA, 655 bp, Zea mays
  misc_feature: Ceres CLONE 1529244
  misc_feature: Encodes the peptide sequence at SEQ ID NO. 62703
tggagctccccgcggtggcggccgctctagaactagtggatcccccgggctgcaggaattcgtctcacccctagaaaaagtctcgcctcgcgtcgtctgcgctcgcggctcgtcacaggtgaggtctcggcgggagaggggcggcggccggtccgtgtccgtgtccgtcgacggttggttcgggaatggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaagatctggaatcgacatccgaagcaaatcaaggacgatttcgaaacccgtggaggatccctcggaactaccaaaatggaactacgatggatctagcacaggacaagccccgggagaagacagtgaattctttctattcccccaggctatcttcaaggaccctttccgaggtggcaacaacgtttttggttatctgggaacccttcacgccccaggggggaaccccttccaacttag

SEQ ID NO: 62703 - protein, 156 aa, Zea mays
  misc_feature: Ceres CLONE 1529244
  misc_feature (68)..(142): Pfam Name: Gln-synt_N Pfam Description: Glutamine synthetase, beta-Grasp domain
  misc_feature: SWISSPROT Homolog: EC 6.3.1.2 Glutamate--ammonia ligase
MAQAVVPAMQCRVGVKAAAGRVWSAGRTRTGRGGASPGFKVMAVSTGSTGVVPRLEQLLNMDTTPYTDKVIAEYIWVGRSGIDIRSKSRTISKPVEDPSELPKWNYDGSSTGQAPGEDSEFFLFPQAIFKDPFRGGNNVFGYLGTLHAPGGNPFQL

SEQ ID NO: 62704 - DNA, 894 bp, Zea mays
  misc_feature: Ceres CLONE 1529245
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ttgttgcctccccccgcgcctcccccgtgtggtgtgnnnaacgcccnnnntttccgggctgggactccccgcggtggcggccgctctagaactagtggatcccccgggctgcaggaattcgtctcacccctagaaaaaatccccctgcaccagacgccaatcccgatcaccgccgcccaacctcacctcccctccgtcccccgagccacctcacaaaccctgttcggtgcctctcactccggtctgccagatggacagcgccgacgcggcgacagccctgggcccgtgcatccggggtctacttcacgccccgccacgttcttcctcggttccgagcttgtgttgcggaaccagcgagcctcccacacccgcgccctccccattctccgtcccccgccatgttgaaacatcttagtcatttttttatagtctagtgctcgtgaggggaggggggggggaccggggataccgcctccaacaacccgtacgatagtccccccccccctggctgtgatcggggccagccctaatctagcgatgcgtctactactcattatccgtcacaacccgcgcagttatcctttccgtttgtcttttgtcgcctcctccgcggtaattacgtgctctcctgcgcgccactatgtcttccctcttacacccccccccgctcggctcccgcccgcagccccttccggcacgccgctacgcagagtttccgaacgcgccggggggcacctaaaccgcgctcccctcgaacggtgaagggtggagttagccacaaaaaaaagatagttaaaaaaagaggcgaacacgccccctgcggaccactgccgcataagtttctacgtttcgatgtgatgatgctcccccttacacgtctcggcgccgaaactg

SEQ ID NO: 62705 - DNA, 890 bp, Zea mays
  misc_feature: Ceres CLONE 1529248
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (19)..(19): n is a, c, t, g, unknown, or other
  misc_feature (20)..(20): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
ggtggtggggggnnngggnnggtctaccccttccttttnnnnngggggaaannnaannnnttggtgctccccgcggtggcggccgctctagaactagtggatcccccgggctgcaggaattcgtctcacccctagaaaaaaaacatagtgcagcaagcaactgcaaagcagcaagctctactcttcttctgtactgaacgtgtgactagataacaataagcgtgaaccatggcggacgagtacggccgcagcggctacggcaggtccggcgccggccacgactaccacagccggtaccacagcttgtccgggtttggatgactacagccgtgggcgaaggtggttacaacaagtcggcgcgcgaaatgaccacctccggcccgccgcgggcgagcaatggggaacccatcagggacacgggccggtttatttacccccccgccccccaggggggggggggggggggggcgcctcctcctccctgtccgcggaaaacccagaacatcgcaccccgctaatcaccacccgctaccgtatccccactcgggctcatcgatttttctgtccccaggataccacgcctgagtagcccaccacgccacgaagggagggacagatgaggccgaacgcgcacgcaagccaacaccgcgattccgcggcggaggttcacgcgcggcttgaaaactataacgcaaagatgcgatgaccccgaccccccccccaccctccctccccgccccgcactcgtccgcaccactcactcaaacactaccattaattccacaaaccaccacccggcccgccacacaagctcactcaatacgtacaccaccgaaacataaacacacaccacatatccttctacaacaactgaacgcatacaccacacg

SEQ ID NO: 62706 - DNA, 859 bp, Zea mays
  misc_feature: Ceres CLONE 1529251
  misc_feature (12)..(12): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (46)..(46): n is a, c, t, g, unknown, or other
  misc_feature (47)..(47): n is a, c, t, g, unknown, or other
ttgggcccccgnggggcnnnccctcnnccccatnnntgggggtttnnaaaaaaaccgggctaccccccgtggcggccgctctatactagtggatcccccgggctggaggaattcccctcaccccttgaaaaatccaagatctctccctcccacggcccgctcggactccccggcgcaatggcgacccgacgcgatcctggagactattccgccgcgggggagcagaggaccagctcccggtgaccccggccgcgccccgcccccggctccccgctgcccccggcccatgtcacccccccccaggggacgagaagaatctacttgaattttcatcattgtgcccgacgcggggagcacccaccccccccctctccccttctttccactgcccaggttggcgccgcgccgactatctctttttttcccccccccccatagagggggcagacgggggggcgtatattccttcttattcttctttctttaccccccacctcccccaagtagtagattatcccgccccgctctttctcccggtgcggcgtcgtctacaataatttgcatccatctttcctccccctcccccacctctctcctttttcttattgttcccccactgctcctcgctctccccttccccgccccgtggccgcagtgtcgcttgcttccttgccttcctctcattagatgtcgccgcgctctccgcccccccggctgcacccgggcccccagtcttcctcccatacgcgcgcgcccccttccgctctcggaggggtggcgaggtaggcgattaatgccgttcatcacaccctcacagaccctcccccacatcataaaaccatccccctcccctctcccc

SEQ ID NO: 62707 - DNA, 685 bp, Zea mays
  misc_feature: Ceres CLONE 1529254
  misc_feature: Encodes the peptide sequence at SEQ ID NO. 62708
tggcggccgctctagaactagtggatcccccgggctgcaggaattcgtctcacccctagaaaaaatgtatgggggctgacgcctgcccagtgccggaaggtcaaggaagttggtgaactgatgacagggaagccggcgaccgaagccccggtgaacggcggccgtaactataacggtcctaaggtagcgaaattccttgtcgggtaagttccgacccgcacgaaaggcgtaacgatctgggcactgtctcggagagaggctcggtgaaatagacatgtctgtgaagatgcggactacctgcacctggacagaaagaccctatgaagctttactgttccctgggattggctttgggcttttccggggcggcttatgtggaaggccaataaggcccccttccggggggggcccgagccatccgtgagatacccctcgggaaagagctcggatttctaaccctgggtcagaacccgcgggccaagggtaaattttcaggttaaacagttttcttggggccgtttggccttccaaaaatggttactggaggcgtggcaatggtttttcttcgggtccaatacggaatttgggtcccttggtatggccagaagcagaagggggagcttggcctgcgcagacatcatcccggttaaagattattctcaaatattcgcccctttattgtcca

SEQ ID NO: 62708 - protein, 49 aa, Zea mays
  misc_feature: Ceres CLONE 1529254
MSVKMRTTCTWTERPYEALLFPGIGFGLFRGGLCGRPIRPPSGGGPSHP

SEQ ID NO: 62709 - DNA, 783 bp, Zea mays
  misc_feature: Ceres CLONE 1529258
  misc_feature: Encodes the peptide sequence at SEQ ID NO. 62710
  misc_feature (14)..(14): n is a, c, t, g, unknown, or other
  misc_feature (47)..(47): n is a, c, t, g, unknown, or other
  misc_feature (48)..(48): n is a, c, t, g, unknown, or other
gggggttttgcttngtgtgttttccttccttcctacccccacctttnnttttcaaagctgtgactccccgcggtggcggccgctctagaactagtggatcccccgggctgcaggaattcgtctcacccctagaaaaccctctctcttcttctcctccctcgtggtcgcgtggtcctgggacgcctcctccaagctccaaggaaacatccaaagcacatccgtgttccgagttcggagactaaacgcgattaagagtactggtagcctagttacagttggatctgagcgatgggggaggagcaggtggtggcgccaaagccggaggccgccgccgccgccacgtctgtggagctgacggggttcgttatgggcgcggaggacgcctagcgcgccgcggtggccgccggcttggccgaccgttcaggacctgctgccgctcctggtccagtccgcgaggaagcgcgcgcaatgtacctatctcggggttcccccatggggcgcctaggaggctgggcgccagcgggtctgctttcttacgtcggtgtaaattcttttagtctcccccggcccacccgctttatgaccattccgtcctacccacaaataaatttcctcgatccgcacatcgaatgctcaccagagagggagaattcctgaatctgcggctcccagtcgaccaataatcacataattaccccctggacgacaaacctgaccagaccagcccccctgctaaggcaacaattcacccgtgtcactcccatccgatccaaccccagagat

SEQ ID NO: 62710 - protein, 32 aa, Zea mays
  misc_feature: Ceres CLONE 1529258
MGEEQVVAPKPEAAAAATSVELTGFVMGAEDA

SEQ ID NO: 62711 - DNA, 441 bp, Zea mays
  misc_feature: Ceres CLONE 1529260
  misc_feature: Encodes the peptide sequence at SEQ ID NO. 62712
aatgaagcagccatggcagcattggaagagcgattagagttcattgagaacgggacatcctcaatgggttcatcttgtttgattaagctctcacactttgagcgtgctctatcgaagatcaagccatcagtatctgaacagcaaattaaatattacgaggcgttgtcaaagagatactcgtcaaactgaggtatcaccacgtctccatgactcccatccatggttcgtcagtggttgcagctttgtatttttggtggtggtgaatggtgatgaaattctacagttgtagaaatcattttaggttttgctgcctacaggcaaatttttgtatggccttaagatacattatacaaggatgagtagtaccacaaatatgtcgcagttaatgctatcgaaggcctccagtcgtggagcgcattcccccaaaaaaaaaaaaaaaaa

SEQ ID NO: 62712 - protein, 58 aa, Zea mays
  misc_feature: Ceres CLONE 1529260
MAALEERLEFIENGTSSMGSSCLIKLSHFERALSKIKPSVSEQQIKYYEALSKRYSSN

SEQ ID NO: 62713 - DNA, 845 bp, Zea mays
  misc_feature: Ceres CLONE 1529269
  misc_feature: Encodes the peptide sequence at SEQ ID NO. 62714
  misc_feature (38)..(38): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gggggttttcttcttttgcttttttttttttttattgnagaacacaannnnncaaaactggaactccccgcggtggcggccgctctagaactagtggatcccccgggctgcaggaattcgtctcacccctagaaaaacacaccgatcctcccagctgcatctgcattgcattgcatgcacaggtcgcgcccaccatcagtagcggtcgccgccatgcagagactcgtgcgcgtcctcgtggtgctgggcgtggccgcctcggcgtcggcgcaaggcccgactgcggcgccaacgacgcccacgcccacgccggcaacccccgcggctcccgctccctctacggcgtccagcaacatcacgggccgagatggccaaagacgtccaattcaacacccatcatccgtcttgttaagtacaaaggatggtggagtcgcaaaatcgaacatctcagtcccgccaatcggacatggaaacgggagtccacggtgtttcgaagccctacatcaaaaaagcaattccaaaaagaacgcccctcaaagctatgaatttaaacttcacctgtcccagaccccatcaacaccaaaacccctactcgctgtcatttcaccacttgtttaggaactcacagcacttcgctcccatgtttcttcaattttacgtacatcccttacaccaaaccccggatacacttaattgaagggagagaggaagaacaccttaatttctattgtagataaatattcccacaataaaaatagatctaatccacccccatcaaaagagtaacactgagatagagctcaagaggtgactcttcctatacgattacttctattttctaacag

SEQ ID NO: 62714 - protein, 134 aa, Zea mays
  misc_feature: Ceres CLONE 1529269
MQRLVRVLVVLGVAASASAQGPTAAPTTPTPTPATPAAPAPSTASSNITGRDGQRRPIQHPSSVLLSTKDGGVAKSNISVPPIGHGNGSPRCFEALHQKSNSKKNAPQSYEFKLHLSQTPSTPKPLLAVISPLV

SEQ ID NO: 62715 - DNA, 921 bp, Zea mays
  misc_feature: Ceres CLONE 1529270
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
ttttttttttttttctcctttnnnnnnnnnnnnannnanncccggtgttnnnnataatagatggactccccgcggtggcggccgctctaaaactagtggatcccccgggctgcaggaattcgtctcacccctagaaaaacctctcacttcgcgggtacgcagagtcgctagacgcacctcgctcgcaacttgttggactccaaggggcaatagacagcaggcagggcccccgaactgcgggaggagacccccaaggatctcgtcggccgggtaaaggaagggatcggggattggctaatggcggcgaaccacagcagcagggaggatttggaagagcctggtcgtaactcacctccagggtgatattcgatttttctctggccggacctcctcctggctcaaaaacttatttaatttattagaaataaattatattttccagcccccagctctcgggggggggggggggggcgcgtcccctcaacctcctcctgtcaaacatttattcacacacacctttaggtggttgatatgttgaaccccgcgcgtataaagtgttgccgttgttatatgactccatgtgtatatcttcataagaatctcagtaattcttgtagcgcccgccgccacgctccgctcgccagtgtcatagccgcaattacaagaaacagctcctataatatattatacattgcgctagacatacgtactattctctatatgaataaccctcctcttccactccgctacaggatggcgcggcggagaagaacaaattacatggaagtgactttacactttgttcttccatactccgccgggagcggtgatgtccgctagtatatggacacttgctgctacccactatatattgtgattgtaataatacctatcgttctcatgctccctcaccacacacca

SEQ ID NO: 62716 - DNA, 704 bp, Zea mays
  misc_feature: Ceres CLONE 1529273
  misc_feature: SWISSPROT Homolog: EC 3.2.1.23 Beta-galactosidase
atagctggagctccccgcggtggcggccgctctagaactagtggatcccccgggctgcaggaattcgtctcacccctagaaaaagatattgacgatgatgtattcaggtcagcatgcagttcactttacttgcatactggctaccatgtatacagaatgctagctatctgtgaatgatctagttgcgaatgatatcataattgtgatgcttttgtgaatatataagtgtggtgcttttgtgtttcaaaacaaaaaaaaaaactagactctccaggtaccccttctccctataatcagcctattacccgcgctcactggccgtcgatttacaacgccgatgactgcgtaaaaccctggcgttacccaacttagatcgcctggcaacacatccccctttcaccagctggcatactagctaagatgcccgcacctatcgcccttcccaacacctgcacacccagaatggcaaatgcaaattgtaatcgttaaaattttcgttaaaattcgcgtaaaatttttgcaaaatcaactcattttcttcaccaatagaccgaaatctccaaaatcccttatcaatcaaacgactataccgacatagggctcgatgttgatccatctcgcaacaagagtccactattaacgaacgtgcactccaacgtcaaagggcaaacaaccgtctatcacggcaatggaccactacgtga

SEQ ID NO: 62717 - DNA, 736 bp, Zea mays
  misc_feature: Ceres CLONE 1529277
  misc_feature: Encodes the peptide sequence at SEQ ID NO. 62718
  misc_feature (736)..(736): n is a, c, t, g, unknown, or other
aaagctggagctccccgcggtggcggccgctctagaactagtggatcccccgggctgcaggaattcgtctcacccctagaaaaatttgttttattgtggatggtgctaagtgccggtgggctcggccttcttatataagtatatcccatctttagcttctttattgaggattgtcacttaagctagcatgtattttaaaacttataaatgttttatacattcaaattgtaatattttgtatcaatttctcttgtaatcactccgatgatatattgtaatattgctataacttgtaaatgttgtaacttgtaaaaaaaaaaaaaaaaacgagacgctcgaggtacccaattcgccctatagtgagtcgtattacgcgcgctcactggccgtcgttttacaacgtcgtgactggcaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactcaaacgtccaagggccgaan

SEQ ID NO: 62718 - protein, 45 aa, Zea mays
  misc_feature: Ceres CLONE 1529277
KAGAPRGGGRSRTSGSPGLQEFVSPLEKFVLLWMVLSAGGLGLLI

SEQ ID NO: 62719 - DNA, 836 bp, Zea mays
  misc_feature: Ceres CLONE 1529278
  misc_feature: Encodes the peptide sequence at SEQ ID NO. 62720
  misc_feature (12)..(12): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tgtttttcctcnccccctcccccttactttttnnnnnnnnnggttnnnnnccaacagctggactccccgcggtggcggccgctctagaactagtggatcccccgggctgcaggaattcgtctcacccctagaaaaatcttcgccaaccgctgcgtcgcgagctcgccgccatggcattggctctccccctcgcccgcctcgtccccgcctgccagtgccagggttggccccacctgcgctttcggaagcgccacgtctccttcgccgctcacgccagttctcgcgccgccttcgctgcctgcgcggcggcccctgccctctttgtccttgtcccttacgcggacgcgggggcggagacggcccacccctcggcccccaaaaacacggcctcgtcgccgcataacatcctttttttcctccccccccgtggggggggggggggggggctctttctatattccactccctcccacccccccccctgtgagagactttccagtgtacagtgctcccactcgagagaggcgggctactttcccaggttttctttcctctagtcttcctcgtcgttcagtctccgttctcttgtaagatgtctcgtcccttgtcctgtcggttggcgcccaatgtggaataccgctgctgacaaccgttcgggttggcgtgccgtccgccgtgcgctcctctcgcggcgaggcatctcccgtgtccagctctcctggacgcacgctacccgccgtccgccccacccgcctcgccccttccgtcccggcctaccgcccggcggatgttcgaataggctgcgaactgtcaccgcctcacccgccctccgcacc

SEQ ID NO: 62720 - protein, 128 aa, Zea mays
  misc_feature: Ceres CLONE 1529278
MALALPLARLVPACQCQGWPHLRFRKRHVSFAAHASSRAAFAACAAAPALFVLVPYADAGAETAHPSAPKNTASSPHNILFFLPPRGGGGGGLFLYSTPSHPPPCERLSSVQCSHSREAGYFPRFSFL

SEQ ID NO: 62721 - DNA, 719 bp, Zea mays
  misc_feature: Ceres CLONE 1529283
  misc_feature: Translation starting site: 132
  misc_feature: SWISSPROT Homolog: EC 3.2.1.23 Beta-galactosidase
  misc_feature (719)..(719): n is a, c, t, g, unknown, or other
atagctggagctccccgcggtggcggccgctctagaactagtggatcccccgggctgcaggaattcgtctcacccctagaaaaagattcgctcgctcgatcctagcttcccttccaagaagcgcagcgcccatgtccacggcaactccctcacctccggccagaagggcctgctcatctacggcagcctcctcatcggcttcctcttcttcatctccggctacttcctgcaatgatgacgccaacaacgactctttctgatctgatctgctttccgtttgtgtgaatagaatacttcgtccgtgcatgtactcctccccactccgagggaacaacattcatcatcaatcgactagaaactcttggttttagattttttttttatttgatgcggtgatcgttaagttcacaggaacaccaagcgcatatcccctccatggttgtaatatgtggacaacaaaactacaaactagacataaagcatgtcataggcacagtggtagaggagggtacgcgtggtgcacacatatcttatccaaccaaaaaataaaaaataaacgagacgctcgaggtacccaattcgccctatagtgagtcgtattacgcgcgctcactggccgtcgttttacaacgtcgtgactgggaaaaccctggcgttaccaacttgatcgcttgcaaccatccccctttcgccagctggcgtatagcgaagaagccgcn

SEQ ID NO: 62722 - DNA, 784 bp, Zea mays
  misc_feature: Ceres CLONE 1529285
  misc_feature: Encodes the peptide sequence at SEQ ID NO. 62723
  misc_feature (20)..(20): n is a, c, t, g, unknown, or other
  misc_feature (48)..(48): n is a, c, t, g, unknown, or other
  misc_feature (49)..(49): n is a, c, t, g, unknown, or other
tgggtgggggtgggtggtgnccctctcctcctccccccccttatatannatcaaaactaggactccccgcggtggcggccgctctagactagtggatcccccgggctgcaggaattcgtctcacccctagaaaaagactaccgaggaggcatccgaggtggccagccacgatgatggccgcggcggcgctgaggccgcacaagtcttcgccggcgcgcgtgcccacgcggtgcgtggccgcgctctgcgccgcctgcttcctcgtcggcgtcggcgtcgtcaacaggtactggcctgttcctgagcctcatcccggttgcccagacaaggctggccctgaccactcgagggccgtgttgaaccaagcgtcacagactctcgaagtcgtcatggcgattggacaagacgatatccgacatctaaacgcgcctggctgccgctagagccgcccaggcgaatgaaccagggcatgtcacccgggcgactcgtaactcttatgtcgaaccatggaaccatcgcggccttaggaagtcttttagtcatgagttgttttccaccccctcctgactatccggaagctgtaaataattcatcttctcgtcacatcttgcatccccctcagggttgataccacctcgcctaacaatttgttaaatacacacgcccgtctccactatcccgcattttcggctgtgcagcggcccacccctgtcacaagtcccacccccctcgataataaatgtatccgtccctcacccttgcctaattcctgaatcacgcctta

SEQ ID NO: 62723 - protein, 90 aa, Zea mays
  misc_feature: Ceres CLONE 1529285
MMAAAALRPHKSSPARVPTRCVAALCAACFLVGVGVVNRYWPVPEPHPGCPDKAGPDHSRAVLNQASQTLEVVMAIGQDDIRHLNAPGCR

SEQ ID NO: 62724 - DNA, 883 bp, Zea mays
  misc_feature: Ceres CLONE 1529294
  misc_feature: Encodes the peptide sequence at SEQ ID NO. 62725
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
gggtttgtttgtggtgggtnnnncncnnnnnnctcttccnnnnggcgcnnnnnnccccctgggactccacgcggtggcggccgctctatacctagtggatcccccgggctgcaggaattcgtctcacccctagaaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccggcagcctccccgtcgcccgacgctcctccagaagcctccggcaacgtcagcaacggcggaaggatccggcggcagccggtgtggagggacctctgtaaccacaaccccctatacgctgctgttaccctgccgcccccccgccccccgttttttttgccccacccacgggggggggggggggggggcctcccatttatcatgttataccacctctgtcccccccccagaaaaggggtgggccattcgccgtcaccgcccgccgcaccagccgcaggttctcaggtggagtatctatggagggtaagaaacaacctaacaatgtgaaccgatcggcggcaagaatgtctcgccgcccggctgcacgagcgttggaacctgatacctctctccccaccatcaccccaacccacccacggcctcgacgcccgcgcagcccatctcttccctagcccctaccacctggcaccaccccaccaggaggacgtgggcactcggaggggagaggacccggaaggtatacgcatacgagatcaatactctatctgtgataccacgtctaccccaaataccactccaccaacaatccggcctggtgttgaagactgcagacattg

SEQ ID NO: 62725 - protein, 55 aa, Zea mays
  misc_feature: Ceres CLONE 1529294
  misc_feature: SWISSPROT Homolog: EC 4.1.1.39 Ribulose-bisphosphate carboxylase
MAPTVMMASSATAVAPFQGLKSTGSLPVARRSSRSLRQRQQRRKDPAAAGVEGPL

SEQ ID NO: 62726 - DNA, 815 bp, Zea mays
  misc_feature: Ceres CLONE 1529295
  misc_feature (19)..(19): n is a, c, t, g, unknown, or other
  misc_feature (20)..(20): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ggggggggttgggggcgcnncaccccccccacgcaaccccatattttnnngcatcccattcaaccctgggactccccgcggtggcggccgctctagactagtggatcccccgggctgcaggaattcgtctcacccctagaaaaaatccgtccaatcaaccgggctgctctgctgcctctccggcgccattgacgagctagagagtgctccgacccctgctccgtctcgtgccgtgcccacccgctatggttaagggtcctctactcgatctcaccccttccaatctaaccgctcccgttcctcgttattctgtaggtccgcccgagatgccgcattctcctctatacctctgttgattttgctgtatttttttattgttgttttaccccacaccgcaacatactccccccaaccctcaagacccgctaaatccacccccccactaacataacggggcgagatccatctttaactaatttaccctcctgtctatccctctcaccctcacccctcttccatattccttcctatttcatgttttggttcattacttctgttccacttgtgttcaaattgccctcatttatcctcgttcttatcatttcctttcgcacgtctcccctactgcttgacgacatgacaaattgttattttcttcatccctaaactttacccccctaagacccctactcagtcttactaactccccctattcccccaaaatcacccctcccctcccctcccctccgccactcctgtcccttctctacttttcttatccttcttacctcacataaagctctattaagtaaata

SEQ ID NO: 62727 - DNA, 734 bp, Zea mays
  misc_feature: Ceres CLONE 1529298
  misc_feature: SWISSPROT Homolog: EC 3.2.1.23 Beta-galactosidase
caaagctggagctccccgcggtggcggccgctctagaactagtggatcccccgggctgcaggaattcgtctcacccctagaaaaaactctcactctccctttctctcgtggagacgactgggcgaccgccggcgccgacctacaccaggtgcccaggccttcgtcgggaccatcgccggcgacgaacacccaccagctggatctgatccaattacaggtgcatacacgcattatgcctactaatttcgattttttgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttgggacaagagtccactattaaagaacgtggactccaacgtccaaaggcgaaaaaccgtctatcagggcgatggcccactacctgaaccatcaccctaatcagtt

SEQ ID NO: 62728 - DNA, 725 bp, Zea mays
  misc_feature: Ceres CLONE 1529301
  misc_feature: Translation starting site: 116
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaaaattgatgtcatcacaggcactgttggggacatgcaaaagctagggattcaagagtcgttcaaggtgaagcaggccattcttctgtctgcaacagaggctgcggagatgatcctcagggtcgatgagatcataacctgtgccccgcgcagaagagaggataggatgtgatattacacgctgtttctcgatgtagcgggatgctcattaccctagttttgaggggtattatggtttaggggcgctcaagttggtcagatttcgagtgtttttggcccctaagcaactggtacttgttatttggttgaaacaatcagccttaggtttgtgttctacattctcatgctgtaccgtttggtagcgagttacgtcgtacgatatgcttgttccatattgtttttctattccttttaacgtaagaatgggcttgtcttttttcctcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcggcttgcagcacatccccctttccgcagctggcgtaatagccgaagaggcccgcaccgatcgccctttcca

SEQ ID NO: 62729 - DNA, 625 bp, Zea mays
  misc_feature: Ceres CLONE 1529305
  misc_feature (201)..(201): n is a, c, t, g, unknown, or other
  misc_feature (202)..(202): n is a, c, t, g, unknown, or other
  misc_feature (209)..(209): n is a, c, t, g, unknown, or other
  misc_feature (287)..(287): n is a, c, t, g, unknown, or other
  misc_feature (288)..(288): n is a, c, t, g, unknown, or other
  misc_feature (412)..(412): n is a, c, t, g, unknown, or other
  misc_feature (415)..(415): n is a, c, t, g, unknown, or other
  misc_feature (420)..(420): n is a, c, t, g, unknown, or other
  misc_feature (421)..(421): n is a, c, t, g, unknown, or other
  misc_feature (423)..(423): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (538)..(538): n is a, c, t, g, unknown, or other
  misc_feature (544)..(544): n is a, c, t, g, unknown, or other
  misc_feature (545)..(545): n is a, c, t, g, unknown, or other
  misc_feature (551)..(551): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (560)..(560): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
tccccgcggtggcggccgctctagaactagtggatcccccgggctgcaggaattcgtctcacccctagaaaaaaacttgcgtagagagttgggcgcagagaatccccaagcaaacaaacagggtagagggagaggagaggagaggagaggagaggagaggttgggtctgggacaccatggctccgatgaagctgtacgggnngcggtgntatgttcgttgggaaacgtggaccgaggtgcgccaacggggcgcttggggaaggctggggtccaattcaaatctgggnncgctttttttttccccccccccaaaaaaaaaccccgaaaactttttttaaaaaaagtcgttggggggggcgccccccccccccgggggggggggtgtgttgtttctctccctttttataaaaanaanacccnncncagggggcgcgtgccgcctctccnnnnnnnncccctctccccccttttttttttnnnctggtgccacccccccccagccccnnnnnnnnnccnnnccacccnnnnnnnnncagcnccggcnncttagnggtnnnggnaaggnnnnnnaggatttcttttcnnnnnnnnnnatgaggggggaggggataataaaatctnnntg

SEQ ID NO: 62730 - DNA, 680 bp, Zea mays
  misc_feature: Ceres CLONE 1529308
  misc_feature: Encodes the peptide sequence at SEQ ID NO. 62731
tccccgcggtggcggccgctctagaactagtggatcccccgggctgcaggaattcgtctcacccctagaaaaatctcttcactgtctcctccaacgccgctcacggcttcgcttcagtgtcttcacgggccgccggcggagatgcggttcacggcgtctccggtggtggagcttccggtcagcggcgcggtgttgactttcgagcaggacaacgactccttcgaggtgggcacctctgtgtggccctcgtccctggtcctcgtcaagttcgtcgagcgctgcatccgcgacccggccctcccctttgccgacgtgctccgcttcccgggaacccgggccgtggagctcgggtccgggtgcggaccggcaggacttggcctctcccgcctcggcctcaccgatctcgtcctcaccgacatcgccgccgtgctcccggcgctccgccgcaacctgcggcgcaaccgagtccacctcgcgcgcgcgccccgccctcgccagctccactgggaatgccccgcgcatctcgggacgcttgccccccccgcgccgctttcgatctccgtgttcgccggaaaacgtgggtcttacgttgcaggagtccgttgcccccaccctcattcgcggcccattggatggcgcctcgcccaaacccccaactggtcgtcgttggtgtgtttcct

SEQ ID NO: 62731 - protein, 179 aa, Zea mays
  misc_feature: Ceres CLONE 1529308
MRFTASPVVELPVSGAVLTFEQDNDSFEVGTSVWPSSLVLVKFVERCIRDPALPFADVLRFPGTRAVELGSGCGPAGLGLSRLGLTDLVLTDIAAVLPALRRNLRRNRVHLARAPRPRQLHWECPAHLGTLAPPAPLSISVFAGKRGSYVAGVRCPHPHSRPIGWRLAQTPNWSSLVCF

SEQ ID NO: 62732 - DNA, 665 bp, Zea mays
  misc_feature: Ceres CLONE 1529315
  misc_feature: SWISSPROT Homolog: EC 6.3.2.19 Ubiquitin--protein ligase
aagctggagctccccgcggtggcggccgctctagaactagtggatcccccgggctgcaggaattcgtctcacccctagaaaaagtcttcctcccgattccaagctgctctcgtccctagaaataaagcagctcctccgcggggcggggaactactacccatcgccaaaacgctatgcccgatgcggtcgaggagcactacttcttggcctggcgggcacccctaggcaggcaagcctcctgctccagaagcagctcacggatcttgcgaagaaccccgtggatgggttctccgcacggcttgtagaccatagccacgtcttctagtggcagggcaccatcatcggcccgcccgacaccctatatgatggaggctacttcaatgcaataatgatcttcccccagaactatcccaacagcccgccatcagtaagatttacttctgggatgtggcatccgaatgtttatccggatgggcgcgtttgcatttctattcttcaaccactggtgaagatctcagtggctatgagcttgcaagcgacacgtggatcacagtgcacacggaggggcttcttgctcagggcacatcaatgtctgcttgctcttttcctatgtggaggtggtaatctgctggggctgcaagtataactctgagcgtcagttcaag

SEQ ID NO: 62733 - DNA, 640 bp, Zea mays
  misc_feature: Ceres CLONE 1529316
agtggatcccccgggctgcaggaattcgtctcacccctagaaaaaagtgcaggagcgctcggctccttcctttctgcttctcccccaaccgcgcgtccgctgccggccgagctccctggccgccgcgccgcggactccagcgctcagtgcccagcttccagcaccgtggctttctagctccctctctcttctccatttccctcaagctcgccgtggccacagggcctctggattccatatcactggtgtcctcttctccggccggttcgagtcggccgccgtcgcttagcttcagctcgttcctggccggattccctgctcggcgtccctctctgctcgttgggtactccttcctgctcgtcgcgcccatagctgagcctagccgcgccttccctgtcctctgcacgctcgcagttcgccccaactcccgtccatagtggtcgccaatcgtcgaccctgctcggattccatctcgccagcagccccccttgttcctcgtcgtcaatccacgtcacgtccgcaacgtgctcgtcgacctctacgatctatctttccattttgcgctactttgtgttgagcttctgaagccccctgtcaagctcttcctccgggaagtcgcccttcgaacacaaccccctgc

SEQ ID NO: 62734 - DNA, 703 bp, Zea mays
  misc_feature: Ceres CLONE 1529317
  misc_feature: Encodes the peptide sequence at SEQ ID NO. 62735
  misc_feature (381)..(381): n is a, c, t, g, unknown, or other
  misc_feature (393)..(393): n is a, c, t, g, unknown, or other
tccccgcggtggcggccgctctagaactagtggatcccccgggctgcaggaattcgtctcacccctagaaaaagctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactatttttggccaccccccgggggggcaagaggggccntattctttcttncccaaacacctcccttttaggtgatccacaaagcggtgggtcgatgccttgggggcgcctgggctacatcatccccgaagggggctggacaaaggggctgccccgtggaacttccaaggaaccccccgtggtatcacaggcccgcctccccaaaccttcccccgaggccgcgccttggacctccctgagacaaccccaacccaggggcacatccttagaagctccctgggcccggaccccgcgttcaaggctgtggcccacgtggggggctcgcgtgaaaggtatttctcgatttaccagcacccttaac

SEQ ID NO: 62735 - protein, 103 aa, Zea mays
  misc_feature: Ceres CLONE 1529317
  misc_feature (94)..(94): Xaa is any aa, unknown, or other
  misc_feature (98)..(98): Xaa is any aa, unknown, or other
MASTIMAATSRIVAAKTPFLGQGRAAAAAANASPLRDVAAAAAGGRITMGNDLWYGPDRVKYLGPFSAQTPSYLTGEFPGDYFWPPPGGARGAXFFLXQTPPF

SEQ ID NO: 62736 - DNA, 722 bp, Zea mays
  misc_feature: Ceres CLONE 1529318
  misc_feature: Encodes the peptide sequence at SEQ ID NO. 62737
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (233)..(233): n is a, c, t, g, unknown, or other
  misc_feature (258)..(258): n is a, c, t, g, unknown, or other
  misc_feature (260)..(260): n is a, c, t, g, unknown, or other
  misc_feature (321)..(321): n is a, c, t, g, unknown, or other
  misc_feature (323)..(323): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (470)..(470): n is a, c, t, g, unknown, or other
  misc_feature (471)..(471): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (493)..(493): n is a, c, t, g, unknown, or other
  misc_feature (511)..(511): n is a, c, t, g, unknown, or other
  misc_feature (512)..(512): n is a, c, t, g, unknown, or other
nnttggnnnnnncccatattggtgatccccgcggtggcggccgctctagaatagtggatcccccgggctgcaggaattcgtctcacccctagaaaaaaagcatccgcagttccccgaccacaccgttcctccgaggtccgagcccaggagcagccccgcgccaggaggatgtttgttcttttaacaatatgtccagggaggagaatgtttacatggcccagttggctgaacangctgaaaggtatgaggagatggttnantatatggagaaagtggctaacactgtacatgtggttttagcccccgggggagggagggggntncctctgtttttttttttttaaaaaagaggtttgggggtggnnnnnnttttttttcttctccccccccgggggggaaaagaaaggggggggnnnnnnccccnnnnnnnnnnnnnnnnnnntttaaaaaaaaaaaaaaaaaaaaaaatnntnnnnaattggggggggggttntttttttatttttttttnntttggatattcctcgactattccttcgtctaccccccccccattgtttttatttatttgtgggcgggaaaacacagcgaagtccctcccccctcaccaacaaaaggggtctttgcatccccctctcttctcctccaaattatatgcaagggtggcagcggggaggaaaagcaaacacctccttatgaaagacctttgtacggcgccccct

SEQ ID NO: 62737 - protein, 51 aa, Zea mays
  misc_feature: Ceres CLONE 1529318
  misc_feature (15)..(15): Xaa is any aa, unknown, or other
  misc_feature (24)..(24): Xaa is any aa, unknown, or other
  misc_feature (45)..(45): Xaa is any aa, unknown, or other
MSREENVYMAQLAEXAERYEEMVXYMEKVANTVHVVLAPGGGRGXPLFFFF

SEQ ID NO: 62738 - DNA, 665 bp, Zea mays
  misc_feature: Ceres CLONE 1529319
  misc_feature: Translation starting site: 393
  misc_feature: SWISSPROT Homolog: EC 2.7.11.1 Non-specific serine/threonine protein kinase
ggagctccccgcggtggcggccgctctagaactagtggatcccccgggctgcaggaattcgtctcacccctagaaaaatcctctcctcctctcccacagtcccacccgtttcccagtgcagaagccggcgaaacttccaagcccaaggaagaaaaaaaaagctgtcacctttaactcgatcccctcttccccgcccgtgtccgagcggcggcgccggagccgacagcttccggcaagcgggggctacttggtgcggcggactatttccgcggttttgtgccacagcgggactgaactgcccgcccaggctgccctgtcagggtcaccaaggttgaacaagactgaactgccgcgcttcagccttcaggatactgaactgccatctcagttaaatgatacactgcacaacagtgggcagcgatagtttgagacacattaacaatgagttgtttttctcattttcaagagaaaaagggggccacaacaacaagacgatccatctgacaattatttcactggttctgagaatataacaagattcagctacagggaactggttagagccacatcaaattttgaccaaggcaataagattggtgagggcggctatggacctgtctacaagggaacactcaaggatgggacagttattgccgtaaaggttc

SEQ ID NO: 62739 - DNA, 637 bp, Zea mays
  misc_feature: Ceres CLONE 1529321
  misc_feature: Translation starting site: 187
cagctggagctccccgcggtggcggccgctctagaactagtggatcccccgggctgcaggaattcgtctcacccctagaaaaactcgcgccgccacttccctcccgacccactcgcccaaaaccgtagcgccctcgcctgctcgccgccgccgtcgttgcgagctccccatcttcctccgttaaccatggcgacccagatcagcaagaagaagaagttcgtcagcgacggcgtgttctacgccgagctcaatgagatgctgacgcgggagctcgcggaggacggctactccggcgtggaggtgcgtgtcacaccgatgcgcacggagatcatcatccgcgcaacgcgcacgcagaacgtgctcggccagaagggccgggaggagggggggagctcacgtctgtggtccaaaagaagttcaacttccccgagaacggcgtcgagctctacgccgaagaggtcgtcaaccgcgggcttctgcgccatcgcgcaagctggattccttccgctacaacctccctcggaggccttgccgtcccggagggcctgctatggggttcttcccctttggtttggaaaaagggggggccaaggggttgtgagggtcattttgggaggggaaaaagttcaggggctcc

SEQ ID NO: 62740 - DNA, 901 bp, Zea mays
  misc_feature: Ceres CLONE 1529327
  misc_feature (11)..(11): n is a, c, t, g, unknown, or other
  misc_feature (17)..(17): n is a, c, t, g, unknown, or other
  misc_feature (32)..(32): n is a, c, t, g, unknown, or other
  misc_feature (42)..(42): n is a, c, t, g, unknown, or other
  misc_feature (43)..(43): n is a, c, t, g, unknown, or other
aaccagaccancatcgncccggctctcttctnccaatctccnncacactagtcatctccaagaaatggccgccgctctagactagtggatcccccgggctgcaggaattcgtctcacccctagaaaatgtgtagaccaccgggtgtagttgactgtatctggttgtttgtatgtatggacaagacaaaactaccactgtagatggtatgggaaggcgtaagcaaatacaatatgacactggtccagttcccggaatgaatggaatatgacattggtcccaaaaaaaaaaaaaaaacgagacgctcgaggtacccaattccccttatactgagttggatgatgctccgctatatggccgttgtttttccacgtgactgaactgggaaaagcctggcgtttctccactccccccccctaggggggggggggggccttccctcctcgcttccgctcgctccccacccagggcccctgcctttgtgctctatcccaccatcgctcgcctgcggcccctacactcgtccccttgacacccgctcctacgcgagcatagcctactgccctccacatcgcgagtggcgttggcccgccttgcgcccatctcaccttcactagggaccaacgcacgacctcctcggcgcttttatctcccgtcggcccccctgccttgttcatctgacgccaggcctactcttctctacgagcctaagcgaacgctgtgggtaggtgctcccagacacgtggacgactcgtcgcgctcgtcagcggcgtcactccaccaccaaccgtcgtttgatcgcacatgtatatcgtttgtcttctctgcgccgccgggtcccccgcattccactactctcgcccaacggccgcgagctcctctacgttgtaagattcgtattcg

SEQ ID NO: 62741 - DNA, 739 bp, Zea mays
  misc_feature: Ceres CLONE 1529332
  misc_feature: SWISSPROT Homolog: EC 3.2.1.23 Beta-galactosidase
  misc_feature (739)..(739): n is a, c, t, g, unknown, or other
aagctggagctccccgcggtggcggccgctctagaactagtggatcccccgggctgcaggaattcgtctcacccctagaaaaaccctagaaaaatcatttgggagttatcacagagccagtttggcagtgctgtagttttggttttacctactctttgtagaagaaaagtgaagagtggatattatggaacaaaatatatacctacggcagcacgcagcatgatgaaacatatttaaaaaatttgggtgctctaccacatgcccgtggaataaaacggatgtaaactcagtgcacttataacaccctaattgtggttttgtttgtggttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgtttaatttttgttaaatcagctcattttttttaacaataggccgaaatcggcaaaatcctttataaatcaaaagaatagacggagataggggttgagtgttgttccagtttggaacaaggagtcactattaaagaacgtggactcn

SEQ ID NO: 62742 - DNA, 748 bp, Zea mays
  misc_feature: Ceres CLONE 1529333
  misc_feature: Translation starting site: 500
  misc_feature: SWISSPROT Homolog: EC 3.2.1.23 Beta-galactosidase
atagctggagctccccgcggtggcggccgctctataactagtggatcccccgggctgcaggaattcgtctcacccctagaaaaactacctggacgccattggcgtctactggcgcgccctctaaaaagctttgttttgcgatgtgaatgaagcagctgcttgcctgcaggtctactcgacacacagtactagtccatcaccaccagctgcttgaatagcagagcgggcggcctgcttgcagttgctatatttccaacctgagtgttgagaagaggagagtttgctaatgtccctaggtacccagcttggccaactctgagcagtgttacgcgcgctcgccgttctcctgaattccaactgaataatagagacctcctgtacaatacgtcacggatttatcactcaaaacaaaaaccaaaacccagactgctcgaggtacccaatacgccctataggaagtcccattacacccgctcactggcctgcatgtttaaacgaaatgactgggaaaaccctggcgttacccaacttaatcgccttgcagcacatccccctttcgtcagctggattagtcgagaatcagcccgccccgattacccttcccactatagcgaaacctgaatgacgaatgtaaattgtaggaacaaatattttctaataattcacgtggactctatgttaaaacggctcattatcttaaccataggccagagtcgctacatgcactataactcaaacatataccggg

SEQ ID NO: 62743 - DNA, 754 bp, Zea mays
  misc_feature: Ceres CLONE 1529336
  misc_feature (754)..(754): n is a, c, t, g, unknown, or other
tcacaactagtggatcccccgggctgcaggaattcgtctcacccctagaaaaaatttctaccggttgttgagcaagctaggaactcttggaatggaagactctacctggtgtccttgccctctatgacccctagatccgctgcagctgctgctactcagggtctgccattttttcatgtcatcttggttcggaccttggtgtagcactgcaacgctaatgtttactcctccgaacatggacttttggggatatgcttgacaaagagtaatactcaataactcgaggaataaacttttacttcctcgctgctgtgggtgaagtgtcttttatccccccatttggaggggggggagccccccagaccactttcatcacaccacttcgttccgccacgaaaaaaaaccctcttgccgcgagctgccggagatcccaaatttgccctatcacccatgctgtaattacgaagagctccgcggagtcctccgtattcacttgcgcgactacttcgccgaaaaaccctttctgttaccccaatctccatgaacatttcctccccaaactccccctccttctacctgtcgccacatacctacccaaaaacgcctcaatgctctctcaccacctacgccaaaatatccccaagactccgtaatggcgccgattgcgactcgcgctggaagtagcatccccctctgatacgcgagcctcatctctctcaccaccctcagctccgttgtatttatctcccagcgn

SEQ ID NO: 62744 - DNA, 758 bp, Zea mays
  misc_feature: Ceres CLONE 1529339
tctgaactagtggatcccccgggctgcaggaattcgtctcacccctagaaaaataccatgtcaattgtatcgttctttccttctacttaaaaatcgggaaatttctgttgaaagaaacgttggattaagtgtccggcgcctgttataaacaagtgtgtaattctgtaacgtaactgctcctttcttatttgtaccttctggaagagctgctcaagaaccggtgccgccacaagtcctggaatctgcgaactcctcacctaacctcgagtacgttcgcggtatccaattacccctatatggactcgtattaaacgccttccttggcctgtttttccccacccagtgacggggggagaccctgccttttccccaacttcctctccttgcaaccgtgccccccttaccccagctggatgaaatcgagaaaatgtccgcccccgcatggcccttcccaacagttttctcccgcttgcatttgccacttgacatttgctcactcttacaatttttgctccacattcaccccacacattcttaccccccccccccgctctctttccagcctcttactcctggacttccgcagaacgctccttttttcacccatcccatacctccccgtgtactcagctttcgcgcttcttccctcccccttcgggacgccatagatcccctctatatgatataactcgacgtgattcaccacgtccacggttgtccgaagaccgctaccctcttctcacgccgtcgcctcccgg

SEQ ID NO: 62745 - DNA, 740 bp, Zea mays
  misc_feature: Ceres CLONE 1529348
  misc_feature: SWISSPROT Homolog: EC 3.2.1.23 Beta-galactosidase
  misc_feature (335)..(335): n is a, c, t, g, unknown, or other
atagctggagctccccgcggtggcggccgctctagaactagtggatcccccgggctgcaggaattcgtctcacccctagaaaaatcacactgtaaatgaaggaacatacatcagctgagttgtgaaaatggtacgcatgcagtgtgaggatctccgtctctcactgtccagtgagaagaacggaacatataggtatagctgctgagtggagtgcgtcctcctgatacttggcttttgcgaataaaaggagtgcctgctgttgtcatatgaagatagcctcagttccttcgatggtgagcttacaaagtaaccatgcatgtgctgatactcaatanaaaaaaaaagaaaaaacggacaaaaaaaaaaaaacgagacgctcgaggtacccaattcgccctatagtgagtcgtattacgcgcgctcactggccgtcgttttacaacgtcgtgactgggaaaaccctggcgttacccaactaaatcgccttgcagcacatccccctttcgccagcttggcgtaatagcgaaaaggcccgcaccgatcgcccttcccaacagttgcgcaccctgaatggcgaatggaaattgtaagcgttaatattttggtaaaattcgcgttaaaatttttgtaaaatcagctcatttttttaaccaaaaggccgaaaaccggcaaaatccccttataaatccaaagaaattaacccgaaaaagcgttaattgttgttccaagttttggaacaa

SEQ ID NO: 62746 - DNA, 727 bp, Zea mays
  misc_feature: Ceres CLONE 1529351
  misc_feature (292)..(292): n is a, c, t, g, unknown, or other
aaagctggagctccccgcggtggcggccgctctagaactagtggatcccccgggctgcaggaattcgtctcacccctagaaaaactagagattatgaggatattatgcttgccctccttggggcggagtgaggaggcgtgcctcaactcgatctcatctgctcctacttgtttgatggggccaaaaaactgcatcgacgtggtatccacatggccgtggttttgaataataataaatttgtaacacgtagcctgcattagcagcgcgttttagataaaggaacttcctgatnaaaaaaacgagacgctcaaagtacccaaatatcaccctataaagaaacaaaattacgcgcgctcactggcacgtgaaaaaaaaacaacaagccgtggccctcgggtgccccaatcccccctatagggattggaataacccccgctttcggccgctggtttaataacgaagaggccggaaaaacccggccttcccccaatttaatcgccttgaatgacaaccccctttcgccagcgggaatattatcaaaaaggcccccaccaatcccctttcccaaaatttgcccaccctgaatgggaaatgaaaattgtaagccttattattttgtaaaaattcgcgctaaattttgttgaatcacctcctttttttaaccatgaggccaaaatcggaaaactcccttttaatcacaaaaatacccccaaatggggtggagggt

SEQ ID NO: 62747 - DNA, 919 bp, Zea mays
  misc_feature: Ceres CLONE 1529353
  misc_feature (16)..(16): n is a, c, t, g, unknown, or other
  misc_feature (18)..(18): n is a, c, t, g, unknown, or other
  misc_feature (21)..(21): n is a, c, t, g, unknown, or other
ttttttgttttctttncnatntatgattttctctccaaacccaaaatactggagctccccgcggtggcggccgctctatactagtggatcccccgggctgcaggaattcgtctcacccctagaactgctcgtgtacggcctgcagtagcctgctcgttcttgttcagaaccttttttttttttttgctgtgctcaagaagctcagctgactgctgctgtactctgtctcacaagacattccgagtgatatacattcctaaaagggaagaaggaaatacacagtatttgaggcttaaaaaaaaaaagtttcctaaaataaaataaaaaacaagaaataaagaaaaaaaaataaaataaataaattaataaatataaaattaaaaaaattaaaaaattctgaatgtctcgtgggtaccccatctcccccccatgaggggagtcgatattattcgatgtattattgagccacccctctatatcattccttgtatattggaaaaaacccctcgcgcattccacaaacgttaaaagagacgttggagacaaatagctccctcccttttttccctcaccatgggtataaaaaacatccaaaaaaggccccccaacactgaaatttgccctctcacccaaaaagatttggacgcctcatcctgttaatgggccgaatcggggaactatctgtaatcgcgtttccttttattctttgtctaacaatatttcccattctaaatattgttttgcttctatatctgccctgaattcttttttttaccacaacattacctcacaaatctataggacagaaccccttctttgtaactaccacatcacatcctccactcctttcattctggtgttaaaactggcactgttcattacttttcggaaaactgaatggtctcttgtcattaataga

SEQ ID NO: 62748 - DNA, 903 bp, Zea mays
  misc_feature: Ceres CLONE 1529355
  misc_feature: Encodes the peptide sequence at SEQ ID NO. 62749
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
gtgggtggagggggtgttccnacaatannttaattttttgtaatactgggactccccgcggtggcggccgctctagaactagtggatcccccgggctgcaggaattcgtctcacccctagaaaaaaaggggaagctggtgatcgacgtcaagtacttcttcttctacgtgcactcggagacgcgcgaaatctgcggagagatctcctgtccggcgaccggcgacttcgtgctgtcccacgagcagacgttgccagggttcacctccaccggggtcgtacacgatctacatgaagatggtcggggacgacgacgaggagctcagctgcgtctcgttcggcttcagcattgggttcgtcgcctccagctgaaacccgcctgagctgctgttccataattcgcccaacatggatgtaatcatgcccaacccatggcattacggaagacgcttcggatttctttcacccccagaggagaagatttttggtcaacttcagaaatggaaatgggcttgcggtgctcgtcctttgtttccgtcgaacaataaattataataatcgcgagcccgcgtccgagggcaaccgcaatactcgcttcgaagtaggtgtaatcctggattgtgaccgagcctacctcactgtggctctgtcgccttttgatagacgctcgggggtcccgtgggaacaaacctgttgccggtgacccccaatccactaacgctccattggccgacaaagagaaccccttatttaacgcagggtgggaccttgtgcgcttggagaacgtcctccgctaccgatacccctatttttcctatacattgtctctacatctgctaataatgtcccaatggtggaattcgttataccgcatagcatcatcttacgtagtggatctccggcgct

SEQ ID NO: 62749 - protein, 125 aa, Zea mays
  misc_feature: Ceres CLONE 1529355
  misc_feature (7)..(7): Xaa is any aa, unknown, or other
  misc_feature (9)..(9): Xaa is any aa, unknown, or other
GWRGCSXNXLIFCNTGTPRGGGRSRTSGSPGLQEFVSPLEKKGKLVIDVKYFFFYVHSETREICGEISCPATGDFVLSHEQTLPGFTSTGVVHDLHEDGRGRRRGAQLRLVRLQHWVRRLQLKPA

SEQ ID NO: 62750 - DNA, 778 bp, Zea mays
  misc_feature: Ceres CLONE 1529359
  misc_feature (383)..(383): n is a, c, t, g, unknown, or other
aaagctggagctccccgcggtggcggccgctctagaactagtggatcccccgggctgcaggaattcgtctcacccctagaaaaaatcgttctccctgcgctctctctctctcacactgcgtctttggctcctgctccatctcctttgctgcgaagctccgagctctgctcggccggatttttcatggcgcccagccccttgcgtcggccagcccctgccatggagccttcggctgtgcagctctctcccccctagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaataaaaaaaaaatagggngggcgcgccggtgaaaccacattgcccttggggtgctcgtgctccccgccgagcccccggagagggaggataaaaaaactgctgccggtggaaaaccccttgttaaccctccaccataatgggagacaaacctatatcccccattataaattactgttagaaaaaaaaaaacattctcttccagatgggcattttacaaaaaaagcccccccccataatcctcccaataaaaatttgttcccccataatattatgtgtaaaacactggtgaaaactttatcttatatgctctcccttctttcacaaaaattaggagaaacaaggcccgtatttcttcctaccaaagctcacaacatccgaaataaacctcgggaaaatatcaactacgaccgggg

SEQ ID NO: 62751 - DNA, 740 bp, Zea mays
  misc_feature: Ceres CLONE 1529370
  misc_feature: Encodes the peptide sequence at SEQ ID NO. 62752
  misc_feature (1)..(1): n is a, c, t, g, unknown, or other
  misc_feature (213)..(213): n is a, c, t, g, unknown, or other
  misc_feature (384)..(384): n is a, c, t, g, unknown, or other
  misc_feature (391)..(391): n is a, c, t, g, unknown, or other
  misc_feature (398)..(398): n is a, c, t, g, unknown, or other
naaagctggagctcaccgcggtggcggccgctctagaactagtggatcccccgggctgcaggaattcgtctcacccctagaaaaagttcgctgcgatccaaacgcgcgacgcgacttattcagcaccaccgccgcctttcattttttccttcgcatcttgagagagagagagagagagagcggaggaggagagcaaggagatgggcggcttcnaccagcaggtgaaggagcggaccaaggagctgaagcacctcaagaccgcggcgatgaagggcatcaaggcggccggcgagtcgtgcaagaaggcgtggagcaaggtcaggagcagcatcaagcgctaaaaggccctaggcgttgttgctctgctgctgcgagggggggggnagtgtgnactgtgntaaatttccccttgtggtttctgtttgtgggatctacttatgtattgtggagatacatcatgtgtgaaaatctacaaaaaaaaaaaaagaacgagaccctcggggtccccaattccccctgaagggggccgaattacgcgggctctctggccgtcgttttacaccgtactggccgggggaaaaccccggggctttccccaattttatgcgccatggaagcaagtccgcctgtttgcggggtgggggaaaagaggaaaaaagggcccccccgatacgccttttcccaacgattgggcaaggccgggaatgggggataggaaaactgatacgcgtgtagctgcg

SEQ ID NO: 62752 - protein, 46 aa, Zea mays
  misc_feature: Ceres CLONE 1529370
  misc_feature (5)..(5): Xaa is any aa, unknown, or other
MGGFXQQVKERTKELKHLKTAAMKGIKAAGESCKKAWSKVRSSIKR

SEQ ID NO: 62753 - DNA, 978 bp, Zea mays
  misc_feature: Ceres CLONE 1529373
  misc_feature: Encodes the peptide sequence at SEQ ID NO. 62754
  misc_feature (22)..(22): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (978)..(978): n is a, c, t, g, unknown, or other
gacgcagggggttcttctttcnccggcgggctcgactnnnnnnaaatcaaagaacgccacgcggctggcggcccctctcgaactagtggatcccccgggctgcaggaattcgtctcacccctacaaaaaaggcgatgaaaatgtccgcttccgttgcggccgcctcccccaccctccgcttctcctccgccactcatcctctccaccgaccgctccgccggcggctcccgtcggttcgatgctccctcgccgccgccgccggccccggtggtccggcgccccctgagctcgtcgactccatcctctccaaggtgacgggaaccgacccaggaccgctgctggccaacaatggcgccccagtacggtgcctgatgttccggctgtacctggcgctagtcctggcttgtgcgccccccctcccagtccgggggggggggggcgcccactccgataaatattaagggtggtggccccccccccgtcggacgagcgctgcccgcgccgcccgtgtcgccctcgtacccggtacggccgccttggtaccgcttccacttatcgcgccttcggtgtgccgcgcgtcgtatctcgcacgtccagcatcttccagcgtgcgaagactgccatcggcccgacccgggtccacccgaccgtgtctggcgttgtgttagctggtctcttgtatggaacattcgaaggcccccgtgtgcgaagtcatctctggttctcctacattgacagtgctcgctacgcgccgcgtggtcgaccgcccgcggaccgcgtgatcgggggagcgccgccccattctgtcgcgtggtcgccccggcgtctcgcgcagtgttattcggagcagaccccgtggtctacagacaccacaccgcgcatggttccgacagagtgcagtcgccatgttcatctgcccactgcctctctcccggacgccctcaccactatccctgctcgcattcgagagtctttacn

SEQ ID NO: 62754 - protein, 108 aa, Zea mays
  misc_feature: Ceres CLONE 1529373
MKMSASVAAASPTLRFSSATHPLHRPLRRRLPSVRCSLAAAAGPGGPAPPELVDSILSKVTGTDPGPLLANNGAPVRCLMFRLYLALVLACAPPLPVRGGGGAHSDKY

SEQ ID NO: 62755 - DNA, 727 bp, Zea mays
  misc_feature: Ceres CLONE 1529375
  misc_feature: Encodes the peptide sequence at SEQ ID NO. 62756
caaagctggagctccccgcggtggcggccgctctagaactagtggatcccccgggctgcaggaattcgtctcacccctagaaaaaaaccatacactctatctcttccttctcccaaccccgctcaaaaccctagctcaacgccacaggctcgccgactttcgcccggccgcgccggggacgatggcgaagcctcggcgcggccgctccgcgtctcgctcctcctcgggatcttcttcccgctcgctgtcccactccgtctcctccggctctgtctcgtcccgctcccggtcgcgctcccgctccttctcgtcgtcgtcctcccagtcccggagccgctcccctcctcaggctaagcgcagttcgcctggagcacggaaagggcgatcaccttcaccgccccctaaaaagggttcaccttcaaagaaagtccgttcgccatcaccaccacttaaaaaggcttcaccccctaggaaagtgtcgcctcctgctgaatcagctgttctctgcattgatcatttatcaaggaatgttaatgaggctcacttgaaagagatatttggaaactttggcgaagtggtgaatgtggagctatcaatggaccgaatggttaaccttcctcgtggctatggatatattgaattcaagaggagagctgatgctgagaaggctcttcttcacatggatggtgggcaaattgatggaaaatattgttaagtgagattcacc

SEQ ID NO: 62756 - protein, 177 aa, Zea mays
  misc_feature: Ceres CLONE 1529375
  misc_feature (108)..(177): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAKPRRGRSASRSSSGSSSRSLSHSVSSGSVSSRSRSRSRSFSSSSSQSRSRSPPQAKRSSPGARKGRSPSPPPKKGSPSKKVRSPSPPLKKASPPRKVSPPAESAVLCIDHLSRNVNEAHLKEIFGNFGEVVNVELSMDRMVNLPRGYGYIEFKRRADAEKALLHMDGGQIDGKYC

SEQ ID NO: 62757 - DNA, 699 bp, Zea mays
  misc_feature: Ceres CLONE 1529378
  misc_feature: Encodes the peptide sequence at SEQ ID NO. 62758
atagctggagctccccgcggtggcggccgctctagaactagtggatcccccgggctgcaggaattcgtctcacccctagaaaaagattttccattcgaactcgcatcatggcgttccctcagttctcccgcagagccctcggcctcctgctcgtcatcgccgcagcggccgcgatcgtctcgcccgccaccgccgacgaggtggtggccctgacggaagccgacttctagaaggaggtcggccaggaccgcggcgccctcgtcgagttctacgcgccatggtgtggccactgcaaaaagcttgcccccgagtatgaaaaacttggcgccagcttcaagaaggctaaatctctactgatagccaaggttgactgtcatgagcacaagagtgtatgcaccaagtatggagtttctgggtaccccacaattcaatggtttcccaaaggttccctgcagccaaagaagtatgagggccaacgttctgtgcaagcccttgcacaatttgctaaccgcgaaacaggtaccaatgtcaagatagctgccattccttcaagcgtcgtgggtctgacttcagagacctttgactcagttgtccttgatgaaaccgaagatgtccttgttgagtattatgccccatgccgtggtcactgcaagcatcttgctccgatttatcataagctggcttcacttttcagcacga

SEQ ID NO: 62758 - protein, 40 aa, Zea mays
  misc_feature: Ceres CLONE 1529378
MAFPQFSRRALGLLLVIAAAAAIVSPATADEVVALTEADF

SEQ ID NO: 62759 - DNA, 753 bp, Zea mays
  misc_feature: Ceres CLONE 1529383
  misc_feature: Translation starting site: 169
tccccgcggtggcggccgctctacactagtggatcccccgggctgcaggaattcgtctcacccctagaaaaaaagcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaaggagactccagaggcgcacctgttcaaggcgggggtaccggggctgaagaaggaggaggcccccctggaggtcgagggacggcaacgtccttcagatcagcggcgagcgcaacaaggagcaggaggagaagacggacccctggccccgcgtggagcggagcagcgggaggttcctgcgcaggtttccaactgcccgaaaacgcccagaagggagcggaacacggcctcccttgaaaaacggcgctgcttacacgtcactggggccgagggagggccgcccgcagcccgggaggggaacgcctttcgaaattccgggtagcgacctcggcgtgcgggtcgtttctacggctgtggtctcgaggaaccggccgttccacctccggcctctccggcaaattgacttcgtggtctacagatg

SEQ ID NO: 62760 - DNA, 630 bp, Zea mays
  misc_feature: Ceres CLONE 1529388
  misc_feature: Encodes the peptide sequence at SEQ ID NO. 62761
  misc_feature (410)..(410): n is a, c, t, g, unknown, or other
cgcggtggcggccgctctagaatagtggatcccccgggctgcaggaattcgtctcacccctagaaaaaatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtgnggtgaggctggcgctgagtatgtcgtggagtccaccggcgtcttcactgacaaggacaaggctgctgcacatctcaagggtggtgccaagaaagttgttatctctgccccaagcaaagaagcccccatgtttggttgttggggtcaatggaggacaagtaccccctcgggatgttaacctttgtttcccaatgctagcctgcacccacaaaactggcctt

SEQ ID NO: 62761 - protein, 147 aa, Zea mays
  misc_feature: Ceres CLONE 1529388
  misc_feature (4)..(147): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (89)..(89): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFGIRNPEEIPXGEAGAEYVVESTGVFTDKDKAAAHLKGGAKKVVISAPSKEAPMFGCWGQWRTSTPSGC

SEQ ID NO: 62762 - DNA, 633 bp, Zea mays
  misc_feature: Ceres CLONE 1529389
  misc_feature: Encodes the peptide sequence at SEQ ID NO. 62763
tggagctcaccgcggtggcggccgctctagaactagtggatcccccgggctgcaggaattcgtctcacccctagaaaaagctcgtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccaaaactgctccgccacgcttaccggcaaccaccggatgcgcgccgccgccgttgcgctgccggagaccaaagactggagggaggatgggattgtgagcct

SEQ ID NO: 62763 - protein, 156 aa, Zea mays
  misc_feature: Ceres CLONE 1529389
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
MAPRRLLVLAVLALAATAAAANSGFADSNPIRPVTDRAASALESTVFAALGRTRDALRFARFAVRYGKSYESAAEVHKRFRIFSESLQLVRSTNRKGLSYRLGINRFADMSWEEFRATRLGAAQNCSATLTGNHRMRAAAVALPETKDWREDGIVS

SEQ ID NO: 62764 - DNA, 753 bp, Zea mays
  misc_feature: Ceres CLONE 1529391
  misc_feature (388)..(388): n is a, c, t, g, unknown, or other
tggagctccccgcggtggcggccgctctagaactagtggatcccccgggctgcaggaattcgtctcacccctagaaaaactccgcttaccttagatgtctccgagatccaaaaacaagaacaagagcgagcagagcgtggcgacaaatcacccgctgccttttatcccgcaaccagcagcagcgaaggccgcgagaggcaggtagtagccgcacgccacatcaacccaccacggatggccggcggcggcgaccgtgacgcatccgacgcggagctccgcgcggggttcgagaccctggccgtgacgcggccggacccttccgcgggggtctacgaggtccgcctcaaccgcccggcgcaccccaacgcgcggaggcgggcggcgttcncggagatcccgcgcgccacctctctgctggaccgcgccccctcggcgcgcgccgtggtgctggccgccgcgggcccgcacttctgcgcgggtatcgagctcgggggccccgggggacccgcttgtccccgcctccgccaatcccgggccgccccgggagggccccccccccctcgtcccccgacaggcaggcggcggctccgggcctctgcgcggggccggaagccccccgttccacggggggacccgccccctggtgccggggcgggcctccaaccgcggggcccctctcgaccacgggggcctcacccgaggaccccccctctctccataaagaagggggaaatacccccctccctccccacg

SEQ ID NO: 62765 - DNA, 654 bp, Zea mays
  misc_feature: Ceres CLONE 1529400
  misc_feature: Encodes the peptide sequence at SEQ ID NO. 62766
tggagctcaccgcggtggcggccgctctagaactagtggatcccccgggctgcaggaattcgtctcacccctagaaaaatccacaatcgcaattcgcaagcccttccaacggcagtcatggcttccatcaccctcctctccctcgctcccaccgccatcttcctccacatcccggctttcacctcctcctccgtcgttggtcccggaatcctagccggccgctgggccgcgccccgcgccctcccgctccgcgcgctcccgccccgtcgcgtcaccgtcgtctgcagcagcgccgcggcggcagccgaggcctcggacgccgcagcgccagtggagaagttccggctcgacaatttggggccccagaatgtgtcccgcccggcgcccaagcgtaaaggacgcggtattgctgcaagccaaggcgcgagctgcgggttccgtatgcgcgggcaaaaatcgcgctcgggggcccggcgtccggcgcgggtttcaaaggaaggcaaaatgcgctctaccggcggctccccaagttaagggggatttgccggcgggaaaggccattgggccccggccaaaaaatgggcccattccaattttaaaaaaaataatggggcgggggggaattccaaagaaggggggaccaaaaaatccccc

SEQ ID NO: 62766 - protein, 138 aa, Zea mays
  misc_feature: Ceres CLONE 1529400
  misc_feature (75)..(130): Pfam Name: Ribosomal_L15 Pfam Description: Ribosomal protein L15 amino terminal region
MASITLLSLAPTAIFLHIPAFTSSSVVGPGILAGRWAAPRALPLRALPPRRVTVVCSSAAAAAEASDAAAPVEKFRLDNLGPQNVSRPAPKRKGRGIAASQGASCGFRMRGQKSRSGARRPARVSKEGKMRSTGGSPS

SEQ ID NO: 62767 - DNA, 731 bp, Zea mays
  misc_feature: Ceres CLONE 1529402
  misc_feature: Encodes the peptide sequence at SEQ ID NO. 62768
  misc_feature (731)..(731): n is a, c, t, g, unknown, or other
ctggagctccccgcggtggcggccgctctagaactagtggatcccccgggctgcaggaattcgtctcacccctagaaaaaaaaaaaccaacgtgcttgatctccctccgccactccatccatctcctcgctcccagtccccgggaagcatggcgtccgtcaccgcccgcgccccggtagcggcccttcgcccgtcgtcggcatcgctcaagtcgtcgtcggccttccttggccactctagccgcctcggccgcaccgcgtctcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaacgcgctgttcgtggtcgagttcatccctgttcactacgtggagatccggcggtggcaggacatccagaaccccggcagcgtcaaccaggaccccatcttcaagagctacagcctgccgccgcacgagtgccgctacccgggcagcgtcttcaaaccgctcaacttccccgcccacgcttcgaggccaaggaaaagaagctcgccacgggaaggctggccattcctgcctn

SEQ ID NO: 62768 - protein, 194 aa, Zea mays
  misc_feature: Ceres CLONE 1529402
  misc_feature (57)..(178): Pfam Name: Chloroa_b-bind Pfam Description: Chlorophyll A-B binding protein
MASVTARAPVAALRPSSASLKSSSAFLGHSSRLGRTASPTRRSLKAEAKGEWLPGLPSPSYLDGSLAGDNGFDPLGLAEDPENLRWFVQAELVNGRWAMLGVAGMLIPEVLTKAGLINALFVVEFIPVHYVEIRRWQDIQNPGSVNQDPIFKSYSLPPHECRYPGSVFKPLNFPAHASRPRKRSSPREGWPFLP

SEQ ID NO: 62769 - DNA, 652 bp, Zea mays
  misc_feature: Ceres CLONE 1529410
  misc_feature: Encodes the peptide sequence at SEQ ID NO. 62770
  misc_feature (18)..(18): n is a, c, t, g, unknown, or other
  misc_feature (380)..(380): n is a, c, t, g, unknown, or other
ccccgcggtggagagcgntcttccaccaccccatcccccgggctgcaggtattcttctcacccctagaaaaaagcgcacacacatacacaagcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgcctgctgcggctcctctcctcgtcccccgtgttcacaggggggggaggagancacggaggaggaccggtcccccctcagccccgtgtcctacctcctggtggacggcatccctcacgaggaccacttgaaccacaccgcttctggggctcacctgggcctcgacgcgctaaatttgaggcgggggataggggctggccgaattgggctcaagaagggaagtgggttccccgtccaccggtcccgaagaggcggcacagggggcaatctccgattcccacgaggaagcttgggggatagctctcccccaccataatttcgccccc

SEQ ID NO: 62770 - protein, 171 aa, Zea mays
  misc_feature: Ceres CLONE 1529410
  misc_feature (31)..(79): Pfam Name: Dimerisation Pfam Description: Dimerisation domain
  misc_feature: SWISSPROT Homolog: EC 2.1.1.150 Isoflavone 7-O-methyltransferase
  misc_feature (90)..(90): Xaa is any aa, unknown, or other
MASEVVRPSDAELLKAQADIWRLSLSYLTPLSLRCAVELGIPTAIYRHGGAASAAELVTALSLPSTKLPFLRRLLRLLSSSPVFTGGGGXHGGGPVPPQPRVLPPGGRHPSRGPLEPHRFWGSPGPRRAKFEAGDRGWPNWAQEGKWVPRPPVPKRRHRGQSPIPTRKLGG

SEQ ID NO: 62771 - DNA, 671 bp, Zea mays
  misc_feature: Ceres CLONE 1529416
  misc_feature: Encodes the peptide sequence at SEQ ID NO. 62772
acagctggagctccccgcggtggcggccgctctagaactagtggatcccccgggctgcaggaattcgtctcacccctagaaaaaacaacagcatcatggcgctcaccacgagcactaacaaccaagccttgcttgacgctcagctagagctctggcacacatcctttgctttcatcaagtccatggctctcaagtctgcagtggaccttggcatagccgacgccatccacagccacggtagcaacgccaccctgccccagatagtttccagggccgcgctccacccgtccaagatcccctgcctgcgtcgcctcatgcgggtgctcacagccgccggcatcttcagcgccgcccaccgctcgccggacgacggcggcggagagctcgtctatggactcacaccggcgtctcagctcttggttggcggctcttcaagcctggctcccttcatgtccctggtgttacaccaggtccacctgtcgccttttccttgggctcggcacatggttacagcacgaaccgctcgaaccccacccctgttttgagaagacccatggggctcacctgccctgggaccctgaaatgacccaccaacccagccccttcggccgaacctccttcaaaccaaaggttaggggtcccgccaaacagccagccctccgcccataggg

SEQ ID NO: 62772 - protein, 149 aa, Zea mays
  misc_feature: Ceres CLONE 1529416
  misc_feature (30)..(78): Pfam Name: Dimerisation Pfam Description: Dimerisation domain
  misc_feature: SWISSPROT Homolog: EC 2.1.1.146 (Iso)eugenol O-methyltransferase
MALTTSTNNQALLDAQLELWHTSFAFIKSMALKSAVDLGIADAIHSHGSNATLPQIVSRAALHPSKIPCLRRLMRVLTAAGIFSAAHRSPDDGGGELVYGLTPASQLLVGGSSSLAPFMSLVLHQVHLSPFPWARHMVTARTARTPPLF

SEQ ID NO: 62773 - DNA, 935 bp, Zea mays
  misc_feature: Ceres CLONE 1529417
  misc_feature: Encodes the peptide sequence at SEQ ID NO. 62774
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (935)..(935): n is a, c, t, g, unknown, or other
ccgaacccccccctccctnntnttnnnngggccccnnnnnnaacccaggaccccacgcggtggcgggcgctctaaacctaatggatcccccgggctgcaggaattcgtctccccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgaattctctttttccacccccccccccggggggggcgagggggggggccacccaacccccaaaaaccttccccccagaaactcccaaagataggaaacgggaaccaccttcccccatggggcccgaggctttagacgccaccaccccgtcggacgacttatcccccgaaggcatgcacctatccagaaaaaccaacttggtcgagataccccgcgacaccgtccgataacacggcccactcaagcgcgcccgcattcgcccacaatccactccgacagcgacacgcgcgacatccgggagacagcacccgcgacgcccacaacccgccatccctagaaccacacgcccgtaaaccacgacaatacgtcatcgatcccgtagtcgtaccccatagtcctatgtactgcagcctcgccgcttcttcgcgagctcccgtctaacgactccgcatcgccgtcgtccgcgccacgccctcaagaccacagacaaccatcacagatactgcacaacactaacctaccactctgctcctctaaccgctcctctan

SEQ ID NO: 62774 - protein, 93 aa, Zea mays
  misc_feature: Ceres CLONE 1529417
MAISSTAMAGTPIKVGSFGEGRITMRKTVGKPKVAASGSPWYGPDRVKYLGPFSGEPPSYLTGEFSFSTPPPGGGEGGGHPTPKNLPPRNSQR

SEQ ID NO: 62775 - DNA, 798 bp, Zea mays
  misc_feature: Ceres CLONE 1529418
  misc_feature: Encodes the peptide sequence at SEQ ID NO. 62776
  misc_feature (357)..(357): n is a, c, t, g, unknown, or other
  misc_feature (359)..(359): n is a, c, t, g, unknown, or other
  misc_feature (367)..(367): n is a, c, t, g, unknown, or other
  misc_feature (368)..(368): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (375)..(375): n is a, c, t, g, unknown, or other
  misc_feature (376)..(376): n is a, c, t, g, unknown, or other
  misc_feature (378)..(378): n is a, c, t, g, unknown, or other
gctcttaactaatggatcccccgggctgcaagaattcgtctcacccctagaaaaaaatgcgcgtcgggccgcgtcgacatagctgcttgccgccgacacccgcagccgcaatggccgtcgcccactttccgccgcggcggggggtgctccccctcctgctcgtcgccgcgctcgtggcggcgctgccggccacctgcgccgcggccaggagcaaaaaatcttacacggccatcttcagctttcgggactctctctcccacaccgggaacctcatcgtcaacggaattttttaatgggctcaccaacgcgaggtcctccccacggttaatttccttttcctaacaaggggaaaaagananggggagannaannntnntnttttttttttaaccccccctaataaaaaaaaataaaaaacttacacactacccggggagggggcgaatagccaaaagttataataaattttcttaaaatggtctacaaaacatcttcccttttataaattggtcaatctgaaacaaaatataataactcccttatatttaaaagtgtaaataagtaatacctatctaactatatacagattataaaatcaaattcttttcaataaataattatagtgtatatatgcttccacattaacacataagaaaattaaccctcatatcaaaccattataatacaaaaaattatcattgcatttacacatttaaaaatattatacattcttactcctgatctataaatccacagttgtaaataataaatatttaattctacctaactgattatttg

SEQ ID NO: 62776 - protein, 60 aa, Zea mays
  misc_feature: Ceres CLONE 1529418
MAVAHFPPRRGVLPLLLVAALVAALPATCAAARSKKSYTAIFSFRDSLSHTGNLIVNGIF

SEQ ID NO: 62777 - DNA, 770 bp, Zea mays
  misc_feature: Ceres CLONE 1529421
  misc_feature (13)..(13): n is a, c, t, g, unknown, or other
  misc_feature (37)..(37): n is a, c, t, g, unknown, or other
tttttttttttanttttttttttattattatacaaangccttacatctcgacattttaaaactggagctccaccgcggtggcggccgctctagaactagtggatcccccgggctgcaggaattcgtctcacccctagaaaaagtttatgaaatggatgaacttgaggctcttgcaagaaatatttcatttgaggatgaagacctagatgatgatgatcatgatgatggacctgaggcatcgttgtaagcttgttgatgaagatctagatgataataatgtaccatgaatgctatgaatgtttcttattgtatttgctctgtaatgttttgtgaccttgcgaacttgggacttgtggctttgtgaactttatgatgaacttgttatattgtgttaaaaaaataaagaccccaaaaaaaatgacaacatcccgccgacaacttcacgggaaagtcataaaaaaaatcgagacgctgcaaggtacccaattcgcccatatagtgagtcgtattaacgggcgctcactgggccgaacgttttacaacgtctgtgacgtggaaaaaacccctggagttaaacccaaccttaagcccccctgggtagcacattccccccttttcccccagctgggggggaaataaccgaaaaaagggccgccccacatttggccccctttcccaaaaagagttggcccacaacccccgaaagcggccgaaatgcgaaaatttggtaaagcgcggttaaaaaattttggggtaaaaaaactcccgcg

SEQ ID NO: 62778 - DNA, 717 bp, Zea mays
  misc_feature: Ceres CLONE 1529424
  misc_feature: Encodes the peptide sequence at SEQ ID NO. 62779
ggagctccccgcggtggcggccgctctagaactagtggatcccccgggctgcaggaattcgtctcacccctagaaaaaacttcccccctcatctctctccgttcattccctctctcatgcgtgcttgggttgggttgggtatagacagttcttgcagtccacaccacctcaagtgagggggtgaccccccaccctcctccctagcgctcctcaccgccatgctgccaagaaggcagagcatcttccacctcggggaggagggtggcgccgccgccgtgcaccaccgcgtcagcgtcgtcggagcggcgtcttcgtccatggccatgggcggcggccggcgtgctcgctagcgtcaccgcctcgtgcggggggtggagatcctggtgcaccaccaccaccacggccggcacgggcacgggcacgcgcacgcggcgaacgtattccctgaaccaaatggtgaggccgcgcgccgccgtcgccgccgcctctgggtcacacaacggtcaggcaaacactccttctctagaagttttctcaaagttcttgctacctctgcaagctggaactttaccctcaacatgtgctttctatatgaaacaaaaggtaaccaagtgtttttccacctaacgaatttcctcttggctagtcatattattgagttcaacgaaggcctcaccaacctcctaggtctcctttcttttcaattcatcaataaat

SEQ ID NO: 62779 - protein, 43 aa, Zea mays
  misc_feature: Ceres CLONE 1529424
MLPRRQSIFHLGEEGGAAAVHHRVSVVGAASSSMAMGGGRRAR

SEQ ID NO: 62780 - DNA, 719 bp, Zea mays
  misc_feature: Ceres CLONE 1529426
  misc_feature: Encodes the peptide sequence at SEQ ID NO. 62781
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (28)..(28): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (54)..(54): n is a, c, t, g, unknown, or other
nnnnnnntttttttcctttcctccctcnagtgtattnnnnannnngcgctcntnccaccgcggagctccccgcggtggcggccgctctatactagtggatcccccgggctgcaggaattcgtctcacccctagaaaaaccggtcggtcccgagcgacacaacagacagaggaggaaggagaaggatatgggaggcgaggcgggaatggggctccgcgtccgcgcctcctccctcctgctgtcactggtcctcgagctcgccgtcgcgctcgtctcagtgtcggcgcagcacaagttcgggatcaactacgggcagatcgcgaacgacctcccggacccggcgcaggtggcgacgctcctgcagtcgatgggcgtgaacaaggtgaagctgtacgacgcggacccccgggtgctgacggcgttcgccaacacgggcgtcggcttcaccatcgccgtgggcaaccaggacctgcaggcgatggcggccagcccggacgcggcgcgccgttgggtggcggcaaacgtgcaaccctacgtcccggccacgcgcatcacctgcgtcacccgtcggcaactaagtcccggtcgggcaaacgacaccagcgggcgaatggcccaaccctgctccccggcccatgaaggccccgatggccacgcccgtcgctttccggcgaaacgcgggggaccttcgggaccaagactcgggatacttcctttttt

SEQ ID NO: 62781 - protein, 171 aa, Zea mays
  misc_feature: Ceres CLONE 1529426
  misc_feature: SWISSPROT Homolog: EC 3.2.1.39 Glucan endo-1,3-beta-D-glucosidase
MGLRVRASSLLLSLVLELAVALVSVSAQHKFGINYGQIANDLPDPAQVATLLQSMGVNKVKLYDADPRVLTAFANTGVGFTIAVGNQDLQAMAASPDAARRWVAANVQPYVPATRITCVTRRQLSPGRANDTSGRMAQPCSPAHEGPDGHARRFPAKRGGPSGPRLGILPF

SEQ ID NO: 62782 - DNA, 970 bp, Zea mays
  misc_feature: Ceres CLONE 1529434
  misc_feature: Encodes the peptide sequence at SEQ ID NO. 62783
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
ctcccttctctctcatttttnncccnnnnnnggcgctannnnnnccccctggagctccccgcggtggcggccgctctagactagtggatcccccgggctgcaggaattcgtctcacccctagaaaaaaaaacacccacttcacctccgaccacttcacctccgatcccgccaccactacccaccctttcctttgacgtcccgatggcacctgtagatctaacccccaaacagcccaggaaggcctacggcggcgacggcggcgcctactacgagtggagccccgccgacctgcccatgctcggcgtcgcctccatcggcgcagcctagcttccccctcgccggcgggcggtctcgcgctccccagcttactctgacgtcggccaaggttcgcctacatcctcctggtgcacccgcccccccggggggggggggggggggtggaaatcgcatcaaagagtcaaccgtgggtccccccctcgaaaggtgtggacgatcccacctcggcagcccgggtctgcggggggggcggcgggtctctcgtcggggtcgcgagtgacccccgtccctggatgcttctgaggcgggttaaaggaggtggtgcggtcgtcggagcggcggcgacggtcgttctccgcccgctaggggaccttcaccatggactgctcgcgcgtgatgctctcacctgcgcgcgacacgcaggtttgatgcgagacagcgccagacgctcacgctcacctgctcgcgggagacggacgtatcgctttacagttaagtcgtttcgcggtgtctcctcctgcgtgcaggtgtcttgcggtcgtcgcgctgacttcggatattgtcgcggtgcaacgtccacgctgcagcctcgcgtgcccacagtcgtgatgggcatgggccgtggcgggcgtcaggtcttagtaggaccactctgctcattgctcatgcgtgaccgcgctcagtcggctcggt

SEQ ID NO: 62783 - protein, 41 aa, Zea mays
  misc_feature: Ceres CLONE 1529434
MAPVDLTPKQPRKAYGGDGGAYYEWSPADLPMLGVASIGAA

SEQ ID NO: 62784 - DNA, 747 bp, Zea mays
  misc_feature: Ceres CLONE 1529440
  misc_feature (747)..(747): n is a, c, t, g, unknown, or other
aaaactggagctccaccgcggtggcggccgctctagaactagtggatcccccgggctgcaggaattcgtctcacccctagaaaaatttaagtatacccctcccggggaaagaagagtaggacaaaagatatggaatacaatacaaaaaaggatctttatttattctttccttcctttatccctattcatacagaattcctcatgaactaatgccaaattctttccatttattaattgctataacgagtgatttattccaatattaagttattaccgaacaaagcaaaattatattatataaaggatgagatcaattcggaagcgcttttttgttattctagcagacgtaattgctttggtctaattcccggctttccgagggggggggatcttatctaattctatctatgcccaaaggatgataccgaaacgaaacaatcctttccttttttctgatcataaaggagccctatgaacctaaggtttcatgtacggtttttgaaaaaccgggggaaccgcgatgttatcctccaccatgataatctaaaaagtcaagtacccgtgaaatactggaaacacactccacaaatgggtttttttggaaggaacctttggcgtccccccaataggtttccaagtattctaataccctctttgggaaaaagggaaaaaaacccccttgatttcccccaagagcaaaaagaaatttgtggccgggtttcccaccccaggattccgcggataaan

SEQ ID NO: 62785 - DNA, 911 bp, Zea mays
  misc_feature: Ceres CLONE 1529441-R
gacctcgcgcgtctcggaggtgacggtatcgaggatgaagatgttttaatcttgtcagtcgacccggtgtgtcttgcacagaactcagtgtctgctgaacacaagagaacaggagtacgtcgcatagaacttcgctgcggagccgtctctccgattcacctgcagctgacttctttcttggcgaagctacgctgcggccccggcttggggcttaagagaattttgggaaagccattccccgtcctttatgtaacagagttagggaataggcagctccgtcaagttggtgtttttctgaagctaaaaaacttccagccttgacattcaacttaagtgatacaggcccatctcctaaggccttcaccggaagggacggttcactgtcggaaggattgaggggaccccccggttggaggttagggggtggtggttcctgtccctctttcaatccaccgcgcccgaggggtttttgactcaattgtggaaaccgggcggacggccgttgatgcattgggactggaaaggccccgggggttggtggagacttgggttagggcggtagaaggcgctttttcggaagccccggaccgaaggtttgggccccggagagcgaatttcttgcccgcggcgtgcgcgaaacccgccggcccggggccttggggcgggcagacaattgcggaggagccccctaaggggtgggggccgctcgggggcggagctctttatgggggctccagaaagttgtgagagcggggagtattcctcctgggggtcaacggggttccaaggctctgggctgaccggctgggggaggcgcgctgccaacacccgttgtatcattaggggcgggagaagtcgccaagactggaggtgtggggggggcttccctgcgggttggggggcgtatgcgg

SEQ ID NO: 62786 - DNA, 458 bp, Zea mays
  misc_feature: Ceres CLONE 1529441
  misc_feature: Encodes the peptide sequence at SEQ ID NO. 62787
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (64)..(64): n is a, c, t, g, unknown, or other
  misc_feature (65)..(65): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (101)..(101): n is a, c, t, g, unknown, or other
  misc_feature (298)..(298): n is a, c, t, g, unknown, or other
ttttttttnnnnnnnnnnncaaaatccccccccctcctgatctatataatatagaaagtgtgtnnttccaattnnnnntaaagctgggactccacgtcggntggcgagccgcttctaaaactagtggaatcccccagggctgcaggaattcgtctcacccctagaaaaaacataaccgcagtccgcagccattggaaatttccgcttcatggcgtggatcctcgtagaccccgacccgcgtgcactcaatccctaggcggcggcctccggcgcgaggctagcgggcggcacccatggncgtccgtggcggaagctccaaggaaaaaagcaacgcccgccaggctaaccgggggtcccggtggaaaactcccctggccccccaaaaacggccccttcccgggcccaaggggggccccgggggaaaaaaaaaggcttcccctttcggaaaaaaccccgga

SEQ ID NO: 62787 - protein, 55 aa, Zea mays
  misc_feature: Ceres CLONE 1529441
  misc_feature (2)..(2): Xaa is any aa, unknown, or other
MXVRGGSSKEKSNARQANRGSRWKTPLAPQKRPLPGPKGGPGGKKKASPFGKNPG

SEQ ID NO: 62788 - DNA, 645 bp, Zea mays
  misc_feature: Ceres CLONE 1529442
  misc_feature: Encodes the peptide sequence at SEQ ID NO. 62789
cgcggtggcggccgctctagaactagtggatcccccgggctgcaggaattcgtctcacccctagaaaaaatccccttcctattctgctttcccctcgctccagagtccagtccccagacgagcggttggagcttcgacgtgcggtttccatttccttccctgctctgatggccgtcgccgaagtggcgatcgagattctcccgcagcagcagcagcagccgccgccgccgccgccgccgcgagaaccggcggtagcgcccccgaacctctccgtgccgagagtgctccactatctgtacctcttgagcgcttgggtcgactgcgcgggcgtggctgccgggaccgtggcgcgcctaaccttgggcgactcttccccgttggtctacaggttccttaaaccccccatcggaaacctcgttatcaccgcgcctgcacatctcccccttcacccagctagatcctgctcgctatgctcgcgattggggtctctaaacgtctcctccgtcaatctcggccacgcgacattccgcatccgataacccccgacattagcacctagtagccgttaattcccgcaatagtggtagccacggaaccattaaccgtggatccgcgtagggcctcccaatcactctccctatttcc

SEQ ID NO: 62789 - protein, 123 aa, Zea mays
  misc_feature: Ceres CLONE 1529442
MAVAEVAIEILPQQQQQPPPPPPPREPAVAPPNLSVPRVLHYLYLLSAWVDCAGVAAGTVARLTLGDSSPLVYRFLKPPIGNLVITAPAHLPLHPARSCSLCSRLGSLNVSSVNLGHATFRIR

SEQ ID NO: 62790 - DNA, 871 bp, Zea mays
  misc_feature: Ceres CLONE 1529448
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (764)..(764): n is a, c, t, g, unknown, or other
nnnaaaacggaaggannnnntttttnnnnnnnnnnnnnnnnaaaannnnngcaaaagtggactccacgcggtggcggccgctctaaaatagtggatcccccgggctgcagggattcgtctcacccctagaaaaagtctccgtcatttctatcagacgcaagcagcagtgacgccgcgctacccgaccaaaatccgccgccggtgcccagaactcgacgggaaaaccggggctttggtcgccggacgccggctgcctcgagatgctcgtgtgggcggccaccgcgtcaccccccagcactccatccgccgtgccatttgctccctccccaccgcgcctccgctccccggccagcgagcgcctcttttgccggctcgctcccggggttggctgggccccggagccagatcacctctgttcttttctgccgcccccttcaggaggggggggggaggtctaggcaaggaacccttaacaacggcccccccgcagccggagcacgaagggaccaaccggccccggtagcaaatgggagggggccctcggccgctttccccttctcttccttccgcccggtcctcttaaaggggctacaaaagcgttcccgccccttctttcagtgtaacctggggaccctccccggcgagcaaaagaatcggtatgctatactctcttaaagccgccccggaaaggaaaaaagggcgtcaactctatgtaaccccaactcctgcgctgagccccccctggacacttctcttcttaactnatccacgcctctccgcaccctcacaagaggtggcggcccgccgccagttcgtatcgaggcgcgcgcccgaaaattgagagagacctccgtgggcctgtagtcatgcc

SEQ ID NO: 62791 - DNA, 641 bp, Zea mays
  misc_feature: Ceres CLONE 1529449
  misc_feature (1)..(1): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (249)..(249): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (534)..(534): n is a, c, t, g, unknown, or other
  misc_feature (535)..(535): n is a, c, t, g, unknown, or other
ncccgggaactaaatatttaatttatagagacaaaggggggcccccggggcgccgtctgagggtgtaccccnnnnggaggnnnnnccaaaatgggactccccgcggtggcggccgctctataactagtggatcccccgggctgcaggaattcgtctcacccctagaaaaaagcatctcaagccaccatcgaccttcaagtctcgctacgtagcagtgcaataaaaaaagcagccgcaatggcggagcangcaccatgggcccctctcccctccaacggggcccttttcggccccgggcaaaaaggggcccccgttgaaaaacagtgtggccggtccgtccgttcccgccctttcgggggaaagggccccccccccttttgaacaaaaaattcccccacaaaaaaaaaaggggggggggccctaaaaagggggcccacaaaaaggggnnntccaaaaggggggggggggggctttctcccgcggggggagaaaccccccccccggggggtgaaaaaagaggggcccccccccccnncccccacaccccgcgggggggttttgatctacaccacccgggggggggggccccccccccctccttttttgccgccgggggggggaaaaaaagcacacccccacct

SEQ ID NO: 62792 - DNA, 719 bp, Zea mays
  misc_feature: Ceres CLONE 1529451
  misc_feature: Encodes the peptide sequence at SEQ ID NO. 62793
tggagctccccgcggtggcggccgctctagaactagtggatcccccgggctgcaggaattcgtctcacccctagaaaaaaatcccttccccggcagacggcagtcgcatcgcatcccctccgcctcgttccttgctcggctcgccccaacttcgctcccggccgccgccgcattcccctcggctactcgctccccggtgatgtctggcggtaacgcgtggtcgccactgccttcgcacggatttggatccgagtctagcggcatggcgaatcgcgccggcgagcctgtggcgaggaccaacagcgatggcggcggcggcggcagcaaggactcgggcagcttcgagtgcaacatctgcctggacctggcgcaggaccccgtggtcactctatgcggccacctcttctgctggccctgcctctacgagtggctccacgtccacgcgcactctcaggagtgccccgtctgcaaggccgtcgtcgaggaggggaaactcgtccccctctacggccgtggtggcagctccgccgtaccccgtgcaaggtcggtggccggtgtggaaatcccgagcaggccgaccgggcagcggccctccactgccccgcagccggaccacattaccattacccgcaccagacccctggttcatggtgctggcgcccccctgtggctatggtaggtgggggagtacactttctcgccgcatcggagggctgtcc

SEQ ID NO: 62793 - protein, 159 aa, Zea mays
  misc_feature: Ceres CLONE 1529451
  misc_feature (50)..(90): Pfam Name: zf-C3HC4 Pfam Description: Zinc finger, C3HC4 type (RING finger)
MSGGNAWSPLPSHGFGSESSGMANRAGEPVARTNSDGGGGGSKDSGSFECNICLDLAQDPVVTLCGHLFCWPCLYEWLHVHAHSQECPVCKAVVEEGKLVPLYGRGGSSAVPRARSVAGVEIPSRPTGQRPSTAPQPDHITITRTRPLVHGAGAPLWLW

SEQ ID NO: 62794 - DNA, 647 bp, Zea mays
  misc_feature: Ceres CLONE 1529453
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaattaagtgttggaaatcctggataagcgaggagtgtctacagctattgttcctgctggtcactgtaggacagtagcagctagacatacttcataaaaaaatagatatggtacctgtctctatcttgttttagattgtagatgtaatcttgattgaaactgccaagatttgtagaacaaagcctcactgtttcgtttcccatcacaaatatgaaatatgagacgcggaagtgatacgagtgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaa

SEQ ID NO: 62795 - DNA, 836 bp, Zea mays
  misc_feature: Ceres CLONE 1529460
  misc_feature: Encodes the peptide sequence at SEQ ID NO. 62796
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (325)..(325): n is a, c, t, g, unknown, or other
  misc_feature (335)..(335): n is a, c, t, g, unknown, or other
  misc_feature (414)..(414): n is a, c, t, g, unknown, or other
ataaaactcatcctttcctttctctatccactatnnnnngcaatanaaacaaagctgggactccccgcggtggcggccgctctagactagtggatcccccgggctgcaggaattcgtctcacccctagaaaaaaataatcctgccccctcgccagtcgcgaaaaccctagccgccgccagaccattcgtttctcgcgagccatcgcttctgcatccggaagaaatggccaagtcgaagaaccacacggcgcacaaccagtcgttcaaggcgcacaagaacggcattaagaaacccaagcgccaccgccagacactccaccaaggnggatggactncccaagttccttggaggaaaccctggagggtattccctaggtaaaggggcaaaccaaaaagaagggggtgaaggcctgnaaagccctgaaggaacataagggaaagggaaaaagccctgggcttttgggtcttttcccccccccggggtttttataaaaaccgacttaacaaacaaaacactcgtccgatacaggtctgaccaataagcgttgtaccacacacacctaccctgcaaaataccttccgctttacactgtccatccatcccaaacaactactcccatcctcacccaaccgacaccaagacaccacaacatacaccgccatggttactatacgccatagtagccacacgtcaacctacccccgcaccacactctatttatatataatatggagatgtcatgatagagacacgcacacgacgccactggtatctctaatcatttcatgacaattcacgaacgcgatacaacactccgccttctgcacaccctctc

SEQ ID NO: 62796 - protein, 51 aa, Zea mays
  misc_feature: Ceres CLONE 1529460
  misc_feature (3)..(45): Pfam Name: Ribosomal_L29e Pfam Description: Ribosomal L29e protein family
  misc_feature (38)..(38): Xaa is any aa, unknown, or other
MAKSKNHTAHNQSFKAHKNGIKKPKRHRQTLHQGGWTXQVPWRKPWRVFPR

SEQ ID NO: 62797 - DNA, 901 bp, Zea mays
  misc_feature: Ceres CLONE 1529462
  misc_feature: SWISSPROT Homolog: EC 4.1.1.31 Phosphoenolpyruvate carboxylase
  misc_feature (1)..(1): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (74)..(74): n is a, c, t, g, unknown, or other
nataaacgtgtttccccttcatccnnnnnnnnnnccctttnnnaaacacatggactccccgcggtggcggccgntttccactagtggatcccccgggctgcgggaattcctctcacccctagaaaaattctgcttcggggaggagcacctgtgcttcccgactctgcagcgcttcacggccgccacgctggaacactgcatgcacccgggggtctctccaagcccgagtggcccaagctcatggaccagatggcggtcgtggccacggaggaatcccgctccttcgccgcccagggagcccccctcctcaagtacttcctattcccccccccggaggaccgtgtccggcaggcagatcttctcgcctcgcgcccgccaagttcgaccccctgcttctttttttccccccccccccgggggggggagaggggggggcctcccccccctccccccttctaccctccctccttccccttcctcccgcccccgcttctagggctcctctccgccccgctacccactcctcctcccctccgaatacagcttctgcaggtcccttccgcccctttcgtgtctccccactcacgcgttctgtgcctccgccccactccccttaagctgggtccctccccccatcctttttctccgcgcccctctttcttcccctcccattgctcacgaacgccgcacgcgttgggcgggccccacgccccctgtcatcgcatcgtctccacgcatacattccccgcgtctccacccctaactgtgcgagtccttccgcatccgccccctcctcgcgcctttcatgtctctctgatgtactacacccctactctccgctagtttcgcgtcgtctcctttcccgtgcaccagacggttctcttccctgctggtgcatctt

SEQ ID NO: 62798 - DNA, 681 bp, Zea mays
  misc_feature: Ceres CLONE 1529467
  misc_feature: Encodes the peptide sequence at SEQ ID NO. 62799
atagctggagctccccgcggtggcggccgctctagaactagtggatcccccgggctgcaggaattcgtctcacccctagaaaaaaatccctccgtcgctcgctccaatcatccccaccgcttcaccgcccgcgccacccaatgtcaggcgacggcgacgcgcgcggcctcgaggcagcggcggccaccgcggcagaggcggcgcgggagctgcgcgaggcggccgcggccctcgtcgccacccgcgccgctgaggaggacgcgctgcgccgccgcgccgtggcgctcgaagccgacgtccgccgcctccaggcctcgctccacgccctcgatccctccacgctcgacaaggtcgaggaggaattggagcgtgccagggtggcaatcacggatagtgatgtggcttcgtttcttcccagcaagcggaatggcaagtttcttaaaacatttctaggccctgtgaatgtgcgggtggcgaggaaggaagataaactccaaatccaggatgagtacaccaattatagggatagggacagcccaataagtttctggtaatttcccatctatccttcctcctactggagaagggggggaatattggaatgggatgcccttcccaccattggcttgggttcaaatttttacccaaggcttggggttacctaatacctcggtaacacag

SEQ ID NO: 62799 - protein, 137 aa, Zea mays
  misc_feature: Ceres CLONE 1529467
MSGDGDARGLEAAAATAAEAARELREAAAALVATRAAEEDALRRRAVALEADVRRLQASLHALDPSTLDKVEEELERARVAITDSDVASFLPSKRNGKFLKTFLGPVNVRVARKEDKLQIQDEYTNYRDRDSPISFW

SEQ ID NO: 62800 - DNA, 808 bp, Zea mays
  misc_feature: Ceres CLONE 1529468
  misc_feature: Translation starting site: 201
  misc_feature: Pfam Name: ALAD Pfam Description: Delta-aminolevulinic acid dehydratase
  misc_feature: SWISSPROT Homolog: EC 4.2.1.24 Porphobilinogen synthase
attccttcaattaatttttaacaacgtccccccccagtacggaaaagtgggactccccgcggtggcggccgctctagaatagtggatcccccgggctgcaggaattcgtctcacccctagaaaaagaggccacaggattagcagcttctccgtgctgctgcgtctcctcctcatcgtcctctccagtgtccagctcggccatggcgttcaccgtctccttctcccccgccaacgttcagatgctccaggctaggagtggccacggccacgccacctttggaagctgttccgccgtgccaagagccgggccaaggctgcgctccacggccgtccgggtcagcagcgagcaggaggcggcggcggccgtcagggcgccgtccgggaggaccatcgaggagtgcgaggccgacgccgtcgctgggaagttccctgctcccccgccgctggttaggccgaaggcccctgaaggaacgccggagatcaggccccttgacatgggcaaagcgccccccgtcgcaaccgcaaatcacctggctcttagggctgccttcccaggagacgagcatctcgcctgcctaactttgtgcttccattgtttatccctgaaggagaagaaaaagctcctatcggaactatgccagggtgctaataggcttgggtggaaggcacgggctgctttgacaaggtttaacaagggcccgcgaagttgggtggtaaaaagtttgggttctcctttcccaaaagttccccaaggcaattgaaatcttccaacagggaagattaagccgttacacccaataatgggctc

SEQ ID NO: 62801 - DNA, 712 bp, Zea mays
  misc_feature: Ceres CLONE 1529470
  misc_feature: Encodes the peptide sequence at SEQ ID NO. 62802
  misc_feature (1)..(1): n is a, c, t, g, unknown, or other
  misc_feature (51)..(51): n is a, c, t, g, unknown, or other
  misc_feature (59)..(59): n is a, c, t, g, unknown, or other
  misc_feature (585)..(585): n is a, c, t, g, unknown, or other
  misc_feature (586)..(586): n is a, c, t, g, unknown, or other
naaaattatattgattaaaataaaaataataaaaaagaaaagattttaaangggggtgntcctaagctggagctccccgcggtggcggccgctctagaactagtggatcccccgggctgcaggattcgtctcacccctagaaaaaatcgcagtccccattactgcactgcgctctgtcgcctcctcgctgctccgatccagcaagagcaggaagtacagctccatccgcgcgcagggaggtcagaatggagttcggtgggctcatcatctcgctgccgctgctcatactcatcatccatcgtcgccgttcgtcctcctgcaatcatcctagcccgccttagagccccgccttttgaaacctccttccccggaaaaaaaaaaggagggtttaaaacccccccgggccgcgatcttttgagaaattgtgggaataaactggggggaattcccccccccccctaacccctttttttcccccccttgggggggtttaaaaagggcgtcgaaattttgtgaaaaatttgtgtgaacccgcttaacaacacgcccttggggacccccttgataaaaataaaaaaacacccnntctgccctctcaccccccccccctcccccacctttctttgatttgttaattcccacttccctcagagggtagtctagaaagaaatactatatgggcgcgggcctcacaaacaaaccatgagagaag

SEQ ID NO: 62802 - protein, 31 aa, Zea mays
  misc_feature: Ceres CLONE 1529470
MEFGGLIISLPLLILIIHRRRSSSCNHPSPP

SEQ ID NO: 62803 - DNA, 744 bp, Zea mays
  misc_feature: Ceres CLONE 1529482
  misc_feature (114)..(114): n is a, c, t, g, unknown, or other
gctctagaactagtggatcccccgggctgcaggaattcgtctcacccctagaaaaactcctgctccctccaacggacttgaccactaaaagctaagcacacccccggccatggngctcgcttccacctcttccaccgggccgggtggcgtgctcaagaccccgttcctcggtgccaggcgcgcgctcgccaatgccgtctcgccccaaacccgcgccgcgcctcgcgctcctcttcgtcgccgcggccccctcctttttcccccgaacggcgggttgatgagccaccccgtttttttttatccgactcttctatatcaatcctctcttttttccccccccccccgggggaagaaaggggggttctttttttttctttttttcatctcccctctcataccacaacttttcttctatgtccccgttgttttcaatctccttctcttccccccctccctttatctcttcctctcctcttcctttctcttcctctcttccgtctctttttttcctcttttccttaccccccctccctgtctcctacctctcctctcctatctccatctctcaaccaatctcctctttacaccgtcttgaactccttacacggattttatttccctcgtccattctcctattcctctcccttctcgcccctccttcattctctatactctcctctctcctccacccctccactttttcacctccttcgctcctttctcccctcctcgtctccacccccg

SEQ ID NO: 62804 - DNA, 666 bp, Zea mays
  misc_feature: Ceres CLONE 1529489
cgcggtggcggccgctctagaactagtggatcccccgggctgcaggaattcgtctcacccctagaaaaactgaaacggcgaaatggcgcggctgtatggcgaccgaatcgcgcagttttgcagcctaaaaatactatgtatgcatgcatcctaatttcgttgtgaccttgtggtgatagagtgattcatttcgatagcgatcctgtactattgtaatacatgtagcactaaattctcttattatcgttgtgcactgcgttgtgttgtgttctacatagattgattcagttagatgacattagtgcctctaggcaagtgtttaaattgggcaccgtgtacatgatctgaaaacaaccatatatagagtcagtaaaagcagctgttcataagcatgatggaaaaaacaaagagtaaccgagacgctcgaggtacccaattctccctatactgagtcgaattacgcccgctcacgggccgtcgttttacaaacgacgagaatgggaaaaccccggcgttacccacttttaatcgccttggaggacatccccctttcacccactggtttatttactaaaaaagcccgaaactaatcgcccctttccgaaaatttgtttaaccccaataggccaaaaggaaaattcgaaagcccttaaaatttttgttaaa

SEQ ID NO: 62805 - DNA, 848 bp, Zea mays
  misc_feature: Ceres CLONE 1529494
  misc_feature: Encodes the peptide sequence at SEQ ID NO. 62806
  misc_feature (1)..(1): n is a, c, t, g, unknown, or other
  misc_feature (36)..(36): n is a, c, t, g, unknown, or other
  misc_feature (47)..(47): n is a, c, t, g, unknown, or other
nttttgtattgttatgtctcttactcataataacanccgggggcgangtggttaaaactggaactccccgcggtggcggccgctctattaactagtggatcccccgggctgcaggaattcgtctcacccctagaaaactccgccccacgcagctgaggagctgatcctcaccggcgtcgccatcgtaatcgccttggacagcggcaccagaacctctgcctccgcagggtgcttgctggtatcattacaatctggtagttttagtggttgggcttgacttcctactattcagaaacacagtaccgagaagtctttaggtggggtcaaagatggtgtcgctgatgttgcaaaagcgcctttgccgcgagctacctcaagtgtgggaaagggaaggtgtggggctttgacccccaaatgaaagttagtgaaaatctccccggggcaaaactccccggcccaaaataattcccggaaagtttgggttaaaaggacggggttttttaattatccccagaaagaccctctataaagaatacccccctcccccaaaaatcccccgggggcaaaaaaaaggggcgcacctatttgaaccgcccccaaggtccaaaaaaggggaaaccgccccccccctccaggaataattggggacaaggccgttaagggggggaaccccagggggaggggttatgggcttaaccccacccaagggggttcttgtgggataaaaaaaaaaagagaaaccccgggggcacctaaaacccccccctttccccccccaagaataatctgggggggcccaaaaaaaaaattgggctaaacccccctggtttttctgggaccattgtgcc

SEQ ID NO: 62806 - protein, 30 aa, Zea mays
  misc_feature: Ceres CLONE 1529494
  misc_feature (12)..(12): Xaa is any aa, unknown, or other
  misc_feature (15)..(15): Xaa is any aa, unknown, or other
FVLLCLLLIITXGGXVVKTGTPRGGGRSIN

SEQ ID NO: 62807 - DNA, 761 bp, Zea mays
  misc_feature: Ceres CLONE 1529495
  misc_feature (201)..(201): n is a, c, t, g, unknown, or other
  misc_feature (204)..(204): n is a, c, t, g, unknown, or other
  misc_feature (206)..(206): n is a, c, t, g, unknown, or other
  misc_feature (210)..(210): n is a, c, t, g, unknown, or other
  misc_feature (224)..(224): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (236)..(236): n is a, c, t, g, unknown, or other
aagctggagctccccgcggtggcggccgctctagaactagtggatcccccgggctgcaggaattcgtctcacccctagaaaaacccaattccttccccacctcctcggtcgtcgcctcccccagagagcaggagccgcctcgtccctgccggtcccgaccccgacccccatcccgtccgcgtccaacgccatgaatcccgnagntnacgntactcacctgcttnccnnnnnnnagngggggggggggggggggccccccccatcctctttttttgttatggttggagaagacaaaccccaacccatgaaattaatatgtggttgttatttgtaatacgaacaaacaacgaaacacaaaggaacacaaaatgccaaacacaacaaaaaacaatataacaaagagaactaattaacagaacacaaacgactgctacgtgtctcaaatttgtctgatgcttcgaacacacagagagcatgagttagattttactcattatcatcaagaaatgtttacgcagaaatactatttaaagagaaaaagagaagcagcttgataatttgctactgtcgactattataacgagttgcgatgtccagctactaaggattagagaccgtcgtgcaattgatctaactcgaactgagaagacatcagtttatgtaatgtactaaggactgtttgtaactcacaccatggacgtgacactattagatgcgtttatttaattgatatttggctcctcctagttccgggtataggg

SEQ ID NO: 62808 - DNA, 729 bp, Zea mays
  misc_feature: Ceres CLONE 1529496
  misc_feature: Encodes the peptide sequence at SEQ ID NO. 62809
  misc_feature (729)..(729): n is a, c, t, g, unknown, or other
caaagctggagctccccgcggtggcggccgctctagaactagtggatcccccgggctgcaggaattcgtctcacccctagaaaaactagaaaaaccactttcaataacgagcggccaacccaacccaacccaacccaccactgcctccctccccgttccccagtccccaccccgaccggctgctcctcctcctttccccgcgccatcctcgaggcatcaccggcgccgcaacttcgttgaggaggaagcccgcacccgcccccgatccgatggccaacagcaacctcccgcggcggatcatcaaggagacgcagcgactgctcagcgagccagcgccggggatcagcgcgtcgccctcggaggagaacatgcgctacttcaacgttatgatccttgggccggcgcagtcgccctatgaaggtggagtttttaagcttgaactctttttacctgaggaatatcccatggctgccccaaaggttaggtttctgaccaagatttatcatcccaacattgacaagcttggtaggatatgcctcgacattctcaaggacaaatggagcccagcacttcaaattcgaacgttcttttgagtatacagctctactgagggcaccaaatcagatgaccctcctctccataaattgcaaagcactggaaaccaatgaaggagaaactgttgaaacagccaaggagtggactcccctgaatgcaacggtgcatgaaaan

SEQ ID NO: 62809 - protein, 107 aa, Zea mays
  misc_feature: Ceres CLONE 1529496
  misc_feature (9)..(108): Pfam Name: UQ_con Pfam Description: Ubiquitin-conjugating enzyme
  misc_feature: SWISSPROT Homolog: EC 6.3.2.19 Ubiquitin--protein ligase
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTFF

SEQ ID NO: 62810 - DNA, 733 bp, Zea mays
  misc_feature: Ceres CLONE 1529497
  misc_feature: Encodes the peptide sequence at SEQ ID NO. 62811
  misc_feature (647)..(647): n is a, c, t, g, unknown, or other
tccccgcggtggcggccgctctagaactagtggatcccccgggctgcaggaattcgtctcacccctagaaaaaagctccacgcctccactgctatccctctcttcctctctgctttccccttccaatggaatcctgtagcttccgtgccgcaaccgcgccttctccctttccctccgctccttcttcatcttcatccccgcgcgccccatgccccatactccgatttcccaggccaagaaaagggaggcagattggggtgcggaggagggcgtccggatttgatgccttcgcgtctttcgccggcaaggtcttcgtggatgaggcgattggagcggaatatggggagggcttcgaaacatttcgaatggatggaccactcaaggttgatgtagattatctgaatgaaaaattgcaagagtgcttccttcaaaggataaggcatgctatgaagccggatgaggcgtttggtctaattttttcgtgggacaatgttattgctgatacagactcgctaaagttgaatgcttggagacaacttgctttggaggaaggtaaggatatcccaagtggtgctcatgtccggaagagcatttatcatggtgctgctgacccaatgtctagaaaggttttgtactggggcaaagangaagaataaatggaaaaatttgaagcacgccttaagaggtgtactacgagaaccctgtcaaactcgatacacctgtagaaagaatg

SEQ ID NO: 62811 - protein, 176 aa, Zea mays
  misc_feature: Ceres CLONE 1529497
  misc_feature (174)..(174): Xaa is any aa, unknown, or other
MESCSFRAATAPSPFPSAPSSSSSPRAPCPILRFPRPRKGRQIGVRRRASGFDAFASFAGKVFVDEAIGAEYGEGFETFRMDGPLKVDVDYLNEKLQECFLQRIRHAMKPDEAFGLIFSWDNVIADTDSLKLNAWRQLALEEGKDIPSGAHVRKSIYHGAADPMSRKVLYWGKXEE

SEQ ID NO: 62812 - DNA, 748 bp, Zea mays
  misc_feature: Ceres CLONE 1529499
  misc_feature (12)..(12): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
gttttttttttngttgtgtttttccgtctccccannannggnnttttttnnnnngagggggaggtccccgcggtggcggccgctctataatagtggatccccccggctgcaggaattcgtctcacccctagaaaaagcgcaaacacctcgccttttgtactcttgcgtctctgccctcgcgttatcgccttcgtcacgctcgctcgcctggctggcttgtgccttgccttgctcggcgtacgcgaacgcagcgagagggaggagcaaggaaatagagagagacagagagagagagagaaaaaatccagtcatccccctttcctctgagctcgttccatggagaactcttctcacaagcgggcgcgggaggcgggcgacctcgtcccccggcggctgctgagaggaaggttcgcctttggcccacccccagaggggggggggggcaggacctgctcgacatggttttttcccccactgtggacgtggccctcggtaccggcgaacctattctacggttttggcggaagcctggtaggaaggatataggcttgccttcaaacaaagccgccggaaggcccctggtccccaggctccccgaaattggggcttttctggctccaagcgactttggcacaccgcatcccgggggcctgaccgtcccgcccttcccctttccgcaaggctccaggcgaggccttgcgttcccccgggaattgttcttgagcccgagcgagataaacctgtatag

SEQ ID NO: 62813 - DNA, 664 bp, Zea mays
  misc_feature: Ceres CLONE 1529500
  misc_feature: Encodes the peptide sequence at SEQ ID NO. 62814
  misc_feature (453)..(453): n is a, c, t, g, unknown, or other
aaactggagctccccgcggaggcggccgctctagaactagaggatcccccgggctgcaagaattcgtctcacccctagaaaaagacgtggcgctcctcctccgacgattcgctccctccctcgagtttcaccactccctcctctcgcggccacgcactcccccgcctccgcaacctctcaccgccggtccccgccctccgaccctccacgcgcaaacagcccgcctccatccaccaggatccccgatgagctaggagaagtgttgatttggatattcgtggagtgtgcaatggtggactttgttcgacggctcgcctctgccctgctcaagtgctgcgaccttgacatacccaatcggccaaagggcctcgaggaccccgaacgcctggctagagaaactgtttttaatgtgaatgaaatcgaagctctgtatgagctgttcaagaagattancagtgctgtggttgatgatggcttgatttacaaagatgaatttcaattagccctgtttaagaccaacaaaaagatagcatggttgctgaccaggtatttgaattgtttgaaccaaaacccaatggaattctccaagttgaagaaatttgcccaaacccctttctggggttccccccaaagggccccaacccaagaaaaaatttgttctgtg

SEQ ID NO: 62814 - protein, 125 aa, Zea mays
  misc_feature: Ceres CLONE 1529500
  misc_feature (55)..(55): Xaa is any aa, unknown, or other
MVDFVRRLASALLKCCDLDIPNRPKGLEDPERLARETVFNVNEIEALYELFKKIXSAVVDDGLIYKDEFQLALFKTNKKIAWLLTRYLNCLNQNPMEFSKLKKFAQTPFWGSPQRAPTQEKICSV

SEQ ID NO: 62815 - DNA, 613 bp, Zea mays
  misc_feature: Ceres CLONE 1529501
  misc_feature: Encodes the peptide sequence at SEQ ID NO. 62816
  misc_feature (296)..(296): n is a, c, t, g, unknown, or other
  misc_feature (343)..(343): n is a, c, t, g, unknown, or other
  misc_feature (377)..(377): n is a, c, t, g, unknown, or other
  misc_feature (389)..(389): n is a, c, t, g, unknown, or other
  misc_feature (397)..(397): n is a, c, t, g, unknown, or other
ggagctccccgcggtggcggccgctctagaactagtggatcccccgggctgcaggaattcgtctcacccctagaaaaagaagcttcttcttgcatccgagtgcggaatcacctccaatctgcccctcgggccgccggcgccgatggagaaggtgaagaacatgctcaagccgcggccgacgccgcagcagcagctgcgcgagtggcagcgccgcctccgcaacgagtgccgcgtcctcgaccgtcagatccgagatgtgcagagggaggagaagaacgtggagaaagccatcaggnaggctgccaagcgcaatgacatgggatctgcaaaggctcttgctaangaactttgtagaatcagacgtgctgttaatcgtncttatgagaacnaggctcanctaaattcagtatcaatgcacctttggagaaattgtcgcaactggcaaaccagtgggtcatctgtcccaaaacccctgaaagtgatggaaaattgttaacaatctcaatgaaagcttcccaatttgggtcccccccaatgccagaatttttcccaaaaaatggcccccagggccgggggtggaatggaaaaaaaaatgggggaccccaagcccttt

SEQ ID NO: 62816 - protein, 117 aa, Zea mays
  misc_feature: Ceres CLONE 1529501
  misc_feature (52)..(52): Xaa is any aa, unknown, or other
  misc_feature (67)..(67): Xaa is any aa, unknown, or other
  misc_feature (79)..(79): Xaa is any aa, unknown, or other
  misc_feature (83)..(83): Xaa is any aa, unknown, or other
  misc_feature (85)..(85): Xaa is any aa, unknown, or other
MEKVKNMLKPRPTPQQQLREWQRRLRNECRVLDRQIRDVQREEKNVEKAIRXAAKRNDMGSAKALAXELCRIRRAVNRXYENXAXLNSVSMHLWRNCRNWQTSGSSVPKPLKVMENC

SEQ ID NO: 62817 - DNA, 639 bp, Zea mays
  misc_feature: Ceres CLONE 1529507
  misc_feature: Encodes the peptide sequence at SEQ ID NO. 62818
  misc_feature (541)..(541): n is a, c, t, g, unknown, or other
  misc_feature (552)..(552): n is a, c, t, g, unknown, or other
aaagctggagctccccgcggtggcggccgctcttcaactagtggatcccccgggctgcaggatttcgtctcacccctagaaaacccttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaatacatcaagaatctcactgctgtgttggagcccagagaagcggatgagttcaaaagggtgtcgaggggtgcacccagtttctccttagcaagctgaaagacctcaanttttttgttgntgagtccatgaaggatgatgcgtcctgtggttttcgcctatacaaggatggggcccctaatccgaaattcccccatttcctccatga

SEQ ID NO: 62818 - protein, 120 aa, Zea mays
  misc_feature: Ceres CLONE 1529507
  misc_feature (1)..(119): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDIVDTFRLQEQPPFDKKSFVSYIKNTSRISLLCWSPEKRMSSKGCRGVHPVSP

SEQ ID NO: 62819 - DNA, 642 bp, Zea mays
  misc_feature: Ceres CLONE 1529513
cgcggtggcggccgctctagaactagtggatcccccgggctgcaggaattcgtctcacccctagaaaaaaacagaggaaacgggctacagccaaaacgcatctccgcgcgcgacgacgatggcagcctcgtgtcaaggccgagggcggcctgatgcagccggctaagatcgtggggtcgggatgccctttgcctccctggcgccgcgtccggactatcgacgtcgcctgaccggaatgcggcgaccaccctgaggttgtccgtatcccatgtcccctgcaggaccacgactactggtgtgacggcgcagccagggctcgcgcggcttcgacctcctcaactcggccgtcgtctgcccggactttatgcgacagtgctcggacatacgctgacctgacatcaagagccgtagcacacgtcaccgggtgggaagggtacgggcactgctaactgatgccggaccatcaaaggtcggctgtaatcgttagcgttcaatggctgctagtttcatatgatcaagctgtgactgcagccgacctcctacgctgtacacgacggagggtctcgccgagaacgccacgccccgacttccctgaaaaccaagctcatgacaccaggctcacgtacatcggctgtactaaaa

SEQ ID NO: 62820 - DNA, 745 bp, Zea mays
  misc_feature: Ceres CLONE 1529519
  misc_feature: Encodes the peptide sequence at SEQ ID NO. 62821
  misc_feature (380)..(380): n is a, c, t, g, unknown, or other
  misc_feature (396)..(396): n is a, c, t, g, unknown, or other
  misc_feature (461)..(461): n is a, c, t, g, unknown, or other
ctccccgcggtggcggccgctctagaactagtggatcccccgggctgcaggaattcgtctcacccctagaaaaatgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcataggtcccgcggcttcggcttcgtcaccttctcccctgatgacgccatgcggaggggggggggggggcatnaaccgccaggacctgnccccccccaccatcaccgtcaaccagggcccagtccgcggcggccgtggaatcccccccggtggntccggtggtgcccttggaagccgccgctactcccgttggcggctccctgttgccggtgccgcttccgccgttgccggcgctcacgttggcgcggccgctaccgtggttgggcgcgccccctaccgcgttgggcacccttggcggccgttaccgaaactcccacgggaactcggaaaatctcgcgcgtgggggcccctccctttctactttatccttgttcgatacccgtgaatttttcaccttccccgaccgggttttatgtcccccccccggttcacgtgttg

SEQ ID NO: 62821 - protein, 191 aa, Zea mays
  misc_feature: Ceres CLONE 1529519
  misc_feature (10)..(73): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (70)..(70): Xaa is any aa, unknown, or other
  misc_feature (75)..(75): Xaa is any aa, unknown, or other
  misc_feature (97)..(97): Xaa is any aa, unknown, or other
MAASDVEYRCFVGGLAWATDDHSLHNAFSTYGEVLESKIILDRETHRSRGFGFVTFSPDDAMRRGGGGHXPPGPXPPHHHRQPGPSPRRPWNPPRWXRWCPWKPPLLPLAAPCCRCRFRRCRRSRWRGRYRGWARPLPRWAPLAAVTETPTGTRKISRVGAPPFLLYPCSIPVNFSPSPTGFYVPPPVHVL

SEQ ID NO: 62822 - DNA, 627 bp, Zea mays
  misc_feature: Ceres CLONE 1529523
  misc_feature: Encodes the peptide sequence at SEQ ID NO. 62823
  misc_feature (627)..(627): n is a, c, t, g, unknown, or other
atagctggagctccccgcggtggcggccgctctagaactagtggatcccccgggctgcaggaattcgtctcacccctagaaaaaaagctcgaccaccaacccagctcgctcgtcccagctgatcaggtcgagcacctagtagcgacctgctcgatcatcattgtagagtgtccggaggtgtctgtctctcttggtggctggttgcaacggtcatggggacgtcctctcgtcgggtgtccttgctaatgctgtgcctgggcgtgctggtgtcatgcatccttcgcgatgcgcagcttggaccactacctggacatcacgtgcgagcaactggcggacaaggtccttgacaacagggagctgctgacgctgtcgctggaccgcacgtcccgctccgggttccaatcccggctcgagtacctgttcggcaagatcgacatgcacctgaagttggtgtcgggcaactcctacgagcacgtctccggctactagctgtcgccgcacgtggtcgcgcacgacgagatcgacttcgagttcctggagctcgtgtacggcatagcctacaccctggacaccttcgtgttcacccgggggtaggagcaacgagaccaacatttccgcctctggtcn

SEQ ID NO: 62823 - protein, 67 aa, Zea mays
  misc_feature: Ceres CLONE 1529523
  misc_feature: SWISSPROT Homolog: EC 2.4.1.207 Xyloglucan:xyloglucosyl transferase
MRSLDHYLDITCEQLADKVLDNRELLTLSLDRTSRSGFQSRLEYLFGKIDMHLKLVSGNSYEHVSGY

SEQ ID NO: 62824 - DNA, 674 bp, Zea mays
  misc_feature: Ceres CLONE 1529524
  misc_feature: Encodes the peptide sequence at SEQ ID NO. 62825
gatagctggagctccccgcggtggcggccgctctagaactagtggatcccccgggctgcaggaattcgtctcacccctagaaaaacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctgtggcctcggatctgacccggagagcctgcggtggaacgtgcaggcggagctggtgcactgccggtgggcgatgctcggcgcggcgggcatcttcatcccggagttcctgacccagatcggcgtcctcaacacgccccttctggtacaccgccgggcgagcagcagttacttcacccgacaccaccacccctcttcatcatccaagctccatcctcatcggggtggggccgagggccgcccgctggagcttgacatcatccaggccccggaagcggtcaaaacccgaaccccatccttcccccagacaaaaag

SEQ ID NO: 62825 - protein, 184 aa, Zea mays
  misc_feature: Ceres CLONE 1529524
  misc_feature (63)..(170): Pfam Name: Chloroa_b-bind Pfam Description: Chlorophyll A-B binding protein
MALVSASSSSTTAVTALPRNGQRASSSFLGGKTLLRQAEAARPSFAVRAAADPNRPIWFPGSTPPPWLDGSLPGDFGFDPCGLGSDPESLRWNVQAELVHCRWAMLGAAGIFIPEFLTQIGVLNTPLLVHRRASSSYFTRHHHPSSSSKLHPHRGGAEGRPLELDIIQAPEAVKTRTPSFPQTK

SEQ ID NO: 62826 - DNA, 963 bp, Zea mays
  misc_feature: Ceres CLONE 1529526
  misc_feature (12)..(12): n is a, c, t, g, unknown, or other
  misc_feature (13)..(13): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (42)..(42): n is a, c, t, g, unknown, or other
  misc_feature (43)..(43): n is a, c, t, g, unknown, or other
ccttttttgttnnctacctnnncccnnnnnngngggaccccnngagccgccccccctccacgcggtggcggccgctctagactagtggatcccccgggctgcaggaattcgtctcacccctagaaaaacctccgtctccgccgccgccgttgccgctctcgtcccacccctcaccgggcgccggtcgccgccggcatcttgcgtaccggagattggccgccgaacattcagatccaaaccccgtatcttctcttcttccccctccttccccattggccccgccgctgccatgggcaccggcggcgcctccccccccgcctccgattttcggccccgcgagggaagtgccccctctcccgctccctatgggggattcgtgctggtgtcatcctggcgcagggttctggtttgccccccccccccaccgcgggggggggggggggggcgctttcccctctctcccccactttttttatctcccccccgtctcactctcaggcgagccccctcgtgccgcgggcggtcctgggctcccggccccttactctctcgcccttttcgtcgccggtgcgctcgccgctacggggcgctactcggccttcctcggtggtcgcccttccgcccctaaagtctccgtgtggccgtagcggctggcgttgtctctcatacggccccgcggtcgtctatctcgcgcgtgagcgattgatgcggcatcagctccctcctcttatgcctgcgccgcccctcctccttctcccgcggctgctgcttctctggctcactccttactgttctctcttgttgtgcgctcccgcctcctcttggtcggagtcgcgtccacttctatccccccacgtctcttttcctatgcttgatcccggcacttgcagcctctgacgcggcgtggtttccgttcccccccgcacactccgtcttccttgatcctccctcgcatgctccgcg

SEQ ID NO: 62827 - DNA, 726 bp, Zea mays
  misc_feature: Ceres CLONE 1529528
  misc_feature: Encodes the peptide sequence at SEQ ID NO. 62828
aaaggtggagctccccgcggtggcggccgctctagaactagtggatcccccgggctgcaggaattcgtctcacccctagaaaaactcaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcggggggggtcgcgctgttcgtggcggtgtctgtgggcgcgaacatctccggcgggcacgtgaaccctgccgtgaccttccgcgccttcgtgggcggcaacatcaccctgttccggggggtcctgtattgggtggctcacctgctggggtccaccttggacggcttccttgtccccttctcaacgggcgggcaagtcacgggcacctttcgggctgactgcctggtccggtgggggaggcgcctggtgttagaatatccagctttaccttttgatattgggtgtcccgattgtactccaccggcgttggcacccgcataaatgggtactctctgcgtctccttcgcccccg

SEQ ID NO: 62828 - protein, 169 aa, Zea mays
  misc_feature: Ceres CLONE 1529528
  misc_feature (13)..(170): Pfam Name: MIP Pfam Description: Major intrinsic protein
MPINRIALGSHQEVYHPGALKAAFAEFISTLIFVFAGQGSGMAFSKLTGGGPTTPAGLIAAAVAGGVALFVAVSVGANISGGHVNPAVTFRAFVGGNITLFRGVLYWVAHLLGSTLDGFLVPFSTGGQVTGTFRADCLVRWGRRLVLEYPALPFDIGCPDCTPPALAPA

SEQ ID NO: 62829 - DNA, 741 bp, Zea mays
  misc_feature: Ceres CLONE 1529533
  misc_feature: Translation starting site: 154
tacccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccaggacgggctgcggacctgaccggcaagttccccggccaccacccgctgggacaccgccggggctgtccgcggacccggaggcgttcgcccggaacagggcgctggaggtgatccacgggcggtgggcgatgctgggtgccgctgggctgcatcccccccggaggggctgggagaaacgggtgcccttggaacttcaaagaaaccccgtggggtccaaggcccgcgcccaaaatctttctccgaggggggggctggacctacctggggaaaccccaacccgggggcccccgcccaacgattcttgggccggggtcccgccttcgcagagccacccctccgtggggctccggccagggtgtttctaggaataaaaggccacaag

SEQ ID NO: 62830 - DNA, 537 bp, Zea mays
  misc_feature: Ceres CLONE 1529536
  misc_feature: Encodes the peptide sequence at SEQ ID NO. 62831
  misc_feature (426)..(426): n is a, c, t, g, unknown, or other
gacggtggcggccgctctagaactagtggatcccccgggctgcaggaattcgtctcacccctagaaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggagggcccatccgagagttcatctcctcctccccaacccgccctacgacctgaagtcctccgggtccaccccctcaagaatccttcggggccccgcgaaatgaacccggggccttccttggagggaaatttattttcccccnggcccgaaacccaaaatgtgggtatttttggggggcccccgggggtccccgggggcccttgttcccgggggccgaaaaaaaaaattttttcaaaaaaaaacccccaccccg

SEQ ID NO: 62831 - protein, 56 aa, Zea mays
  misc_feature: Ceres CLONE 1529536
MATTAASSLLKSSFAGSRLPSATRTTTPSSVAVATPRAGGGPIREFISSSPTRPTT

SEQ ID NO: 62832 - DNA, 802 bp, Zea mays
  misc_feature: Ceres CLONE 1529540
  misc_feature: Encodes the peptide sequence at SEQ ID NO. 62833
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (419)..(419): n is a, c, t, g, unknown, or other
  misc_feature (422)..(422): n is a, c, t, g, unknown, or other
  misc_feature (423)..(423): n is a, c, t, g, unknown, or other
nnaatcacccnnncgtttcatgagctccccgcggtggcggccgctctagaactagtggatccccccggctgcaggaattcgtctcacccctagagaaactcgtctcgtctcgtctccctctctctcgtccggtcctccctccccttcctgaggcgttccctctctctcctcccctttcctcgggtgggctctactctcttgtcatcgcacccgtctccccgctctgactccgtcccgagcggccgactccgcccgcgccgccgccgccgccgcctcgtcccgatcgacccccgaatcttttgaacccggggaggtggcgaggttgtgtctttacctcttattcggggagggaaaataacagggggacagctttttttttccccccccccgggggaaagaaaggggggannnnnnnnncnaannccccccccccccccgggttttaaaaaagatacccgaccgagggtgggcggtggggggtgccctcgtcctaccccccccaaacaacccttaagggttgctcaaactgttttatataaacccttttctaacaagtgcttactcgtccccccccttcttggcggtctcttctcatcctttgtttgtacccaaatcctttatacctacccgtgctacctctccacccttctcattcgacttcttctcttccatccctcgggtttcgcacgaattgtgtagtttttcccctcccccgtttctatctccttttttttctttcacttataactgtgtacttccctccttgttaattcgctcggtctttcctccttctttctcgtat

SEQ ID NO: 62833 - protein, 29 aa, Zea mays
  misc_feature: Ceres CLONE 1529540
  misc_feature (3)..(3): Xaa is any aa, unknown, or other
  misc_feature (4)..(4): Xaa is any aa, unknown, or other
ITXXFHELPAVAAALELVDPPGCRNSSHP

SEQ ID NO: 62834 - DNA, 662 bp, Zea mays
  misc_feature: Ceres CLONE 1529544
ggatcccccgggctgcaggaattcgtctcacccctagaaaaaaatattgatccgccttcgtatgtagccacttagcttttctttgttttcttgtccaattgcgtgagttcgtcctcggcaagtatatggaaatagggtggtgaaatgtaccattttttactagatgatggcaattattgttgaacatacatatagtggatgcactggtggggtttacatcacactacaccaactacaataaaaaaaacactaacgaaaccaaaaaataaacaaaaaaaaaaagcgaaaccaattcaccacacaaaactaaaaaccaagaaagcccctccctatcataaattaaaaatcctacccccccctggacccccattgccccttgtaaaaataaatataccggcaacaatgggccatattttttcacaaccccggctggagataaacccgcgcgccaccccaaggtataccccttcccccaataatatcccttttccctacccttgcatattatacaaaaaaaatacccccacattctccccccccttccccaattattcaccacaccttgaaatcccaaatttcaaaaactttccaaacactctcatctttttttataacaaacctcccccccttatttatatctctaacatccccccacctctatt

SEQ ID NO: 62835 - DNA, 738 bp, Zea mays
  misc_feature: Ceres CLONE 1529549
  misc_feature: Translation starting site: 129
ggagctccccgcggtggcggccgctctagaactagtggatcccccgggctgcaggaattcgtctcacccctagaaaaagccaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctgggggcctcggatctgacccggagagcctgcggtggaacgtgcaggcggagctggtgcactgccggtgggcgatgctcggcgcggcgggtatcttcatcccggagttcctgaccagatcggcgtcctcaacacgcccttctggtaacacgccggcgagcagcagtacttcaccgacacccacacccctcttcatcatcgagctcatcctcatcggctgggccgagggccgcccgttgggctgacatcatcaagccccgaagcgtcaaccccgatcccatcttcccaggaacaagtcaccgggcccgacgtcgggtaccctgttggcctgtgtttgaccc

SEQ ID NO: 62836 - DNA, 775 bp, Zea mays
  misc_feature: Ceres CLONE 1529550
  misc_feature: SWISSPROT Homolog: EC 3.2.1.23 Beta-galactosidase
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
ttttttttttttttttttttttttttttnccanngnnnnnaatattaaaaaaaattgctggagctccacgcggtggcggccgctctagaactagtggatcccccgggctgcaggaattcgtctcacccctagaaaaaagatcaatcctctttgtaattttgatgtttaccaatgcatgatattcagtcaaatttctgtcaatgagtagtcatgtaatatggtacggtttaaatcaacctaaaatctttattttccagttgaagtatgtaattttgacctcgtatgctatgatgtggccgattgttccaaaaaaaaaaaaaaaaacgagacgctcgaggtacccaattccccctatagcgagtcgtattacgcgcgctctaatggccgtctttttacaacgtcatgaatgagaaaaccctggcgttacccaacttaatcgccttgctcctgttccccctttcgccatctggccttataatctaacaagcccgcactgttttcccttccaaacagttgcgccccctgaatgtgcaatggaaaattgtaaacctttaatattttgccaaaaattccccggttgaaattttttgtttattttcaaactcaatttttttttaacccactatcccccaaattccggtaaatttcccttttaataaatttaaaaaagaatataacccgagaattatgtgttttaaattcgtttttttccccatttttgggaaaaaaattatatcttacaccgtgttctaatgagaacctgtgtggcatcctc

SEQ ID NO: 62837 - DNA, 723 bp, Zea mays
  misc_feature: Ceres CLONE 1529554
  misc_feature: Encodes the peptide sequence at SEQ ID NO. 62838
  misc_feature (1)..(1): n is a, c, t, g, unknown, or other
nggggggggatcgatattggaaaacaaaccaccacaattaaaatctctttccccccaaaactggaactccccgcggtggcggccgctctaaaactagtggatcccccgggctgcaggaattcgtctcacccctagaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggacactggaagcacagcgacatcacactcaaggactccaagacccttctcttcggtgacaagccggtcaccgtctttggcatctggaaccctgacccaatcccgtggggtgaggctggcgctgagtatgtcgtggagtccaccggcgtcttcactggacaggacaaggctgctgcacatcttcacgggtggtgcccaaaaggctgttatcttctggccccaagcaaagaaggcccccatggtttggttgttgggggacaatggacggacaaagtccccccccgggaatgtttaacatttggttttccaaaggactaaggcagagcaccaacaaaaacttggccgttg

SEQ ID NO: 62838 - protein, 158 aa, Zea mays
  misc_feature: Ceres CLONE 1529554
  misc_feature (4)..(150): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDKPVTVFGIWNPDPIPWGEAGAEYVVESTGVFTGQDKAAAHLHGWCPKGCYLLAPSKEGPHGLVVGGQWTDKVPPRECLTFGFPKD

SEQ ID NO: 62839 - DNA, 640 bp, Zea mays
  misc_feature: Ceres CLONE 1529557
  misc_feature: Encodes the peptide sequence at SEQ ID NO. 62840
  misc_feature (640)..(640): n is a, c, t, g, unknown, or other
tggagctccccgcggtggcggccgctctagaactagtggatcccccgggctgcaggaattcgtctcacccctagaaaaataaaacctagaccacgcgcgacgacggccgcctgatcgatcgaccaaccattccgccgtcgccgccggccggatcatcggtcgtcgtcatgatgatatctatcaatctacgcgtgatgatcgatggctacttgtctactgctatgtactactaaataaaatctctccccgtgtgtgtacacgtacgcttgcatgtgcatggtagcatgtacgtacgacgtcgtccatgtataagtgtgtgacgtgtgagacggacagagagagagagagacaggatcgatcgagagacggtcatgtccttttggctgtttggtttattcatatcacaacttttgagtgtatacaagattatttctgtggcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccan

SEQ ID NO: 62840 - protein, 111 aa, Zea mays
  misc_feature: Ceres CLONE 1529557
  misc_feature: SWISSPROT Homolog: EC 3.2.1.23 Beta-galactosidase
MYKCVTCETDRERERQDRSRDGHVLLAVWFIHITTFECIQDYFCGKKKKKNETLEVPNSPYSESYYARSLAVVLQRRDWENPGVTQLNRLAAHPPFASWRNSEEARTDRPS

SEQ ID NO: 62841 - DNA, 656 bp, Zea mays
  misc_feature: Ceres CLONE 1529562
  misc_feature: Encodes the peptide sequence at SEQ ID NO. 62842
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nttttnnnnnnnnnnnnnnttacaaatctcacaagatattnntnttgggnnnngttcatagctggactcaccgcggtggcggccgctctagaactagtggatcccccgggctgcaggaattcgtctcacccctagaaaaatagcgtcgtagtcctagtcaccgcgttcgcttcccgagcacgcaaccatggctcgactgtcagccaccgccgcgctcctcctcctcgtcctctccctcctcgccgtcgcgcactgcggtgccctcgcagtcgcagcagagcacgacaccgagcccgaatcaaccgccgccgtggccgtcagcgacgacaacgtgctatccgaccccacggtccacgctgaggcgggcaccgccagcgccactgaagaggaggccatcccggcggagcagcagcagcatgggttcgaactcctccgcctgccgtctcaccggctccaccaccaccaccacctctggtggaagcgccaccacgggatctaccgtgacgcgtcgcacaagttcccttgttctggccacggcgcgaggcgcgagcaggcagtgagccaccttgccatcttgcccgcatccgcagaagtggccaaggaaggccggggaaggagaagccccgtgggcccaaacccggaccccggatccctcc

SEQ ID NO: 62842 - protein, 156 aa, Zea mays
  misc_feature: Ceres CLONE 1529562
MARLSATAALLLLVLSLLAVAHCGALAVAAEHDTEPESTAAVAVSDDNVLSDPTVHAEAGTASATEEEAIPAEQQQHGFELLRLPSHRLHHHHHLWWKRHHGIYRDASHKFPCSGHGARREQAVSHLAILPASAEVAKEGRGRRSPVGPNPDPGSL

SEQ ID NO: 62843 - DNA, 466 bp, Zea mays
  misc_feature: Ceres CLONE 1529567
  misc_feature: Encodes the peptide sequence at SEQ ID NO. 62844
  misc_feature (241)..(241): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
ggagctcccgcggtggcggccgctctgaatagtggatcccccgggctgcaggattcgtctccccctaaaaaatctcaatttggatttgacaggatacaagttatctggcggattgcccagtgtaaacctgaaccttttatgatgtgtggtgtccggtattggcagcaaaaaacaattcgtttactgctgtaagtgctgcagccactgatattttgtctatttaaccttgactgtttgtgtngtgggagtctatcctgaagaacaaatgttttatcaagaaaaagttatatggccttaaaaaaaattgtttttttattggttgaaaannnntaataaaaaaatattaaaaaccccgaaccccccccccccgggggggttccccccccaatttttttcccccccccccttaagggggggcgcctataatataaacccccgccccccccctgggggcgcgggttttttc

SEQ ID NO: 62844 - protein, 63 aa, Zea mays
  misc_feature: Ceres CLONE 1529567
GAPAVAAALNSGSPGLQDSSPPKKSQFGFDRIQVIWRIAQCKPEPFMMCGVRYWQQKTIRLLL

SEQ ID NO: 62845 - DNA, 731 bp, Zea mays
  misc_feature: Ceres CLONE 1529576
  misc_feature: Encodes the peptide sequence at SEQ ID NO. 62846
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (497)..(497): n is a, c, t, g, unknown, or other
nggggnnnnnaatttggggcccgcctgatcacgaggcaggnnnnncgcccnnntttaaaactggaactccccgcggtggcggccgctctacactagtggatcccccgggctgcaggaattcgtctcacccctagaaaaaatcaacccaacacggcgtccccgtcccgagtcaccaccgacccaagcaaaaccgcacgcaccctgccagcggccccccaactcccaacccaacccctactccagctagctcgcggcggcggccagcggccatggccttccggctgagcaacaacctgatcggggtcctaaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcctgcgtgccgcgtcacctggctgctctgggnctacctcctcgccatgttcgtcctcatcctcgacctcttctgcttcaccgtctttcgccttcgttcgtcaccaacagggggctccaggcgaaggaccgtcctccgagccgcgggaattacaaaggaagtacccgccctccaggggaaacttacctccaaaactaggcctgccaagtaagccgccgattctcaaaaaaacacacccatggcagaaacctggtggttaccctggga

SEQ ID NO: 62846 - protein, 130 aa, Zea mays
  misc_feature: Ceres CLONE 1529576
MAFRLSNNLIGVLNFVTFLLSVPILGAGIWLGHRADGTECERYLSAPVIALGAFLLAVSLAGLVGACVPRHLAALGLPPRHVRPHPRPLLLHRLSPSFVTNRGLQAKDRPPSRGNYKGSTRPPGETYLQN

SEQ ID NO: 62847 - DNA, 731 bp, Zea mays
  misc_feature: Ceres CLONE 1529579
  misc_feature: Encodes the peptide sequence at SEQ ID NO. 62848
  misc_feature (412)..(412): n is a, c, t, g, unknown, or other
  misc_feature (423)..(423): n is a, c, t, g, unknown, or other
  misc_feature (427)..(427): n is a, c, t, g, unknown, or other
atgctggagctccccgcggtggcggccgctctagaactagtggatcccccgggctgcaggaattcgtctcacccctagaaaaaaacgcgacggcaaagacggtgtatcgaagggtcgacaatggttacgacgatcggtagtccatagcagcggcgggcgcaacttcgacccggttttcttcccatatatctgtcaaatccttctccggttaccctccatcggcagcaatttccgccatagataccggcgatcgagggcctcggacaacccaatcgacggagcatcttcgtcggcaggagagggcaaaccctttttcttcctccgtacttctacttggcctgcccccgggatccccctcccgcaggaatatttttcccccccccccggcgggggaaagttaggggggaatttnaattcaatccnaccnttatcccttccaaggaaaaattttttgggaaaaatttttgcccccgttcccttggggccgtggggatcccctctttctgcgccttggggcgctaaagggaaaaccaatattcctgtgggtaatcctatcccctccgcgggtggccactcacctctttaggtccccccctgcgcaaaaacaccgaacaagggagaaaaagtgccccccccccaaccgctgggcccccctcctgccaccaatttgcggcccttctccctaaaaacacgctaccccacgttctttttcccgcccttcatcacccccc

SEQ ID NO: 62848 - protein, 45 aa, Zea mays
  misc_feature: Ceres CLONE 1529579
AGAPRGGGRSRTSGSPGLQEFVSPLEKNATAKTVYRRVDNGYDDR

SEQ ID NO: 62849 - DNA, 806 bp, Zea mays
  misc_feature: Ceres CLONE 1529585
  misc_feature: Encodes the peptide sequence at SEQ ID NO. 62850
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (35)..(35): n is a, c, t, g, unknown, or other
  misc_feature (793)..(793): n is a, c, t, g, unknown, or other
nnncctaaaaaaaaaannnaataacagccggtcgnttcgtctacccccacaaaactggaactccccgcggtggcggccgctctattctagtggatcccccgggctgcaggaattcgtctcacccctagaaaaaaaaggtactcctctcctcccctctgctgcagtcctctgcccgctgcagatcatggaggatgaagcatggcaggagtgtctgcatgggtcctgagagtcgcgtgagcagcgaagcagttcacggatggttggatggacggcaatgaccagctgctgagctgctgctgctcctcctgggcgaccatcaatatgaatttgttaatgcctcgtgtagcccgccgtcttcttgccctggattgtccagtttcccgaacgcgggccagcccggtgaagccttgtacagtaaccggtacagtcagaaaccgcgaatcccgcatcccctccaggaagcctaaattaaactccccttattatacccaatttttaaagcttcccttacccctcccgctggattcctgggaacttacctttcgctttctttctaggcgcagggttaacctcccttgaaccccaaaccgctctccccatgacaaccagccgcatagtattctcatcctaacaatatcccctgcttcctcgccgaaacaccactactcgcacccaacttacgccctactgcccaccccccccccatctccacaaaaaaacacgacgccccacccgccaggctaaccactataaacccacccctcaaaaacaacatccccacacacactagtancggacataacaca

SEQ ID NO: 62850 - protein, 73 aa, Zea mays
  misc_feature: Ceres CLONE 1529585
  misc_feature (5)..(5): Xaa is any aa, unknown, or other
  misc_feature (11)..(11): Xaa is any aa, unknown, or other
LKKKXNNSRSXRLPPQNWNSPRWRPLYSSGSPGLQEFVSPLEKKGTPLLPSAAVLCPLQIMEDEAWQECLHGS

SEQ ID NO: 62851 - DNA, 789 bp, Zea mays
  misc_feature: Ceres CLONE 1529587
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (20)..(20): n is a, c, t, g, unknown, or other
  misc_feature (21)..(21): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (69)..(69): n is a, c, t, g, unknown, or other
  misc_feature (70)..(70): n is a, c, t, g, unknown, or other
nnnnttttnnggggggcccnnttcccacaatcnnnnnnnnnttaaaannnnnatcttaaagactccacnnggtggcggccgctctttcctaatggatcccccgggctgcaggaattcctctcacccctagaaaaatagagaaaggcctacaagaacgtcgaggtgctttctgcaggatctcatagtacttgcacgagctaggatgcagctcaagcctcctgcaagacccaagctctattcagggctcatgccccaagaagatttggatccgtaccgtgatctaataccaggcttgcctgaagacttggcgaagatatgtcttgcccttgtccctcgtgtttcattttcctgcggggggcgctttttccaaaattttttttttgtttcttcgaaaggaaaggagcccccaaacttttttttccccccccccggggggggaaaggggggggggccacttttccccctttccccacccccccccccccaattacctaaaaatccacccatacccccattctttgccgggggggcccaacctaaacactcctcttcttaccccttcaaggcctgcgctcccatacaaaacacttggtccctatgcacatgacgcatcacacaaacctacttaaaccccccccccttcctccccgcccccccccccacccttgctatccaccgataattatccccgacacccctctcccaccacaccccaatcttcccccttgtccccctctttgcccccataccccccccgttttatttcaccctcagactcaccacccttta

SEQ ID NO: 62852 - DNA, 731 bp, Zea mays
  misc_feature: Ceres CLONE 1529588
  misc_feature: SWISSPROT Homolog: EC 3.2.1.23 Beta-galactosidase
  misc_feature (13)..(13): n is a, c, t, g, unknown, or other
  misc_feature (14)..(14): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
cccccccgccggnngggggggccgtgcgaaacnnncccnnnnccnnnnnnnnccgacccggactctccgtggaggcggccgctctataactatggatcccccgggctgcaagaattcgtctcacccctagaaaatttgataatatcatactcctctcagatggtcaagttgtgtaccagggtcccagagaagaagtgcttgagttttttgagtctgtaggtttcagatgccctgagaggaagggcgttgctgacttcctgcaagaagtgacctcgaaaaaaaaaaaaaaaaacgagacgctcgaggtacccaattcgccctatagtgagtcgtattacgcgcgctctctggccgtcgttttacatcgtcgtgactgggaaaaccctggcgttacccaacttaatcgccttgcagcacatccccctttctccagctggcgtaataatgaagaggcccgcaccgatcgcccttcccaacatttgcgctaccctgaatggcgaatggaaatttgtaagccgttaatttttttgttaaaatttcgcgtttaattttttgttaaatttagctccatttttttgacccatttggccggaaatctggcaaaaacccctttttttattccctgacgaattacaccccaaatcagggcttgaagagttttgttcccggtgttggaaacacagaaatctcccctattttaaggaacggtgggaactcccacgcgtccaaag

SEQ ID NO: 62853 - DNA, 661 bp, Zea mays
  misc_feature: Ceres CLONE 1529589
  misc_feature: Encodes the peptide sequence at SEQ ID NO. 62854
  misc_feature (385)..(385): n is a, c, t, g, unknown, or other
aaagctggagctccccgcggtggcggccgctctagaactagtggatcccccgggctgcaggaattcgtctcacccctagaaaaaactggttgctagtgctaccaagaacaggaaggaaacaccgccgccgccgcgccttccattccagtactcgcggaggaaaggaacaccagccagcgccatggtcacgtcgacgaccgccgccgccgtgctgtccccgccgtccgtggccgggcttcgcctggcgccgtctccccgggcgcgcgtggcgttccgcgcggcgccggcgcggcggtccgtggcggcgcgcgcggagctgagcccgtcgctggtgatcagcctgagcacgggcgtgtcgctcttcctgggccgcttcgtcttcttncacttccagcgggagaacgtggcgaagcacgtgcccgagcagaacggcagacgcacttcaacgccggcgacgagcgcgccaaggagtttctcgggcctgctcaagtccaacgacccccgtggggctttcaccctcgtcgaacttccttcgcctgggggctcgcctcgggccccattcggtcccctactaacatcctccgccccctccccagcaaacggaatacaaccccctaactccttccttgaacgggccgggcttgcgggggcatggttcctt

SEQ ID NO: 62854 - protein, 160 aa, Zea mays
  misc_feature: Ceres CLONE 1529589
  misc_feature (45)..(123): Pfam Name: PSI_PSAK Pfam Description: Photosystem I psaG / psaK
  misc_feature (68)..(68): Xaa is any aa, unknown, or other
MVTSTTAAAVLSPPSVAGLRLAPSPRARVAFRAAPARRSVAARAELSPSLVISLSTGVSLFLGRFVFXHFQRENVAKHVPEQNGRRTSTPATSAPRSFSGLLKSNDPRGAFTLVELPSPGGSPRAPFGPLLTSSAPSPANGIQPPNSFLERAGLAGAWFL

SEQ ID NO: 62855 - DNA, 552 bp, Zea mays
  misc_feature: Ceres CLONE 1529590
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (198)..(198): n is a, c, t, g, unknown, or other
tggagctccaccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatgggcgagcagcaccattggccccttttcccnnnntttccctcccagncggcctttcgcccgggcaaagggcccgttgaaaacgtggcccgttcggtccgtcccggcctttccggccaaaggcccccccggttgaccaatgccccccaagaaacgggcgggggccaaaagggcccaaaccccaaggcggggcggggcgttccccgggaaacccccgtggggttaaggggcccccccaaaaccccgcgggtgggtcttgttaccccttggggggcccccccacttgtggttcccccccggggggggaaaagaccccctccccccccccgggaaaatcttttttttcccttttttaaaaaaacggggggggcaaaaaaataatttttttcctccccccccgggg

SEQ ID NO: 62856 - DNA, 958 bp, Zea mays
  misc_feature: Ceres CLONE 1529593
  misc_feature: Encodes the peptide sequence at SEQ ID NO. 62857
agttggacaatccgcagctcctccatctcattcttccccccatcccatccccaaggttgaccggcgaaatcagcagtccgagaaccgcgagcttctgcctgatccagcctcatcccgccatggacgagtaagtctcttcccctcgccccttccatggatggatgaaggaacctaatgtttcgtgccctgtctccatccatcccagatctgaggagcacagcaacggcggcgggcacccccacccgcaccacgggtacgagtggaagttcccggcggcgctgagcgcgaacacgacgagcgtgcacgtgacggcgctggacggcgtggtgaacgtgaactcgctgttcacggtggccgtgttcgtggggctgtcgctggcgaccccggggcagctgcggagcctggcgggggacccgcggtgcgacgccggcccgggcgtggcgcggtcgctgctggtgctggaggtggtggccttctcgtccttcctcttctccagcctggtggcgcagggcctgaagctggcgctcaacctcatcaactccaaggacccgcacgacgcggcgcgcgcccacatcgacgcccgcgtgctccgcctcggcatgctcgcctccgccgtcggatccgtcgtcggctgcgtcttcctcatgacgtccatggtcatggtcgtgcaggtccgcctcggcacgctgagctgccccaccgaccgcgccgccgccaaggccgccgcgggcctcgtcggcctcgtcaccaccgcgctcgctttctacgtgggcaccgtcttctacaccttcacccactgatgccagttccatgcatccgtgcgctgcatcccaaatccatctagcgttgcgttgcgttgcgttgcaaagaacacatcgccatcagtggtgtcggtgtgcgaggaaattgaaaggaggacatgcaatctgcgttattactttgaaaaaaaaaaaaaaaa

SEQ ID NO: 62857 - protein, 212 aa, Zea mays
  misc_feature: Ceres CLONE 1529593
MKEPNVSCPVSIHPRSEEHSNGGGHPHPHHGYEWKFPAALSANTTSVHVTALDGVVNVNSLFTVAVFVGLSLATPGQLRSLAGDPRCDAGPGVARSLLVLEVVAFSSFLFSSLVAQGLKLALNLINSKDPHDAARAHIDARVLRLGMLASAVGSVVGCVFLMTSMVMVVQVRLGTLSCPTDRAAAKAAAGLVGLVTTALAFYVGTVFYTFTH

SEQ ID NO: 62858 - DNA, 689 bp, Zea mays
  misc_feature: Ceres CLONE 1529594
  misc_feature: Encodes the peptide sequence at SEQ ID NO. 62859
aaagctggagctccccgcggtggcggccgctctagaactagtggatcccccgggctgcaggaattcgtctcacccctagaaaaagccacaaagctagcttatttcccttcccttcacgcggcaagcggcggccggccttccgccgccatggccaccaccaccgctcccgtcctcctcgtcttcctcgttgccattgccacgtccgtcgccccctcaccattccccatcctgacgatggcggcggacgcggacaacggcaccacccacctgagcttcttcatgcacgacatcacgtcgggcgccagcccgaccgcggtgaaggtgatcaaggggcccggcgcggggtccacgccgacggcgccggcgctgggcatgacgttcggcgacatcgtggtgatcgacgacccgctgatggaggaggcgttccccgcctccgccccgctgggccgcatgcaagacttctacatgcttgcgtcccaaaccggggcggcgcttaatggtgtggccccaccctgctgctcaccgtcgggggccccacaaacgggaagacgcctcctccgtggtttgggccccgaacaaacacccggccaggaacttcccgggaaaaatccccgatctttcgggcgggccccggggaacatttccggaatgggcccaccgggccttacttggctttgtttttttatttt

SEQ ID NO: 62859 - protein, 180 aa, Zea mays
  misc_feature: Ceres CLONE 1529594
MATTTAPVLLVFLVAIATSVAPSPFPILTMAADADNGTTHLSFFMHDITSGASPTAVKVIKGPGAGSTPTAPALGMTFGDIVVIDDPLMEEAFPASAPLGRMQDFYMLASQTGAALNGVAPPCCSPSGAPQTGRRLLRGLGPEQTPGQELPGKNPRSFGRAPGNISGMGPPGLTWLCFFI

SEQ ID NO: 62860 - DNA, 736 bp, Zea mays
  misc_feature: Ceres CLONE 1529595
  misc_feature: Encodes the peptide sequence at SEQ ID NO. 62861
  misc_feature (197)..(197): n is a, c, t, g, unknown, or other
  misc_feature (307)..(307): n is a, c, t, g, unknown, or other
tcaccgcggtggcggccgctctagaactagtggatcccccgggctgcaggaattcgtctcacccctagaaaaaatcagcctcatcaacctcgacgaaggaggaacgaacggacaggttgttgcacagaagcgacatggctttcgcgcccaaaacgtcctcctcctcctcgctctcctcggggttgcaggcagctcantcgccgccgctgctcctgaggcggatgtcgtcaaccgcaacaccgagacggaggtacgacgcggccgtcgtccttcactactaccccccctgcggggaggttgctgccgnctgctgtcccggttccccgccccccccgcccgcagggggccggggcccggagtctggtgcccccccccccgggggggggggggggggggccaaaaattaaaaaccctctctctttgttccaccccccctgggggcccccctcccgggccagggggcaaagaccgggggggtttttccccttaagcctcccccctggggggccgctccgcaatcttttgtggaattaacgcgccctaggcgcgccctttgtggtgtccaaaaccattgtcccccccccccccccagatctttcttccgccgatagggagggagccccctgcgtccctacccccccccccgttcccgtcccgggcgcaccgtgtgccccccagttgggctcgtgggggcgcggaggggtgtcccccgtccctacgctgcttcacgaagttg

SEQ ID NO: 62861 - protein, 90 aa, Zea mays
  misc_feature: Ceres CLONE 1529595
  misc_feature (21)..(21): Xaa is any aa, unknown, or other
  misc_feature (58)..(58): Xaa is any aa, unknown, or other
MAFAPKTSSSSSLSSGLQAAXSPPLLLRRMSSTATPRRRYDAAVVLHYYPPCGEVAAXCCPGSPPPPPAGGRGPESGAPPPGGGGGGAKN

SEQ ID NO: 62862 - DNA, 793 bp, Zea mays
  misc_feature: Ceres CLONE 1529596
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
cccttcccnnnnnttcctctttacacggtagctnnccnccccccccccccccaaagtaggactccccgcggtggccgccgctctagactagtggatcccccgggctgcaggaattcgtctcacccctagaaaaagtagagctccctgctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgaaggaggaatcttgtattgagaccttgatgttaaaagcttatccggagttcagtttcagaatattggttggtttagtttggaaaccgcgtatcgtcgacccctccctctattctagtcggccaacagcttctataaaaagaaaaataacatattataggagaacacaaataaagagacgtaaaacaactccatcaatctcctgttatatatagcgcctgaatccgccactacataaaacacatactgtcaccccgctcggggagtacaccgcactatcaaatctccccgcaatggtgtcacttctcccgacaactcactacacgcgaagccggcgtgtataccgacactcatcattcgcctcaccccgtactaacacacactgcaccccccccatatttccgttcaccgcccaaccaccattattgcatcacaaagtagccccctgcggcactacatcgctctgagttgcatg

SEQ ID NO: 62863 - DNA, 798 bp, Zea mays
  misc_feature: Ceres CLONE 1529598
  misc_feature (1)..(1): n is a, c, t, g, unknown, or other
ntttattttttgttggaatgtagatagaatataaaaaccacaccatctgaaacaggagtcaacaggtggcggccgatctataacagaggatccccgggctgcaggaattcgtctcacccctagaaaatagtgattctctgattgaacgaggcgtgaaggagaactattcattgatgtcgatccttgacaaaagaccgatagagtctgcaattccaagtatttccaggcctatcatgtccttgtgatggaaatgaatatgccattgcttggagccctgaaacaaagcttgagacaacttggagtcccttggcgctcaatgggcaggtcttgaagacatggctcttaataaaagaaaaaaaatgagaacgctcgaggtacccaattcgaccccaaagtggagtcgtattacggggtgttcacaggcccgctctattacaaacgatccatggattggggaaaaccccggtggttaccccccattaatcgacctggcaagaacattccccccctattcgtccagctgtgctgtaaataaagtaaaaaagtaccggaccacgaaatgggctctttcccctaatcaatttacagaaaaccccgtaaacggcctaagggaaaaatctggaagagccattacaataataacacgggtaataaaatccgacggaaaagaatctctctggttttagtacagcccccatcgccctggtgaaacgcaaggctgcgtgtttgaaaatctgtgaaacaataccgccttttttaaactcccgaaacgaaataataaacccatggaatttagtg

SEQ ID NO: 62864 - DNA, 600 bp, Zea mays
  misc_feature: Ceres CLONE 1529606
  misc_feature: Encodes the peptide sequence at SEQ ID NO. 62865
  misc_feature (92)..(92): n is a, c, t, g, unknown, or other
  misc_feature (414)..(414): n is a, c, t, g, unknown, or other
  misc_feature (429)..(429): n is a, c, t, g, unknown, or other
  misc_feature (435)..(435): n is a, c, t, g, unknown, or other
  misc_feature (505)..(505): n is a, c, t, g, unknown, or other
ggagctccccgcggtggcggccgctctagaactagtggatcccccgggctgcaggaattcgtctcacccctagaaaaacacaggaaccaccnggaaaaaaaaatcctataaaacgacgcgcccgtctcctcccccgccgtcgtagctccttctcctacacagaaaagccgtcgcctactcgcctccggccaaaaaactgactccacacacgacccaaatcttttcctctccacaggcgactcccaacgcaacagcagctcgtcgagcgagtcgtcgccggccggccggtatatacgcaagaaagccaagaaaaacacttctgcctcttcctccatatccaagaaccaaaggtagctagctagccgcgactcgttggctagacgatttcagcagcagcgcaggatggtggcgccngtggtgattgcgtcngccggnctgggcatgctggccggcgtggcgatggccaaccggtccctcgggaaacgggctcccggcggccttcaangtgggaacgcggcgcctgcgctgcgcccacgtgcgggggcttccggccgcgttgaaatggattctgcaaccggttggtcccgaaggggaaattcc

SEQ ID NO: 62865 - protein, 66 aa, Zea mays
  misc_feature: Ceres CLONE 1529606
  misc_feature (35)..(35): Xaa is any aa, unknown, or other
MVAPVVIASAGLGMLAGVAMANRSLGKRAPGGLQXGNAAPALRPRAGASGRVEMDSATGWSRRGNS

SEQ ID NO: 62866 - DNA, 690 bp, Zea mays
  misc_feature: Ceres CLONE 1529608
  misc_feature (394)..(394): n is a, c, t, g, unknown, or other
  misc_feature (395)..(395): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (402)..(402): n is a, c, t, g, unknown, or other
  misc_feature (403)..(403): n is a, c, t, g, unknown, or other
  misc_feature (414)..(414): n is a, c, t, g, unknown, or other
  misc_feature (690)..(690): n is a, c, t, g, unknown, or other
ggagctccccgcggtggcggccgctctagaactagtggatcccccgggctgcaggaattcgtctcacccctagaaaaagggccctgcagcggcggcagctggcgggagagaggcttggcttgggactgggccgcccggccgcgaggaataaactcactcctgccttcatacgtatccatagccgcggcagtacgtgtatgtggttagctatacgcgacctcagctcgggcgcaagctacaaccccgaccaggcgagaagaagcatcgatagtgtgacgagctaacccaccagcagcaacgtaatccaaatccatggacaaccagccgctgccctactccacaggccagccccctttttttttcccccccccccgggggggaggagggggggggnncnnnccnncctccccaccnttttcccaccacccaccaggataaaaaaaaatattgtgcccgggggggggggggttcttccgcgaaccataccccccgaaagggggtaacccccccttcccctccccgactttccggaaactctcctgctgcccttcgggccagggagacaaaaaaaactatagaaggtctgtcaatgccccttccgtgttttttctctctcaaaatccccctcggtctttcccccaaagccgtggcggctgttttaattctcgcgaggtcgcggattttccgctn

SEQ ID NO: 62867 - DNA, 668 bp, Zea mays
  misc_feature: Ceres CLONE 1529609
  misc_feature: Encodes the peptide sequence at SEQ ID NO. 62868
  misc_feature (374)..(374): n is a, c, t, g, unknown, or other
ggagctccccgcggtggcggccgctctagaactagtggatcccccgggctgcaggaattcgtctcacccctagaaaaacagagccgccgacaacgctctctaccgtccgagaccccaagcaccagcgcggcggcgggggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcaggncgacgagggatcagctttacaggaaatcagggctcgtgctgaagatgtgcagggcaagaatgtgctccacaacttttggggcatggattttaccactgataaactcaaatccccaggggaaagaatggcaaaacttaatcgaaccccttgttgattccaaaaaaaccgaaccccccctgttccgtttggtccggaccgggtttccccaagaggggcccaaacccatttaaaaaaacctggtttttcttgggtccccaaaatcccaaaaaccccccaaaaaaggggtggaatatt

SEQ ID NO: 62868 - protein, 125 aa, Zea mays
  misc_feature: Ceres CLONE 1529609
  misc_feature (11)..(125): Pfam Name: Ribosomal_S3Ae Pfam Description: Ribosomal S3Ae family
  misc_feature (75)..(75): Xaa is any aa, unknown, or other
MAVGKNKRISKGKKGGKKKTVDPFSKKDWYDIKAPSVFSVRNIGKTLVSRTQGTRIASEGLKHRVFEVCLADLQXDEGSALQEIRARAEDVQGKNVLHNFWGMDFTTDKLKSPGERMAKLNRTPC

SEQ ID NO: 62869 - DNA, 624 bp, Zea mays
  misc_feature: Ceres CLONE 1529625
  misc_feature: Translation starting site: 240
  misc_feature: SWISSPROT Homolog: EC 1.14.99.33 Delta(12)-fatty acid dehydrogenase
  misc_feature (555)..(555): n is a, c, t, g, unknown, or other
tccccgcggtggcggccgctctagaactagtggatcccccgggctgcaggaattcgtctcacccctagaaaaaggccaggctccctccctcctccctgcaaatcctgcagacaccaccgctcgtttttctctccgggacaggagaaaaggggagagagagaggtgaggcgcggtgtccgcccgatctgctctgccccgacgcagctgttacgtcctcctcagtctcagtcaggagcaagatgggtgccggcggcatgatgaccgagaaggagcgggagaagcacgagcagctcgcccgagctaccggtggcgccgcgatgcagcggtcgccggtggagaagcctccgttcactctgggtcagatcaagaaggccatcccgccacactgcttcgagcgctcggtgctcaagtccttctcgtacgtggtccacgaccgtggtgatcgccgcggcgctcctctacttcgcgctggccatcatagcggcgctccaaaagccgctccgctacgctgcctggccgctgtactggatcgcgcaggggtgcgtgtgcatcggncgtgtgggtcatcacgcacgagtgcggcctacacgccttcatcgactactcgctcctggacgacgtgtc

SEQ ID NO: 62870 - DNA, 631 bp, Zea mays
  misc_feature: Ceres CLONE 1529630
  misc_feature: Encodes the peptide sequence at SEQ ID NO. 62871
  misc_feature (631)..(631): n is a, c, t, g, unknown, or other
ggagctccccgcggtggcggccgctctagaactagtggatcccccgggctgcaggaattcgtctcacccctagaaaaaaggaccggacgcgcacaaggcaataaataaaaagcccaacgctgggctccgctagctctcggtctctctggagtctggactcgcctccacggctccaccatgtatcccaaggcggcagacgaaggtgcgcagccgctggccacgggcatccccttcagcggcggcggcggctactaccaggcgggcggcgcgatggcggcggcgttcgcggtgcaggcgcaggcgcccgtcgccgcctggtccaccgggctctgcaactgcttcgacgactgccacaactgctgcgtgacgtgcgtgtgcccgtgcatcacgttcgggcagaccgcgaagatcatcgaccggggctccacgtcctgcggcaccagcggggcgctgtacgcgctcgtcatgctgctcaccggctgccagtgcgtctactcttgcttctaccgcgccaagatgcgcgcacagtacgggctccaagtgagcccctgctccgactgctgcgtgcactgctgctgtcagtgctgcccgctctgccaggagtaccgcgagctcaagaagcgaggccttn

SEQ ID NO: 62871 - protein, 151 aa, Zea mays
  misc_feature: Ceres CLONE 1529630
  misc_feature (47)..(146): Pfam Name: PLAC8 Pfam Description: PLAC8 family
MYPKAADEGAQPLATGIPFSGGGGYYQAGGAMAAAFAVQAQAPVAAWSTGLCNCFDDCHNCCVTCVCPCITFGQTAKIIDRGSTSCGTSGALYALVMLLTGCQCVYSCFYRAKMRAQYGLQVSPCSDCCVHCCCQCCPLCQEYRELKKRGL

SEQ ID NO: 62872 - DNA, 709 bp, Zea mays
  misc_feature: Ceres CLONE 1529639
  misc_feature: Encodes the peptide sequence at SEQ ID NO. 62873
  misc_feature (1)..(1): n is a, c, t, g, unknown, or other
  misc_feature (320)..(320): n is a, c, t, g, unknown, or other
  misc_feature (363)..(363): n is a, c, t, g, unknown, or other
  misc_feature (364)..(364): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (423)..(423): n is a, c, t, g, unknown, or other
  misc_feature (438)..(438): n is a, c, t, g, unknown, or other
  misc_feature (466)..(466): n is a, c, t, g, unknown, or other
nccagctggagctccccgcggtggcggccgctctagaactagtggatcccccgggctgcaggaattcgtctcacccctagaaaaaaccgccaccatttaagcaacacagcagccaaagcagcggcatctcagctctgttcccagctagttagccgcggcgccatggctcctctgctgttcagggacatgaaggggctctcgtgctcgtcccaggcgtccacggcgacatgcccgagcctggagcggcacccgacgccccgcccacacaaggccagcgccggcgccagccccttggctcccgtggggggctgccgagcccnggaccattatttcaccggcttgacgggaaaaaaagggaagccnntttttttttccccctcccccccggggggaaagaaagagggggnnnnnnnnnnnnctccnccaacccccccccantttataaaaaaaaaaaaaaaattttaanccttccccctgcggggcgcccttccttaaaaaaaatcctcttatgttctttggaacctctccccccctccacctcaaccctaatttgcaaacgacaaaatgaaaacataccttattcccttcatgacgtttaaaaacccccccccgcccccaacacgccacggtggcgaatccgccccaaacaatacccccccgcgccagaacaccactcttaacccgcccaaaaaccccacacaatatcctt

SEQ ID NO: 62873 - protein, 100 aa, Zea mays
  misc_feature: Ceres CLONE 1529639
  misc_feature (53)..(53): Xaa is any aa, unknown, or other
  misc_feature (68)..(68): Xaa is any aa, unknown, or other
  misc_feature (82)..(82): Xaa is any aa, unknown, or other
  misc_feature (83)..(83): Xaa is any aa, unknown, or other
  misc_feature (84)..(84): Xaa is any aa, unknown, or other
  misc_feature (85)..(85): Xaa is any aa, unknown, or other
  misc_feature (86)..(86): Xaa is any aa, unknown, or other
  misc_feature (92)..(92): Xaa is any aa, unknown, or other
MAPLLFRDMKGLSCSSQASTATCPSLERHPTPRPHKASAGASPLAPVGGCRAXDHYFTGLTGKKGKPXFFSPSPPGGKKEGXXXXXPPTPPXFIKKKKKF

SEQ ID NO: 62874 - DNA, 668 bp, Zea mays
  misc_feature: Ceres CLONE 1529646
  misc_feature: Encodes the peptide sequence at SEQ ID NO. 62875
  misc_feature (406)..(406): n is a, c, t, g, unknown, or other
  misc_feature (408)..(408): n is a, c, t, g, unknown, or other
gagctccccgcggtggcggccgctctagaactagtggatcccccgggctgcaggaattcgtctcacccctagaaaaaacagctcgccttgcctctgttcagctcacggcggaagacgagggcgacagcacacgagagggaggcaggagcggaagcgcgcaaggaggtcagtgaagcacgcgcccacggcccacatccagagcagcacagcaccgcgcgatggcgtgcatcaacatgtacaaccctgacggcgcgcccgggttcggcggcgggccgcagccgccggccgcgctgggcccgcgcgtctccttctccagcgacttcgccgtggagccgcccccggtgcagaaccgatttatcaccccccccccgggggggaaggaaaggtgcaacttccaattctcccntncccacccacccccatgatggggggccgacccggctccttctccaagggcgagggatccttccccctcagggaaaaacggcaggctgttttccccgcccgggggggccgcccaccacctttcccccaacaaacctccttgggctgtcagctgtcgggggcggctttgcgaaaaaaaaccacaaagggccttcccgcccccctacaaacaacgggcccccggcccggctggaacaagaaaccactccccctctgcagacaag

SEQ ID NO: 62875 - protein, 68 aa, Zea mays
  misc_feature: Ceres CLONE 1529646
  misc_feature (63)..(63): Xaa is any aa, unknown, or other
  misc_feature (64)..(64): Xaa is any aa, unknown, or other
MACINMYNPDGAPGFGGGPQPPAALGPRVSFSSDFAVEPPPVQNRFITPPPGGKERCNFQFSXXHPPP

SEQ ID NO: 62876 - DNA, 656 bp, Zea mays
  misc_feature: Ceres CLONE 1529647
  misc_feature: Pfam Name: DUF706 Pfam Description: Family of unknown function (DUF706)
  misc_feature: SWISSPROT Homolog: EC 3.2.1.23 Beta-galactosidase
  misc_feature: SWISSPROT Homolog: EC 1.13.99.1 Inositol oxygenase
aaagctggagctccccgcggtggcggccgctctagaactagtggatcccccgggctgcaggaattcgtctcacccctagaaaaatttttcctttgtggtggacaatgaggactacgagaacctccagcggctgcatgtgttcaacaagtatgacctgtacagcaagagcaacagcaagatcgacgtggaggaggtgaagccctactacatgtccctaatcgacaagtacttcccggccaagctaagatggtgagaaggggcggcctggcctggacctggatgatagatggaaccccaaggccccaccaagagctgtcgttccaagtgtccatgtaccatatacatatctctactactctataagactctattgtataccatccgtgcaccgcggttctgccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgcccgctggcgtaatagcgaataggcccgcaccgatcgcccttcccaacatttgcgcagcctgaatggccaatggaaattgtaagcgttaatattttgttaa

SEQ ID NO: 62877 - DNA, 658 bp, Zea mays
  misc_feature: Ceres CLONE 1529648
  misc_feature: Encodes the peptide sequence at SEQ ID NO. 62878
  misc_feature (1)..(1): n is a, c, t, g, unknown, or other
  misc_feature (334)..(334): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
  misc_feature (473)..(473): n is a, c, t, g, unknown, or other
naactctggagctcaccgcggtggcggccgctctagaactagtggatcccccgggctgcaggaattcgtctcacccctagaaaaaacgacgcgtcttgtaaagttgtaacgaaccgaaccggaacgtaacctctgtctcgtcaacgacctcgtccgtcgcgcccgaggcgaggaagcaacccgccccagtttcgcgctatggcgacggcgacgtcatcgaggcgcgtgtcggtgccggccctggcggccgccgccgtgctcctgctcgcgtccgtagccgcggccgattacccacaacggcgtgtacgacccctgcgcggactcttctgtgcancccggcgacgggtcccccttcggggtttttttctccccccccgaggggaaagacaggggaannntnncacttctccccctccacaatcctcttagggataaacaaaccccccgaaggggggggggggggcgccccccangccaacaaaattttcccccctccccggtcaacccccccctccttccaccccgttttctttcggggggggaccggggggggtttttcccccggaaaaaaaaacacacgcgcgggcccccccctggggtgtcctctgcccactttcttgtaacccgggggaccgggcttcccccttgcccctggagt

SEQ ID NO: 62878 - protein, 76 aa, Zea mays
  misc_feature: Ceres CLONE 1529648
  misc_feature (46)..(46): Xaa is any aa, unknown, or other
  misc_feature (66)..(66): Xaa is any aa, unknown, or other
  misc_feature (67)..(67): Xaa is any aa, unknown, or other
  misc_feature (68)..(68): Xaa is any aa, unknown, or other
MATATSSRRVSVPALAAAAVLLLASVAAADYPQRRVRPLRGLFCAXRRRVPLRGFFLPPRGERQGXXXTSPPPQSS

SEQ ID NO: 62879 - DNA, 652 bp, Zea mays
  misc_feature: Ceres CLONE 1529649
aagctggagctccccgcggtggcggccgctctagaactagtggatcccccgggctgcaggaattcgtctcacccctagaaaaataaaaacctctcaggctctcacgccgccgccgccgccgctctcaactacccttgcccctcgccagttctccacagcttttgtttccagcatttgaatttggatcggcggtgtctttgttctttgtatctttcttttttggtcgcggttttggttctgatggggatttgagctgcgcatctggctgaggacgatgaagattgtatctattggtctcgttcgtcgtaacaggcatttgattgcctttgccgaccatcctgatatatcaccacccatattccgagtccgctcccaacggtcgtcagtttctatcaactttttcattccctttagattttgatgtttgatttataatatatttgctgggcctatgataaattttcaaaaaaagacagcatatgtccgaattcctgtatgtggataacctaatcttctctatgaggtccatcacttattataaacttttatgtggcttggaaattccattcctttgaaggcaaaaagaaaattggggaagctattctggtaagacgtcctcccggttgaattaaaaaaccctttaatggccttt

SEQ ID NO: 62880 - DNA, 797 bp, Zea mays
  misc_feature: Ceres CLONE 1529651
tttgttttttttggcgggtggaaataagaagagaaaaaaaattatatgtcgccggccgaatagggaactcaccgtggtggcggccgctctttactagtggatcccccgggctgcaagaattcgtctcacccctagaaaaaccccttctgttccccctcccgttgcttgctgtgttcttgccaccgactcctctagttgtaatcctgccgctagttatgtgctagtagtagctgtcctgctgtaaccttctcttgcaatgaaaggagagattatatggttggtagaaaaaaaaaaaaaaaaaacgagacgcttcgaggtacccaatctcgcccctaataaagagttcatatttacgcgcgactccctaggccgtcgttttataaacagccctgaactgggaaaaacctttggaggtaaccccaaaatgaattctcctttgccaaccaccaatccaccactttttgccaatctggcattaaataacgaatgaagcccaccaccccattcgtgtcatctttccaaaatgattgtgccagcacctggaatggggaaaatggaaaaatctcgttcaaccgttcaacatatttttggataaaaattccaccacttaaattttttagggtaaataagaactaattattttatattgataccacccagatcccccaaaaccccattcaaataatccgcccatattcaaattcaacaattaacaacaaaaccgcacgaataaagggtttagaagaatgactttccatagatattgtgtaacaagagaaagtacccccatgttgttt

SEQ ID NO: 62881 - DNA, 768 bp, Zea mays
  misc_feature: Ceres CLONE 1529653
  misc_feature: Encodes the peptide sequence at SEQ ID NO. 62882
  misc_feature (20)..(20): n is a, c, t, g, unknown, or other
  misc_feature (40)..(40): n is a, c, t, g, unknown, or other
ttttttttgtaatgaggaanattataatggtaggtttgcncacatacaaccacttaaagtggtactacccgcggtggcggccgctctagaactagtggatcccccgggctgcaggaattcgtctcacccctagaaaaaacatcgggaaccgccgccgacgccgcaagaggagacgcatcgaggttagcacgcgaagaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaaccctgccatggtggtcacggtccgccatcagttgaacgtcttgcctgcacttcagtaggccatttttcatggctctagttgtatttgaatccagcgttcgccacccaaaaaaaatcagacattcgttttgtgaaaccccaaataaaaaaaaaaaacgagaccgcccgagggcacccaaatttccgcccctaataatgaagtccgtaatttacgcgcagcctccctgggcctgtcgtttttaacaccgtccgtggaccggggaaaaaacccctgggcggttccccccaacttttatttcgccctttgccaggcaaatttccccccttttccaaccaagtctggggcgttaattaagcggaaagaaagaccccccgccgaccccaaattcggcccccatg

SEQ ID NO: 62882 - protein, 39 aa, Zea mays
  misc_feature: Ceres CLONE 1529653
MTCVGTYISSDALVCLWRDVNPAMVVTVRHQLNVLPALQ

SEQ ID NO: 62883 - DNA, 612 bp, Zea mays
  misc_feature: Ceres CLONE 1529664
  misc_feature: Encodes the peptide sequence at SEQ ID NO. 62884
ccccgcggtggcggccgctctagaactagtggatcccccgggctgcaggaattcgtctcacccctagaaaaattggggagacctccttcctcatggctcggaataatctttgtgaccatggcatcgtcccatctgaccctcccctgtgcgaggtgagagggagctacgtctggcacttggaccagactatctttctcctggctgattgccatgacgtcacttacttaggctaggactactgattgcggccgcaggagggtccctgtacctgattatgtgcgtggagcgccctccgcttctggatggactatgactactgcgtctccctcggataaatggcttggtcctccttatctcatgatgttgtgtgagtcttacatgaactcgctgcatattgtcgatgtcctaaatgaccacacataacgagcactctcgaggtacccaattccccacatctcgaggcacactactcgccctctctggactcctatttcccacgcctcgtcggcgaaaaccctgaacttacccactgagtcaaccctgcagctcatccccctttctccacctggcgtaatacccattagcccgcaccgatcatccttaacacgctcg

SEQ ID NO: 62884 - protein, 46 aa, Zea mays
  misc_feature: Ceres CLONE 1529664
  misc_feature: SWISSPROT Homolog: EC 3.4.11.18 Methionyl aminopeptidase
MARNNLCDHGIVPSDPPLCEVRGSYVWHLDQTIFLLADCHDVTYLG

SEQ ID NO: 62885 - DNA, 642 bp, Zea mays
  misc_feature: Ceres CLONE 1529666
  misc_feature: Translation starting site: 154
  misc_feature: SWISSPROT Homolog: EC 3.6.3.14 H(+)-transporting two-sector ATPase
  misc_feature (453)..(453): n is a, c, t, g, unknown, or other
atagctggagctccccgcggtggcggccgctctagaactagtggatcccccgggctgcaggaattcgtctcacccctagaaaaaagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggnctcccgcccatcctcacggcgctcgaggtgctcgacaacacatccgcctcgtgctcgaggtggcgcacaactttgcgaaaacatgttggcgcaccatcgctttggaccgcacgaaagggctcgtccggcggccaggcggtcctcaaaactggtctccccccatcacccgggctggttgggagggcttac

SEQ ID NO: 62886 - DNA, 814 bp, Zea mays
  misc_feature: Ceres CLONE 1529670
  misc_feature: Encodes the peptide sequence at SEQ ID NO. 62887
  misc_feature (11)..(11): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
tcgtttttttntnannnntntggaacaggaacaaggtctcacctcatacccataccggcgctcaccgaggtggcggccgctctctcacagtggatcccccgggctgcaggagttcgtctcacccctagaaaaaagagcaaagctagtcacctgcctatctatctagcgagagagagagaggaaagctagctagctagcatggagtgcggcagcaagaaggcagcaggcggtgtgttgacgctgctgcttctccagctggtgttagctccgatgacggcgacggcccgcctcctgcaggcggatacctccaccgtggttggcctgtacatcatcgcgagggagtttggacatccaatgtaaagcttcctctgtggtgaaaccagggtatctccaccatggctataacggccacccgtggggtcgccatcgtatttgcccaattccgccctggtggtatattaggatcttaccccccctctacaaatcttgttgttggccaaaaaaaacaaaacgaatggatacgggggggcgttcatccactcttcttggcctgccgtcagtgagaggactccttcttattggtgaagccgctccgtgagaacagcctcttcgcgccaacggcaggttgtcttcttcacgctcccaaacaaatgaccgtgaatcaactacgacagggctgcctccaatactccgccacctagcaaggccgaataccgtatatttaccgcgcctaacatttaccattgagccaccgcctcactatatcaaatactctctccatgacgcttagggagataactgctcacgtggccta

SEQ ID NO: 62887 - protein, 53 aa, Zea mays
  misc_feature: Ceres CLONE 1529670
MECGSKKAAGGVLTLLLLQLVLAPMTATARLLQADTSTVVGLYIIAREFGHPM

SEQ ID NO: 62888 - DNA, 760 bp, Zea mays
  misc_feature: Ceres CLONE 1529674
  misc_feature (7)..(7): n is a, c, t, g, unknown, or other
  misc_feature (15)..(15): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
ttttaanttaatttnaccacaaaacaacaaacataccagccccnnttnnnnnggggnnnnnntaaaactggagctccccgcggtggcggccgctctagactagtggatcccccgggctgcaggaattcgtctcacccctagaaaatagtgccaaggatgcaacaaatgtggagaaggcattcatgaccatggcaggggagataaagaacaggatggcaagtcaaccagctgcaagtggtgctagtaggcctgcaactgtgcaaatgcggggtcagcctgtttctcagcaaagcagctgctgctcttgatcgtctgtctagatcacagtagtgtgattgtgcagcaagcgaaacttaaattggttgctccgtgtacattaagcctattactgtcccaaagaactcgatgttatctatcgggatactggaaagtctgtctatccacctgcaacgctttaagcagatattggccctgtttttatcctgccaaaaaaaaaaaaaaaaaataccaagacccctcggaggttaccccaatttccgcccctataaattgaagtccgaattatacccgccgcttcccctgggcccgtcccttttttaaaaacctctcctggaactgggaaaaaacccccgggcggtttacccccaaactttaatccccccctttgcaaacaaaaaatcccccccttttccccccccatttgggggcgataatataccccaaaaaaaaggccccgccccccccaataccgccccctttc

SEQ ID NO: 62889 - DNA, 767 bp, Zea mays
  misc_feature: Ceres CLONE 1529675
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (18)..(18): n is a, c, t, g, unknown, or other
  misc_feature (19)..(19): n is a, c, t, g, unknown, or other
nnncctggaaagaggggnnggggagggtgagagtaaaaaaatcccccctcaaagtggggctcaccgaggtggcggccgctctagaactagtggatcccccgggctgcaggagttcgtctcacccctagaaaatgcatacttcgccccgtcgtttcgtacggccgataatcgcattcgtatctacacgcaaagtatacattaagggctagtttgggagctcaattttctaagggattattattttcccaagagaaaatgaactaatttccctttaaaaaataaaaattcattgggataatatggttttcaaactagccctaatatgtataatattcttgtgtatatatgtggagacaaatccttgttcgattagtctcgggtattgctctgatatatgtcattgtgctagtaatttctggtaaactttccggatgtactttcaagctgtaaagaatacctatacatggtgtgtttcaaaaaaaaaaaaaaaaaacgagacgctcgagggacccaaatccgcccctatagggagtcgtaattaaggggggctcacggggccgacgttttttaaaccggccgtgactggggaaaacccctggggagtttacccaactttaaaccgcccttggcagccacctccccccccttttcggccaagctgggcggtattttacccgaaaaaagagccccgccaaccggatcgggcctcctttcccaaacaaagtttggaccgaaaacccctgaaaatcgggcccaaaataggaaaa

SEQ ID NO: 62890 - DNA, 653 bp, Zea mays
  misc_feature: Ceres CLONE 1529678
  misc_feature: Encodes the peptide sequence at SEQ ID NO. 62891
  misc_feature (1)..(1): n is a, c, t, g, unknown, or other
  misc_feature (61)..(61): n is a, c, t, g, unknown, or other
  misc_feature (387)..(387): n is a, c, t, g, unknown, or other
natctctgtagctccacgcggtggcggccgctctagaactagtggatcccccgggctgcangaattcgtctcacccctagaaaacttttgtgcttgctcttttttttaagatttgttttttctgctttcgttaagggggagagcgagttcaaattctgagtagtgagcacaaatctgtctgtctggtgtgagcacttcatgtttaccagcttctggtgttgtagctgccaagaaatgaactttgggagctgtccggccgtggccggggacgcgacggcagatgagctgcttgaacaggcgcgggggctggtgccaccagccctggccgctgcgcgcgcggccactggctttggtgggcggcgaaaggctatcgcagcgagggctggnaaggctgccgccctgcctgtcggacctgtccagccacccctgcttctccaagaactcgctctgtcgggagctgttgcagtcggtggctgcaacgctagcggaggccgccgagctcggtgcgcgctgccacgagcctccgaaggcgggaaagctgccgatgcaaaccgacctctaccccctggccgggaaactgggacctcaaccctcagggattgttctctttcttgtaaaagactgggtggggttgttctgaacccgacggtttc

SEQ ID NO: 62891 - protein, 119 aa, Zea mays
  misc_feature: Ceres CLONE 1529678
  misc_feature (36)..(36): Xaa is any aa, unknown, or other
MSCLNRRGGWCHQPWPLRARPLALVGGERLSQRGLXRLPPCLSDLSSHPCFSKNSLCRELLQSVAATLAEAAELGARCHEPPKAGKLPMQTDLYPLAGKLGPQPSGIVLFLVKDWVGLF

SEQ ID NO: 62892 - DNA, 619 bp, Zea mays
  misc_feature: Ceres CLONE 1529686
  misc_feature: Translation starting site: 147
  misc_feature (262)..(262): n is a, c, t, g, unknown, or other
  misc_feature (385)..(385): n is a, c, t, g, unknown, or other
  misc_feature (619)..(619): n is a, c, t, g, unknown, or other
tggagctccccgcggtggcggccgctctagaactagtggatcccccgggctgcaggaattcgtctcacccctagaaaaacgggagccacggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcanctacgccaaggacgcggccccagtcagcaccaagggcgcaggcgcgtcgctgctcgccgcagcgggcgcggtgaccgcgtcggcggggcccgcgctggcgctcgtggacgagcgcatgtccancgaggggcaccgggctgagcctcgggctcagcaacaactgctgggggtggatcctccctggggtcttcgggctcatctggtccctctacaccatctacacctctgacctcgacgaagacgaagagtccggtgggctctcgctctagatccacctcctctccctgtaatgatctgaatgtaaacatggtggtggtcatcggtgtaaatttagacatggctatttgcatctaagan

SEQ ID NO: 62893 - DNA, 629 bp, Zea mays
  misc_feature: Ceres CLONE 1529705
  misc_feature: Encodes the peptide sequence at SEQ ID NO. 62894
aaaactggagctccccgcggtggcggccgctctagaactagtggatcccccgggctgcaggaattcgtctcacccctagaaaaagttttgttctctgtgagcgtcgtgggtgttgatggcgtcaacggcgtactcgcggccatccaagccgcctgggccggcggccggagacaggagcggaccgcggctggccaaggagctcggcaggatcgagcccaagaagctgggcatcgggctggttgccggctgctgcttcgcgctgctcacctacctctcctttgcccggctgtttgccatctactcgccggttttcggtaaggcctttgaatccgattccctaccaagaattagaattcgtctcttgcgtgtgcggtgagagttccttcaatgaaccgggccgcagacagctcgtcgtccatggtgttgaagaacatgccgccagcaacgacgacggtgccgggtacagctacaggggcgctgccggtggaggagcagaaagaggttcgtgaccctgaggcggacccgcacatgccgaacttaccggaggtcacagaaaaggatcagcaggaggaggccacggcgacgaagccagaggccaagatcacctgcgacgagaacggcgtcgacga

SEQ ID NO: 62894 - protein, 86 aa, Zea mays
  misc_feature: Ceres CLONE 1529705
MASTAYSRPSKPPGPAAGDRSGPRLAKELGRIEPKKLGIGLVAGCCFALLTYLSFARLFAIYSPVFGKAFESDSLPRIRIRLLRVR

SEQ ID NO: 62895 - DNA, 623 bp, Zea mays
  misc_feature: Ceres CLONE 1529708
  misc_feature: Encodes the peptide sequence at SEQ ID NO. 62896
  misc_feature (522)..(522): n is a, c, t, g, unknown, or other
aaagctggagctccccgcggtggcggccgctctagaactagtggatcccccgggctgcaggaattcgtctcacccctagaaaaaaatctcggcaagcgggagccagcccagaccagagcgaagacccaccgtcccactcccagcgctcgatttgaaccaactcgaacgcgacgctttcaagccccccaacctaatctacgatctccctccgacctatacgaaatctccgcctcccctggcccctgccctgctgcgcccctgcataggaagaaagaaacgcacgcacgccccccgcggcaaagggaaccgtcgccgcgttgcgagagtccggaaaactgaatcggagcaccggaagagaggccgaggccacgaggagagggtaccggcggccatggagcggtaccatccctcagaggtgtacgagctcttcgtgcgccacatgaacacccctacggtggtggtggacaacggcgtgcgcgcgactgcgacgctggtgcaggtgcactgcgcgaggtatcacgncgtgctgctcgaagcgatggtcgccctgtccgaacacggtgtctgcgtcagcaagggctacatctcatcagagacggtcgctgattcatggacgtgtccac

SEQ ID NO: 62896 - protein, 77 aa, Zea mays
  misc_feature: Ceres CLONE 1529708
  misc_feature (44)..(44): Xaa is any aa, unknown, or other
MERYHPSEVYELFVRHMNTPTVVVDNGVRATATLVQVHCARYHXVLLEAMVALSEHGVCVSKGYISSETVADSWTCP

SEQ ID NO: 62897 - DNA, 803 bp, Zea mays
  misc_feature: Ceres CLONE 1529714
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (9)..(9): n is a, c, t, g, unknown, or other
  misc_feature (11)..(11): n is a, c, t, g, unknown, or other
  misc_feature (16)..(16): n is a, c, t, g, unknown, or other
  misc_feature (18)..(18): n is a, c, t, g, unknown, or other
  misc_feature (48)..(48): n is a, c, t, g, unknown, or other
  misc_feature (89)..(89): n is a, c, t, g, unknown, or other
  misc_feature (96)..(96): n is a, c, t, g, unknown, or other
nngggcntntnaagananggggggcgccagaacccaacaaaggggacnaacagcgccccctcccacccgggaaccccccggggggggcnacctcgnctttccacccacgagcccccgagttgcagggggtcccctcaccgccggaaaaaccaaaggcaccggtcgcacttaacccattcacaagtgtgtttgataccctgaagaagttgcttgaactggacttcaagtaaaaaacagtggagcattgtccagtagccaatagccaattgcccaacttctcgacttggatcttcaatggaatgaagttcagtttattctgacgttggctagccagtgagatctttttaaggacattgtccgttttgcctattatataagagtgggatatgtaagattaagacccgcgcgaaaaccaggaggaagccggaggccttttttccggaaacaagcagcggggggggggagggacgacccaaacaaagagaaaccacaaatcgcggcagataagaagtaggaagccgcgggcggccccccgagagagcaccacagacgcgggccccagagacaggggggccccgaggcccgagaccccacccaccggggccccacgtcgccgacgcaccacgccgacgaacgccgagagaaacacggcccggcgcgccaatacacgcaccgcgggagagcgcgcatggggcacgcccccgccgcccccccgctgcaacccccgcccggtgcgcacgcaccgcgataaaggcacaacacgacaccgacagaaaacaccgacagcgcccgaccccccaccg

SEQ ID NO: 62898 - DNA, 649 bp, Zea mays
  misc_feature: Ceres CLONE 1529715
  misc_feature: Translation starting site: 129
  misc_feature: SWISSPROT Homolog: EC 3.2.1.23 Beta-galactosidase
ataactggagctccccgcggtggcggccgctctagaactagtggatcccccgggctgcaggaattcgtctcacccctagaaaattctacagcggatatggctatgcctccccggtgacacacccaaacatgtacgctgcagagtatgggacgtacccgctatatggtaaccagcatctagtgagctatagagctcccctccgacgtgttccctctgacaggaaacaaacgttttagtccggtgagaatagtagcgtctcgtgaaaaagtgcctttataacgctgtcctaataagtgggcgagatatgttgttgcatcgttatcgttatggtgcctgtaactgttgtgtgtgccgtgtgcgtccagaagaattgcatggaatgtaactctagtcttattgtactacatcataaagacatgttatactttcaagaaattttgacttgtaaataaattaaactattgtttgtgcgatctcaaaaaataaaaaaaatcagacgctagacgtacccaattcacactataatgagtcgtattacactgcgctcactgtgcccctgttttacagcgacgtgactggtaaaaccctggcgttacccaacttaatcaccttgtgacacatccccctttctccagcagatataataccc

SEQ ID NO: 62899 - DNA, 669 bp, Zea mays
  misc_feature: Ceres CLONE 1529716
  misc_feature: Encodes the peptide sequence at SEQ ID NO. 62900
  misc_feature (397)..(397): n is a, c, t, g, unknown, or other
agctcaccgcggtggcggccgctctagaactagtggatcccccgggctgcaggaattcgtctcacccctagaaaacagtgagtattgcttccacaactgtaaagcagccccaattatcattgtgcctgggaaagaagctggtgaacagtctgtgctttgaaggaagatgagtaggagagttgttcctgttcgttgtactgtcagtttaagtgataaagtgttgtatattggtgctggcttattgtgggaacatgtccttaagtgctttgctttgcttgtaatctgaagctctgaaccctctgtctggcttggttatgaaggaatgcttagaaaccgggagagtagcagacaaacctttttccccccccccgtacgtggggtgggcggttgctgacanaatactttcttcccccccccttgatatgaattaaagaacctttcacccaaaaaaacaggccggtacgccgcacccgccctcctgcgtccccccgccctcctcctcctctccgccgtctcctctcctgccccccgccattgttgtattctcttggtgagagataacgccttccgccccttttttttcccccctcctccctcttacaggtgcctctttttcccccccccctcttgtccccctcttctaccccctcttttatgcggccccccctg

SEQ ID NO: 62900 - protein, 39 aa, Zea mays
  misc_feature: Ceres CLONE 1529716
MSRRVVPVRCTVSLSDKVLYIGAGLLWEHVLKCFALLVI

SEQ ID NO: 62901 - DNA, 611 bp, Zea mays
  misc_feature: Ceres CLONE 1529722
  misc_feature: Translation starting site: 142
  misc_feature: SWISSPROT Homolog: EC 3.2.1.23 Beta-galactosidase
ggcggccgctctagaactagtggatcccccgggctgcaggaattcgtctcacccctagaaaaactcttttccggctgcgccatcccctcgcagccgccagccctcaacgttcctaccagctgccaccgcctgttaccagtgatgtctcccgcccttgccgctggcgtggagcccatggccgtcgacgattccgcctccaagaaggccaagcgcaagcagctcaaggccgccgccgccgccgcggaggcagaggcggaggccgcttcggcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatcccccctttcgccagctggcgtaatagcgaagaggcccgcaccgatcgcccttcccaacagttgcgcagcctgaatggcgaatgaaaattgtaagcgttaatattttgttaaaattcgcgttaaatttttgttaaaatcagctcattttttttaaccattaggccgaaaatcgggcaaatccccttataaattcaaaa

SEQ ID NO: 62902 - DNA, 627 bp, Zea mays
  misc_feature: Ceres CLONE 1529723
  misc_feature: Translation starting site: 200
  misc_feature: SWISSPROT Homolog: EC 1.4.1.2 Glutamate dehydrogenase
atagctggagctccccgcggtggcggccgctctagaactagtggatcccccgggctgcaggaattcgtctcacccctagaataaccctcacgacaccctagtcctctgttacttctcccgccgccgccaatcccctcccgttctccgacaccgcctatcccctcccgtcctccggcacctctgctgagagcgagaagagatggccggcaagggtgatgggccggcaatcggcatcgatctcagcacgacctactcttgcgtcggtgtgtggcatctcgaccgtgtcaagatcatcgcctacgaccagggcaaccgcacctctccctcatacggcggcttccccgactccgagcgcctcatcggatatgcgggctacaacctgctcgccatgaagcccatcaacaccgtctttgatgcctcgcgtctcctcgcctagacgtttagtcgatgcctctgtccacagtgatcttaagctgtggcccttcaaggtcattcctgagcccggtgacaagccaatgatacccgttcagctcacgggggaggagaaacagcttgcaacctatgagatctcctccatggttctcatcgagatgcgtgagatcgctgattctcaccttgtcggcacga

SEQ ID NO: 62903 - DNA, 639 bp, Zea mays
  misc_feature: Ceres CLONE 1529735
  misc_feature: Encodes the peptide sequence at SEQ ID NO. 62904
aaagctggagctccccgcggtggcggccgctctagaactagtggatcccccgggctgcaggaattcgtctcacccctagaaaaaatggctgcaacacccactgccgccgttttgctcgcgcgcccgctcatcgcactctccagtgctttcacctcccctcatcgtgcgcgggtgccgagcgatccctcctccatctcggtgccgccactgaggagtcgatggtgccagtggcgcggcccgctccgatcgctgccccccgaaggagctccggccgagctgatggaagaggactccaagtttgtgccgttgaacgcggacgatcccatgtacggcccaccggcgctactgctcatcggatttgagaaacgcgaaactgtcggatgcgggccttcctgaaagagcttgaaggtgaattcctcaaggtgatccattgtacagaggagatgacaaagcaaaccttatgggatgccatgcacactgagcagcctgatttggaagctgtcaagattgcaagaccactgcccaggatatgcatattttctggtctaactggcgagaagatgatgatgttcatcacgccttcccagaaaccgggctggaacagctgcctttgctgcgcttggccctaacaatgaaaaa

SEQ ID NO: 62904 - protein, 103 aa, Zea mays
  misc_feature: Ceres CLONE 1529735
MAATPTAAVLLARPLIALSSAFTSPHRARVPSDPSSISVPPLRSRWCQWRGPLRSLPPEGAPAELMEEDSKFVPLNADDPMYGPPALLLIGFEKRETVGCGPS

SEQ ID NO: 62905 - DNA, 677 bp, Zea mays
  misc_feature: Ceres CLONE 1529739
  misc_feature: Encodes the peptide sequence at SEQ ID NO. 62906
ggagctccccgcggtggcggccgctctagaactagtggatcccccgggctgcaggaattcgtctcacccctagaaaaagccaaaaaggtggccgactcgtaggtccctggcaatgctgatgcactgtctctctctgtcctctctgaactgaaacgctcctagctgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcactaggtgctgtttgtaataagcttgttaagatgtgtaaaatttgttttgtgcttccattgaaaaaaaaaaaaaaaacgaaacgctcggagtaatccaattcgcccttatagtgagtccgattaccgcgcgctcactgccccgtcctttttacaacgtccgggactgggaaaaacctttgcggtttaccccaattttattccccctttgaaccaaattccccccttttccccaagcttggggaaaatacccaaaaaagggccccctaaccgatttccccccttttcccaaaaagttttggcccaacccctggaaatggg

SEQ ID NO: 62906 - protein, 33 aa, Zea mays
  misc_feature: Ceres CLONE 1529739
GAPRGGGRSRTSGSPGLQEFVSPLEKAKKVADS

SEQ ID NO: 62907 - DNA, 678 bp, Zea mays
  misc_feature: Ceres CLONE 1529745
  misc_feature (381)..(381): n is a, c, t, g, unknown, or other
  misc_feature (382)..(382): n is a, c, t, g, unknown, or other
  misc_feature (393)..(393): n is a, c, t, g, unknown, or other
tggagctcaccgcggtggcggccgctctagaactagtggatcccccgggctgcaggaattcgtctcacccctagaaaaagaaagcaaaacagcagcagtcactgaaaaaggtcatcgatgtgaaggtgcctaacgccaccgacgcagatacaagtctcgtaggaactgtatcaacggaactcaccaatgttgaggctgatgtcttgaacaaagagctttcattagacaaagcagtagagaaaaacgaggagaaaggaaatgatgtcgccccacaggacctgaaatcaccagctgagaagtcgggaggcccaaatggctgttaattttttttttgttatctcggccattgacagtggtatggggcggggacctgaggctggnnggttgtttgangaaaatcctgaaatcccattgagcttgtttcttgcccttgttttctataggtcaaagaggattagttagttgcttgggtgtttggggggaaagtggaggccattggccctggcttgccgggtattttggaatagaagggacgattaacggggttttaccaagggggggttcaaggggttttgaaggttttgttttcaaaaaaaaaaaaaaaaaaaaccggaaccccttcgagggaaccccaattcccccccttaatgggggggccctaaattacccccgcccctc

SEQ ID NO: 62908 - DNA, 810 bp, Zea mays
  misc_feature: Ceres CLONE 1529756
  misc_feature: Encodes the peptide sequence at SEQ ID NO. 62909
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (810)..(810): n is a, c, t, g, unknown, or other
gcgcccgtttactcctccannaccacaccaccannnnnttgtaaannanaacaactgggactccccgcggtggcggccgctctatactagtggatcccccgggctgcaggaattcgtctcacccctagaaaaaaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaaaaaggctgagcagaagccccgggaaaccaaaaggaaggtgaagagcagcaaacaggcggcgggcggcaaaaaagtgacgtacagttacgtgtgggagtggtaatgggagctttccatgcctggagtgaattccctggcaatgccccccccttctaagcccttccctttccttggaatccttcccatggtgaacccgggcggtggcgcctcccccctcattgtggtgaatgaattgcccaaaaggaaatacctaccaaaataaaaaacggttggttgggaaaaaaaaaaaaaaaaaaaaaaaccccagggcgcttccgaagggtccccccaatttccccccccttaaagggggagttccgtaattcactcccccgccttccccttgggcccgtcctttttttacacaaccgttcttgggaccgtggggaaaaaaacgctcggggcgggtttcccctccacctttataattccccctgtgn

SEQ ID NO: 62909 - protein, 72 aa, Zea mays
  misc_feature: Ceres CLONE 1529756
MASLKAAKPSGVAAQGKEPAPKLSETATKPSAAKSGGVKKAEQKPRETKRKVKSSKQAAGGKKVTYSYVWEW

SEQ ID NO: 62910 - DNA, 610 bp, Zea mays
  misc_feature: Ceres CLONE 1529759
  misc_feature: Encodes the peptide sequence at SEQ ID NO. 62911
  misc_feature (610)..(610): n is a, c, t, g, unknown, or other
agctccccgcggtggcggccgctctagaactagtggatcccccgggctgcaggaattcgtctcacccctagaaaactcttttccggctgcgccttcccctcgcagccgccagccctcaacgttcctaccagctgccaccgcctgttacccgtgatgtctcccgcccttgccgctggcgtggagcccatggccgtcgacgattccgcctccaagaaggccaagcgcaagcagctcaaggccgccgccgccgccgcggaggcagaggcggaggccgcttcggacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttatn

SEQ ID NO: 62911 - protein, 110 aa, Zea mays
  misc_feature: Ceres CLONE 1529759
  misc_feature: SWISSPROT Homolog: EC 3.2.1.23 Beta-galactosidase
MAVDDSASKKAKRKQLKAAAAAAEAEAEAASDKKKKKNETLEVPNSPYSESYYARSLAVVLQRRDWENPGVTQLNRLAAHPPFASWRNSEEARTDRPSQQLRSLNGEWKL

SEQ ID NO: 62912 - DNA, 626 bp, Zea mays
  misc_feature: Ceres CLONE 1529760
  misc_feature: Encodes the peptide sequence at SEQ ID NO. 62913
  misc_feature (388)..(388): n is a, c, t, g, unknown, or other
ccccgcggtggcggccgctctagaactagtggatcccccgggctgcaggaattcgtctcacccctagaaaaaaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacccgtggagtgtaatggagcttccatgcatgantgaaccctgccatgttatgaatctagtccttcctttcttggatcttccatgggacgcggcgtgggcgtcccctcctgtgggatgatgccagatgaatactaccaataagaagtttgttgtaaaaaaaaaaaaacaaaacccagcccccctccggggtccccaatttccccccctaaaaatgaagcctaaaatacactccggccttaccggtgggcggttgcctttttccaccagccgc

SEQ ID NO: 62913 - protein, 63 aa, Zea mays; identical to SEQ ID NO: 28299
  misc_feature: Ceres CLONE 1529760

SEQ ID NO: 62914 - DNA, 664 bp, Zea mays
  misc_feature: Ceres CLONE 1529765
  misc_feature: Translation starting site: 188
  misc_feature: SWISSPROT Homolog: EC 3.2.1.23 Beta-galactosidase
tggagctccccgcggtggcggccgctctagaactagtggatcccccgggctgcaggaattcgtctcacccctagaaaaaaacactcccatccagccgccaccaggtgcagagtctttcgtcatctcttctccggcgaagaacccccagtcgcccaccagatcacttgttaaactttgttgaggggtgatggcggtttctttcgcaaacctcagctccgaggcagggcttaaaaagcttgatgagtaccttctcactcgcagtgatattgccgtgagtatttttggatcctattcgagtcgaatgtaccagtaccagagttaatttgctttaattcgaaacaccgttccagttggaaaaaaaaaaaaaaaaaaaataaaaaaaaaaaaaaaaacgagacgctcgaggtacccaattcgccctatagtgagtcgtattacgcgcgctcactggccgtcgttttacaacgtcgtgactgggaaaaccctggcgttacccacttaatcgccttgcagcacattccccttttcgccagctggggtaaaaagcgaagaagcccccgccccgatccgccctttcccaacagtttccccacccctgaatggggaaaatgggaaattgtaaagcgttaaataattttggttaaaatttcgccgttaaaatttt

SEQ ID NO: 62915 - DNA, 629 bp, Zea mays
  misc_feature: Ceres CLONE 1529766
  misc_feature: Encodes the peptide sequence at SEQ ID NO. 62916
  misc_feature (195)..(195): n is a, c, t, g, unknown, or other
gctctagaactacgtggatcccccgggctgcaggaattcgtctcacccctagaaaaaaggaggcgagtcgcggcaagcggagcagcaagtggtgcccctcctaccatgtcgcgtccgggcttagctgcgcgccgcgccatggcgtcgaccaaggctcccgggcccggcgagaaccaccactccatcgacgcgcanctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctactatgtatccgccgactgggagggggggggagacactacgaagctgggcgagctcggcgccaagctcacggggctggcccctgccgacgccatcctcgtggcgagctccatcctgcacatgctcgacctcgcccacgtggggcgaggaagtgcaaatcgcgcaccgccgccgccaccgcgaaactcaaaaaaggtggcttcgccgaaaaaaggctccgcccaccaccggaagtcggacctcgggggaaacgcctcaaaccccctcggggtcgcgaggtccggcaagggcgcccggag

SEQ ID NO: 62916 - protein, 163 aa, Zea mays
  misc_feature: Ceres CLONE 1529766
  misc_feature: SWISSPROT Homolog: EC 4.1.1.31 Phosphoenolpyruvate carboxylase
  misc_feature (19)..(19): Xaa is any aa, unknown, or other
MASTKAPGPGENHHSIDAXLRQLVPGKVSEDDKLIEYDALLVDRFLNILQDLHGPSLREFVQECYYVSADWEGGGDTTKLGELGAKLTGLAPADAILVASSILHMLDLAHVGRGSANRAPPPPPRNSKKVASPKKGSAHHRKSDLGGNASNPLGVARSGKGAR

SEQ ID NO: 62917 - DNA, 775 bp, Zea mays
  misc_feature: Ceres CLONE 1529768
  misc_feature: Encodes the peptide sequence at SEQ ID NO. 62918
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (143)..(143): n is a, c, t, g, unknown, or other
  misc_feature (145)..(145): n is a, c, t, g, unknown, or other
  misc_feature (146)..(146): n is a, c, t, g, unknown, or other
  misc_feature (150)..(150): n is a, c, t, g, unknown, or other
  misc_feature (152)..(152): n is a, c, t, g, unknown, or other
  misc_feature (155)..(155): n is a, c, t, g, unknown, or other
  misc_feature (156)..(156): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (168)..(168): n is a, c, t, g, unknown, or other
  misc_feature (169)..(169): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (179)..(179): n is a, c, t, g, unknown, or other
  misc_feature (182)..(182): n is a, c, t, g, unknown, or other
  misc_feature (183)..(183): n is a, c, t, g, unknown, or other
  misc_feature (188)..(188): n is a, c, t, g, unknown, or other
  misc_feature (191)..(191): n is a, c, t, g, unknown, or other
  misc_feature (243)..(243): n is a, c, t, g, unknown, or other
ggggttttttctatttttttttattattggcggaaannnnnnngctctcttnnntatattggaactcacctcggtggcggccgctctatttctagtggatcccccgggctgcaggaattcgtctcacccctagaaaaaccctnanntctnantannannnnnttgggnnggatnnntancanntgcancancacccctccccacctatcttcaaaaggtcgatcagatcgatttattcctcgnccataatggttcgtgaggagtaggcgctgctgtcaatggagatcgtgaaccgaggagtggagacgtcgggcccggacgccagctcgccggacttctcggtgcgcgtgcgccgccgcctgccggacttcctgcagtcggtgaacctcaagtacgtgcgcctcgggtacaactacctcatcagccatggggagtacctggccaccatctccgtcatcgtgctggggcccccccctcttaagctgggacatcctcaatccctatacaatactgtgctgccaaggttgttagggggaaaggaatacttaattaaccaggccaccccggactcccaattcccaaggcagttatttagcctttttcaaattttcccgtctaacattcttgttccatgcaccagagccccgagggtttcgttcctcctcctttcgcaatgatagtaatatccggtgttgaactaaatcctataatgcgccgcactaggtggataagaacttatgtcgaacatgggatatcacctaaaccctcatgtaca

SEQ ID NO: 62918 - protein, 132 aa, Zea mays
  misc_feature: Ceres CLONE 1529768
  misc_feature: SWISSPROT Homolog: EC 2.3.1.119 Icosanoyl-CoA synthase
MEIVNRGVETSGPDASSPDFSVRVRRRLPDFLQSVNLKYVRLGYNYLISHGEYLATISVIVLGPPPLKLGHPQSLYNTVLPRLLGGKEYLINQATPDSQFPRQLFSLFQIFPSNILVPCTRAPRVSFLLLSQ

SEQ ID NO: 62919 - DNA, 643 bp, Zea mays
  misc_feature: Ceres CLONE 1529770
  misc_feature (553)..(553): n is a, c, t, g, unknown, or other
  misc_feature (576)..(576): n is a, c, t, g, unknown, or other
aatgctggagctccccgcggtggcggccgctctagaactagtggatcccccgggctgcaggaattcgtctcacccctagaaaataccgtctcacccctcactgtaatgggcctggcccagttactaagtctattaatactactccccatccctggttaggggcatgggttcctattctcacatctgggagcaagttcagagatccaatcatctgtgatgtcgcttacaaagacccgatcaaggtgaaatcagtgcacttcattggagaaaaggactggctcaaggtaccttccgaggagctggcttctgcatttgatgagcctatcatcataaggcatcctcagggtcacactgtccctaggcttggttcgcactcttcgcgaatctctctgttcggtttgtctccatgaaaccagcattgctcatctgttcactagtgtttatgcttagtgccttctcactgattgtctgatatgttctttcccagacgacgtgtctgtgaaacagctttctgaatggagctcacgcgtcctggaaaacctcaagacctcanatgttcctgaggccttatattcnggaaaccatctgataaggaggctgctggtgcggatttcacaaaaaacctggtgaaagcttgaggctg

SEQ ID NO: 62920 - DNA, 694 bp, Zea mays
  misc_feature: Ceres CLONE 1529774
  misc_feature: Encodes the peptide sequence at SEQ ID NO. 62921
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (531)..(531): n is a, c, t, g, unknown, or other
ggggnnnccccnnncccnnnnttttttatttttctccccnccccannngggannnnnntaataccagaactccccgcggtggcggccgctctagaactagtggatcccccgggctgcaggaattcgtctcacccctagaaaaaatcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggccntccgcccatcctcacggcgctcgaggtgctcgacaacgacatccgcctcctgctcgagggggcgcagcaccttggcgagaacatggtgcgcaccatccctatggacggcacggaggcgactcggcccgcggccagagcggtcctgaaaactggctcccccaat

SEQ ID NO: 62921 - protein, 155 aa, Zea mays
  misc_feature: Ceres CLONE 1529774
  misc_feature (85)..(152): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (101)..(101): Xaa is any aa, unknown, or other
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGXPPILTALEVLDNDIRLLLEGAQHLGENMVRTIPMDGTEATRPAARAVLKTGSPN

SEQ ID NO: 62922 - DNA, 699 bp, Zea mays
  misc_feature: Ceres CLONE 1529779
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (16)..(16): n is a, c, t, g, unknown, or other
  misc_feature (355)..(355): n is a, c, t, g, unknown, or other
  misc_feature (370)..(370): n is a, c, t, g, unknown, or other
  misc_feature (392)..(392): n is a, c, t, g, unknown, or other
  misc_feature (397)..(397): n is a, c, t, g, unknown, or other
  misc_feature (448)..(448): n is a, c, t, g, unknown, or other
  misc_feature (456)..(456): n is a, c, t, g, unknown, or other
  misc_feature (497)..(497): n is a, c, t, g, unknown, or other
nnnncccctccccccntggtttttctcttccccacttttttaaagaaaaaaatttataacatggatttcctgctcggtgggggaacgctcttccctagtggatcccccgggctgcaggaattcgtctcacccctagaaaaattcccgttcttctccttccgtccgaccgtccctcgacactgccgaggccgaacctagcagccgcccacccgacgcccaatccgccggtgcaatcgcaatctccgagggttaatcgactaccggcggctacggcgccgccagtctcctggcttaggctgccaggggatgcgaggagccagcgcagcgcggccgccggccagccgcccccgccccnctgcctataccgccngctacagtcggaaacggccgcnagggngtcggaagagggaagccgcagccgggcactgactccgatccccactctagncaaccccncgcggaccggtccacctcggacgaccacgacgccatctcgnaagcgtgcttccacccaaccacagaaatcttctctcacaggactaaacttcctccccacgagctgcctctactgattttgcactggcatgccgtgacgcgcaaacatgtggagatccatcttggactgatttcttccttacctcgctgaagaaccctcggtagtctgagcatagaaaaagggtggaatgttatcactctttc

SEQ ID NO: 62923 - DNA, 839 bp, Zea mays
  misc_feature: Ceres CLONE 1529783
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (42)..(42): n is a, c, t, g, unknown, or other
  misc_feature (44)..(44): n is a, c, t, g, unknown, or other
nnnnnccccccccnttnnnttntttnnattttgttcttactngnggggggggggttttcaaaacggtacctcccctcgcgtggccgccgctctgtactagtggatcccccgggctgccggaattcgtctcacccctagaaaaaagcttctctcatcttgagaaagaactcctcgtcctcgctccctccccaaccatcaagagcgcacacgcacacgcacacgccgcgcgcaagccggccgacgtacggcttggataagagagctacaactggcggtggcggtacaagcggcggcggataggcggcggaggaagcgaaggtgcctctcgcgaaacctagggctgcggcgggaggaggtgggccgaagcagaccatgggaggtaggaggaggatacgacggataaggcgggcatccagtgggatagttatatattgaggggcccgggacggcgtcggggggggggcgatagccactttcaccgatgttggaagtgggggacaccaacacaaaaaactttgttatatgtggccccaggaacacgtttcatcctgatagaaggtttaagcacatacggatgaaggtcgcacgtgccttcagcacacgcccgctcacattggtgccgcacgcggcaactctagatgcttttggaggaggtttgatcagaagacagacgatcaaaccttatgatcttagagacctccgcgcaagccccactatccatctgtcgcggaccataggtggtgaatgtctctagtgggagaatattactaaccccgggaatattggatcttccgcggcccgaccatcgcccctgtattactacgcgacaaatcacgagg

SEQ ID NO: 62924 - DNA, 627 bp, Zea mays
  misc_feature: Ceres CLONE 1529785
  misc_feature (351)..(351): n is a, c, t, g, unknown, or other
  misc_feature (371)..(371): n is a, c, t, g, unknown, or other
aaactggagctccccgcggtggcggccgctctagaactagtggatcccccgggctgcaggaattcgtctcacccctagaaaaaatccctccactccctcttatctgctgcgccatcctccccggcctccaccatggccacagccgccgcggccaccgcctcctcctccctcctcgcgccggcggccagcagcacggcgccggcctcgtcaacgcgctgctgttccctcctccgtgccgtcgctgcgtgcgtacccgcggctcctcctcgcgttccgccgccccgccgcggccgccgtcgccgacccgcagggggccgtgctcgaagaggaggcggaggtcgaccagcaggnccagtacgacgacgactacnggtatgagggcggggcgcgccccgcgttcacggccccacgcgcccgcgcaacggaaaggccgcgctactgcttaagcgcgaacgcacgaagtcgaagaggttccttcgagatacaaaaactgcgggagagcaagaaagactacaacgttgcccacgccatcctctttaataaaccaaatgcccattgccaaagtttgttggatccaccggaagggacccttcccctgaaacctcccacccccaagtaaattgaccc

SEQ ID NO: 62925 - DNA, 666 bp, Zea mays
  misc_feature: Ceres CLONE 1529786
  misc_feature: Encodes the peptide sequence at SEQ ID NO. 62926
  misc_feature (309)..(309): n is a, c, t, g, unknown, or other
  misc_feature (312)..(312): n is a, c, t, g, unknown, or other
  misc_feature (497)..(497): n is a, c, t, g, unknown, or other
aaagatggagctccccgcggtggcggccgctctataactagtggatcccccgggctgcaggaattcgtctcacccctagaataaccaccacagaacacagattcgcgagcccaagaccaagagcaagagaagaagagctcagctgctgctgcggtgctgccggtgccgggcggagtttaacatcgcgccgcagctaactcaacgcagttaagcttctcctactcctagcttagcccatagccatggcgctggctagccaaggtcgccgcttaccagccgccgccgccgacgattctcttccccgaccgncgnctcccaagaagcagcagcaacgctctgctgctgctcccagccggcggacgccggtcttccgcggcccggaccctgtaggctttcgggctcccggcccgccggaagagggccctggacacccctcttcttcccgcggggggttcttctgaagccaaagggcgagacagcccaaagccggccggccnccgccgggggaacccaaaaaagaaccggccttcccagggagttcaagggggccattcgaaaaaccctaccgggctcaatttaccccaaggcccccacggggggccgttacttggaaggccttcaagccgggggcccccccccaaactgaccggccattttccagggggg

SEQ ID NO: 62926 - protein, 72 aa, Zea mays
  misc_feature: Ceres CLONE 1529786
  misc_feature (23)..(23): Xaa is any aa, unknown, or other
  misc_feature (24)..(24): Xaa is any aa, unknown, or other
MALASQGRRLPAAAADDSLPRPXXPKKQQQRSAAAPSRRTPVFRGPDPVGFRAPGPPEEGPGHPSSSRGGFF

SEQ ID NO: 62927 - DNA, 666 bp, Zea mays
  misc_feature: Ceres CLONE 1529795
  misc_feature: Encodes the peptide sequence at SEQ ID NO. 62928
  misc_feature (364)..(364): n is a, c, t, g, unknown, or other
  misc_feature (400)..(400): n is a, c, t, g, unknown, or other
  misc_feature (415)..(415): n is a, c, t, g, unknown, or other
  misc_feature (426)..(426): n is a, c, t, g, unknown, or other
aaagctggagctcaccgcggtggcggccgctctagaactagtggatcccccgggctgcaggaattcgtctcacccctagaaaaagccatacaattctcacacgcgcgcgcccaacacactagcctgcaggatcgtcgagcgcgaggcggctgccccgccggccggttcgttcgctctatagcttgagaccgatcctagctaggccaagacgatatcggcggcgatgatgatggacgcggcgaggatcgtagagtacttcaagggcaagtgcatcctcgtcaccggctcaacagggtttcttggaaagatccttgtggagaagatactgcgggtgcagcctgacgtgcgcaagattttacctggncttgtacgcgcggtccgacgaagccatcagcgaagncagcgcgtcccacangaagtgatagnacacgagctgttcggcctgctgaaagagaaccacggcagggcttccagcagttcgtagaggccaggtcgtccctttggccgagacttcgtatacaacggcctggggctggaagcaaccctgctggaacccctggccaaggaagtcaaatttttcttaaaattgaagcaaccccaatttttaaaaaaaaaacaatgtttccctggaaatagaccgggctggggaggaaaccccttggcttg

SEQ ID NO: 62928 - protein, 86 aa, Zea mays
  misc_feature: Ceres CLONE 1529795
  misc_feature (59)..(59): Xaa is any aa, unknown, or other
  misc_feature (64)..(64): Xaa is any aa, unknown, or other
  misc_feature (68)..(68): Xaa is any aa, unknown, or other
MMMDAARIVEYFKGKCILVTGSTGFLGKILVEKILRVQPDVRKILPGLVRAVRRSHQRXQRVPXEVIXHELFGLLKENHGRASSSS

SEQ ID NO: 62929 - DNA, 678 bp, Zea mays
  misc_feature: Ceres CLONE 1529797
  misc_feature (293)..(293): n is a, c, t, g, unknown, or other
aaaagctggagctcaccgcggtggcggccgctctagaactagtggatcccccgggctgcaggaattcgtctcacccctagaaaaactcagccgcccgctagggttttagtgttttagcctcctgcgtccctcccctgttccctcaacgcttctctcctccacctcttctcgacagccgctgccacccggaaccttctcgcagcgacgctatgtgggctctccgccgagctggtaaccccctcaggttccatgcccaaaaagttgtgagtccccgtggttgtgcgagccttgangtgctgctaactgctgatgcaaaaaatgttgaagaacaccatgaggcagacggtcaaaaagtgtgctactgtcataagccaaggcagcagcgttgctattgtcattttcatctgggccatttgcttggagtaggggtttctcctccccccccggtgcaatttctagtgacaaggatgatgaatttaaaggaatgtttttctggattccaatggtcccccaaaaactgggaaaaagagggccggggttgaaatctgaaaaaaacttccgaagaggaagcccccggaaaaaatggggttggcccacaagggaggccgaatgaaaaccccggaaacgggggccatttaaggggctttttgggtcccccccctttccacaaaggggggg

SEQ ID NO: 62930 - DNA, 645 bp, Zea mays
  misc_feature: Ceres CLONE 1529806
  misc_feature: Encodes the peptide sequence at SEQ ID NO. 62931
  misc_feature (313)..(313): n is a, c, t, g, unknown, or other
  misc_feature (371)..(371): n is a, c, t, g, unknown, or other
  misc_feature (398)..(398): n is a, c, t, g, unknown, or other
  misc_feature (400)..(400): n is a, c, t, g, unknown, or other
  misc_feature (402)..(402): n is a, c, t, g, unknown, or other
  misc_feature (410)..(410): n is a, c, t, g, unknown, or other
  misc_feature (413)..(413): n is a, c, t, g, unknown, or other
  misc_feature (475)..(475): n is a, c, t, g, unknown, or other
aacgctggagctccccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcncgtccatgtccatgtcctcctccaacccgccctacgacctgacgtccttcccccccanccccaggggggaggggggcgtgtcccncnanataacccntcnctacatgacggacatgatcacctacgccgacaccgacggcggtctcgtgggcgccggctccncggggctgtcctgcacgtaccaactctccagggaccccgccgtgagcatcgccatccgggggaacgccggggcccccgggcggcgtcccttgcctgggcggccagctgttcccggcctgggggggggcccaacccggcccacctgtttccggtaaaaactgggcatggcc

SEQ ID NO: 62931 - protein, 150 aa, Zea mays
  misc_feature: Ceres CLONE 1529806
  misc_feature (46)..(46): Xaa is any aa, unknown, or other
  misc_feature (65)..(65): Xaa is any aa, unknown, or other
  misc_feature (74)..(74): Xaa is any aa, unknown, or other
  misc_feature (75)..(75): Xaa is any aa, unknown, or other
  misc_feature (78)..(78): Xaa is any aa, unknown, or other
  misc_feature (79)..(79): Xaa is any aa, unknown, or other
  misc_feature (100)..(100): Xaa is any aa, unknown, or other
MATAAASSLLKSSFAGSRLPAATRTTPASLVVATGPRGAGAGPICXSMSMSSSNPPYDLTSFPPXPRGEGGVSXXITXXYMTDMITYADTDGGLVGAGSXGLSCTYQLSRDPAVSIAIRGNAGAPGRRPLPGRPAVPGLGGGPTRPTCFR

SEQ ID NO: 62932 - DNA, 671 bp, Zea mays
  misc_feature: Ceres CLONE 1529809
  misc_feature: Encodes the peptide sequence at SEQ ID NO. 62933
  misc_feature (582)..(582): n is a, c, t, g, unknown, or other
atagctggagctccccgcggtggcggccgctctagaactagtggatcccccgggctgcaggaattcgtctcacccctagaaaaaaatagccgcaagcctgcagcgcaaaggaaagcacagcagcggcggtttgcaaaagagcccgccacctctgtctctctgccctgcgctgcgccgtccacaccactcatccggcaacctctctctgtctccactcgtacagtattaatttcctcgcgcctcctccgtcctccattttttttgttgggtgccgtgcgagctccaagtacccctgtctccctcccgtcttgcgggcttgcctttgcctgttccatttccggctcctccagttggtagtgtcgtttcaatgcgagacgccgtccttcacgagcttgattgcccttgaaagcgaagttggtgttggtgtcgttgccggtgaggaggaagaggggatatatggctcccacggaagaggcagcaggggaggacgagcggctgctgaaggatcttctcgcttcttcgtcagataaggaaggagaggatgaagagaatacaaagacacagtccgatgaatctacttangggggattgtgataaacggcgggtccgtagccgccttatcgagtgaagatgtcaatgatagtcatggtagtgacagcaacagccaatgt

SEQ ID NO: 62933 - protein, 45 aa, Zea mays
  misc_feature: Ceres CLONE 1529809
  misc_feature (42)..(42): Xaa is any aa, unknown, or other
MAPTEEAAGEDERLLKDLLASSSDKEGEDEENTKTQSDESTXGGL

SEQ ID NO: 62934 - DNA, 655 bp, Zea mays
  misc_feature: Ceres CLONE 1529828
  misc_feature: Encodes the peptide sequence at SEQ ID NO. 62935
  misc_feature (589)..(589): n is a, c, t, g, unknown, or other
  misc_feature (655)..(655): n is a, c, t, g, unknown, or other
aaagctggagctccccgcggtggcggccgctctagaactagtggatcccccgggctgcaggaattcgtctcacccctagaaaaagctctcgcacgagacacgcacgcccgcgcgcgtgaaggtacgcggaagcaggggcgaggattctccgaagcggagggcgaggcggcggcagcgaccttgagggagatggcggcgggcggtagggtttcaatcccggcaggggcgcggcgcacgatcgcggacatcaaggagatcgccggcggccacaccgacgaggaggtctacgctatgctccgcgagtgcaacatggatcccaacgagaccgttcagaggctcctcctcgaagatacctttcatgaggtgaaaaggaagcgtgacaagaaaaaggaggttagtaaagagccatcagattctcggtggagacctgccgtgcaggggcaaggtggaaagaattgtcggaattgtgcttcacgcagtttgtccagctctaatgattctgctggacgaagtgctatttctggaaaggagaatggaataagtttgatcatgggaaaaaggtagtggttctactccgataacaatatgnaatatggatgtcaaagctttcactttcatgccaagtaacagtttggttgagtggtcttttgcacgn

SEQ ID NO: 62935 - protein, 124 aa, Zea mays
  misc_feature: Ceres CLONE 1529828
  misc_feature (9)..(68): Pfam Name: DUF1296 Pfam Description: Protein of unknown function (DUF1296)
MAAGGRVSIPAGARRTIADIKEIAGGHTDEEVYAMLRECNMDPNETVQRLLLEDTFHEVKRKRDKKKEVSKEPSDSRWRPAVQGQGGKNCRNCASRSLSSSNDSAGRSAISGKENGISLIMGKR

SEQ ID NO: 62936 - DNA, 732 bp, Zea mays
  misc_feature: Ceres CLONE 1529830
  misc_feature: Translation starting site: 285
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
tttttaattttttttttnnttntatttatattattccttaaagttcttttcttcaaactggaactccccgcggtggcggccgctctagaactagtggatcccccgggctgcaggaattcgtctcacccctagaaaaaaaacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatggctatgattgatgagcctctttatccaattgctgtactgattgacgagctcaagaatgaagacatccagttgcgtctaaactccattagaagactttcaacaattgcacgggctcttggagaagaaagaacaggaaggagctgattccttttcttagtgaaaacaacgatgatgaagacgaggtgcttcttgcaatggctgaggaaattggtgtgttcattccgtatgttggtggtgtaaacatgctcatgttttgctcccaccttttgaaaaatttgtggacagtggaagaaaccttgtgtccgggaataaagcaagttgaatcctctgggcccgtattgggtgccccaaatgaaggaaaactggactttggccaactggtttcctttcccattagttaaaaaaggccttaccccctgggaaaagtggtttttaccgccccccc

SEQ ID NO: 62937 - DNA, 641 bp, Zea mays
  misc_feature: Ceres CLONE 1529836
  misc_feature: Encodes the peptide sequence at SEQ ID NO. 62938
  misc_feature (355)..(355): n is a, c, t, g, unknown, or other
  misc_feature (361)..(361): n is a, c, t, g, unknown, or other
  misc_feature (390)..(390): n is a, c, t, g, unknown, or other
  misc_feature (437)..(437): n is a, c, t, g, unknown, or other
  misc_feature (486)..(486): n is a, c, t, g, unknown, or other
aaagctggagctccccgcggtggcggccgctctagaactagtggatcccccgggctgcaggaattcgtctcacccctagaaaaaatgtccaggtaaaaggaaaaatcgctccatcccctgactatcactggctcactgcccttccacctccaggttccagcggccatggtgaagaagcccaacggtgtcgccaaggccacggcgacctctgctgacgtggcagcccagccatccaaggagaatccgtccacccctgggttggtcaaggcctcgaagtttaagaggagaaaggtcaaggccaaccgtgcgaagcaggcagtcgctgcagcagctattgacgaagtcgcccctgtangtgcangcactggtgatggcgatgcatctgcatcnagcgcttttaccgcacccatccgaatgtgccgaagcattacctgtgntgcaaacgccaaagtcaaccacttttgctgatgcatcacctggtggccngacccaaaagcccaccactgatgctaaaggatggttgcctgcaccaatacaacccatgggtggaaaatcagcttcgtccccaaagccaaaaccgcccaagctaaggcgtaagcttccccttgaattttccgcccaaagggaaattatttgggtcc

SEQ ID NO: 62938 - protein, 100 aa, Zea mays
  misc_feature: Ceres CLONE 1529836
  misc_feature (64)..(64): Xaa is any aa, unknown, or other
  misc_feature (66)..(66): Xaa is any aa, unknown, or other
  misc_feature (91)..(91): Xaa is any aa, unknown, or other
MVKKPNGVAKATATSADVAAQPSKENPSTPGLVKASKFKRRKVKANRAKQAVAAAAIDEVAPVXAXTGDGDASASSAFTAPIRMCRSITCXANAKVNHFC

SEQ ID NO: 62939 - DNA, 672 bp, Zea mays
  misc_feature: Ceres CLONE 1529838
  misc_feature: Encodes the peptide sequence at SEQ ID NO. 62940
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (199)..(199): n is a, c, t, g, unknown, or other
  misc_feature (200)..(200): n is a, c, t, g, unknown, or other
  misc_feature (207)..(207): n is a, c, t, g, unknown, or other
  misc_feature (208)..(208): n is a, c, t, g, unknown, or other
  misc_feature (369)..(369): n is a, c, t, g, unknown, or other
  misc_feature (370)..(370): n is a, c, t, g, unknown, or other
  misc_feature (378)..(378): n is a, c, t, g, unknown, or other
  misc_feature (394)..(394): n is a, c, t, g, unknown, or other
  misc_feature (395)..(395): n is a, c, t, g, unknown, or other
  misc_feature (412)..(412): n is a, c, t, g, unknown, or other
  misc_feature (423)..(423): n is a, c, t, g, unknown, or other
  misc_feature (520)..(520): n is a, c, t, g, unknown, or other
ggagctccccgcggtggcggccgctctagaactagtggatcccccgggctgcaggaattcgtctcacccctagaaaaaaagctgacgagcgggaggccctcacgggccgcaccgctggccgaccctgatcttctgtgaagggttcgagttggagcacgcctgtcgggacccgaaagaatggtgaactnnnatgcctganngcggggnncgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccacacgagttctatcggnngtaagccnatgatttagaggcatnncgggggcgcacgccccntcgacctattnctcaaaacttttaaataggtaggaacggccgcgcttgctttcggtggagccgtgccacgggattcgggaggctccaggggggccattttttggtaanccaaacctggcatatgcgggatgaacccggaaacccggtttacgggggccaaactgggcgcctaccctaaaacccccaaagggggtttggtcatttaaaaccaccggcacgggggccttggaatccaaatccccccaaaggagggggtgaaa

SEQ ID NO: 62940 - protein, 45 aa, Zea mays
  misc_feature: Ceres CLONE 1529838
GAPRGGGRSRTSGSPGLQEFVSPLEKKLTSGRPSRAAPLADPDLL

SEQ ID NO: 62941 - DNA, 660 bp, Zea mays
  misc_feature: Ceres CLONE 1529846
  misc_feature: Encodes the peptide sequence at SEQ ID NO. 62942
aaagctggagctcaccgcggtggcggccgctctagaactagtggatcccccgggctgcaggaattcgtctcacccctagaataatggaaagcgaagaatgcccccttccgggggggcccgagccatcagtgagataccactctggaagagctcggattctaaccttgtgtcaaacccgcgggccaagggacagtctcaggtacacagtttctatggggcgtatgcctcccaaaaggtaacggaggcgtgcaaaggtttcctcgggccagacggacgttggtcctcgagtgcaaaggcagaggggagcttgactgcaagactcacccgtcgagcagagacgaaagtcggccttagtgatccgacggtgccgagtggaaggaccgtcgctcagcggataaaagttactctagggataacaggctgatcttccccaagagtccacatcgacgggaaggtttggcacctcgatgtctgctcttcgccacctggagctgtaggtggttccaagggttgggctgttcgcccattaatgcgatacgtgagctgggttcagaacgtcgtgagacagttcggtccatatccagcgtgtgcgttagagcattgacaggacctcttcctattacgagaggacctggaaggacgcatctctggtgtaccagt

SEQ ID NO: 62942 - protein, 108 aa, Zea mays
  misc_feature: Ceres CLONE 1529846
MPPSGGARAISEIPLWKSSDSNLVSNPRAKGQSQVHSFYGAYASQKVTEACKGFLGPDGRWSSSAKAEGSLTARLTRRAETKVGLSDPTVPSGRTVAQRIKVTLGITG

SEQ ID NO: 62943 - DNA, 2294 bp, Zea mays
  misc_feature: Ceres CLONE 1529857
  misc_feature: Encodes the peptide sequence at SEQ ID NO. 62944
gtcggcctgcttccagtttaccgcagcggggcgactgacgcgcctccgacgacacgccaggtccggcatccatgggcgccgcggcggccgacctcgaggcgcgtcagctccgcatcctcggccgtatttctgacctcgagctcgccgcgcagcagcaccgcctcggggcgctctccatctccaccgcgccctcagagaaaggcgaggccgacgcgggggctaccgaggttcatctcgcagccctcctggccgcgcgcggcgtgcgggacttcgccttccgtcgcgttcccgccgactactacgaccgctccctcgaggagcggcgcgacctgctccgagccgactcagtcgcccagctctgcaagagtatcgtcatggtgaacacccaagctgctgcagatgttgttgattgcagtaatccaaagaattcaaaatactatgtcgttgttgttcagtatatggcacggcttaacgctgaaaacatcaagaacttcctgtatgaactaaatgagaagcaaataccgaaaaagagatttaacatgaggttggcaccagaagaggagtcacacaagcttactgggtttgtgcataacgctgtcacttgcatcgggatggaaacaaacataccggtcatcatagatgaagctatcaccaaattggatgaggatttcttctggttgggtggcggagaagttgacctcaagctcgggatgcgaacctcacaattcttaagtgtctttagtccattcgtggtgaaatgcagctgatgatagccgtgcagcctaagagaagcttctgattcatttatttctaccgagcctccatgcatccatcacatggaggtacaccacaatactaggaggttttgcttggatctggggtttggatgtctgtcttttttggagcaggctattcctgttcagttgctcgcctcacattatttacagctgattgttgttacgactgatgtggtggaggggacattcttgggaagattgagatatttgccacaactaggcatatacaataatactctctgtagtttgtgcctaaaattagcactggttacttgtgtaatcaacgagactcttactttcatcgaaaggatgacactatgagttggtgcgattttcttttattttttttcaaacactacacaatgtcatacccttagaagggtcggtgacacatttatagccctaagagcaactccaatcatgagtcccctagttgggccctataatttaagttagctacctgttctatttgtttagggtccaaatacaattgttgattcctaccgtggaccctaaaatagcttacatttgtaatcaacccatattcccctgtacgtagatcctctgttctgtgccactccgaacgccattcctgcgcagactgttttttgcgccgccgctaattccaggtggtgttccggcgctcatccagtagaagccgccattcctgcgcagactgttttttgcatcgaccaggattgctgccttcatttcaggatggtgtatggaagtaggagatcaaaaaggcaccaagaagatgatgagattgatgatgaccttcagcacattggtttttatgctaggtgaataccggaagaggaagaatgaagatcaacgtaaaaagcgtcgaggtttggtttttggacatgaggtatatgatcgtagtagaggagagcatgatttaaaattattcaatgactactttgctgagcgtccaacatatcctgggaagtatttccgacgacgctttcggatgagtcatcctcttttcttgcggatagctgaagctgttaaacaacatgatcactattttgctcagaaaaaaaatgctgtcggtgctcttgggttttcttgtcttcaaaaggtgactgcagcttttagacagcttgcttatggtgttccagcagattacgttgacgagtatttgtggattggagaaagcacgactatcgagagcctacgaaaatttgtcagggcagtgtgtgaggtttttggaccagagtatttgagacctccaaatgaaaatgatatagctaggttgcttactattggtgaacaacgtggatttcctggaatgattggtagtgtcgattgtatgcattggaagtggaaaaattgtcctacaacttatcaaggcatgtattgtggtcatgtgaaagaaccaactattgtactagaggctgtggcgtctaccgatttatggatatggcatgcattctttggtctaccggggtctttcaatgatattaatgtcttgcacaaaaaaaaaaaaaaaaa

SEQ ID NO: 62944 - protein, 231 aa, Zea mays
  misc_feature: Ceres CLONE 1529857
MGAAAADLEARQLRILGRISDLELAAQQHRLGALSISTAPSEKGEADAGATEVHLAALLAARGVRDFAFRRVPADYYDRSLEERRDLLRADSVAQLCKSIVMVNTQAAADVVDCSNPKNSKYYVVVVQYMARLNAENIKNFLYELNEKQIPKKRFNMRLAPEEESHKLTGFVHNAVTCIGMETNIPVIIDEAITKLDEDFFWLGGGEVDLKLGMRTSQFLSVFSPFVVKCS

SEQ ID NO: 62945 - DNA, 648 bp, Zea mays
  misc_feature: Ceres CLONE 1529859
  misc_feature: Encodes the peptide sequence at SEQ ID NO. 62946
aagctggagctccccgcggtggcggccgctctagaactagtggatcccccgggctgcaggaattcgtctcacccctagaaaaagtagctcgtactccccgctagctccctctgttcaagcggagagagagtgatagagagagagagagagagagagaagaagcaacaagagcgaacgcaaaaagtacggtacagctcctgagatggcggcgccggcgccgaagcaggaggagctgcagccgcacgccgtcagggaccagctgccttccgtctcctactgcctcaccagcccgcccccatggccggaggccgtcctcctcggcttccagcactacctcgtcatgctcggcaccaccgtcatcatccccaccgcgctcgtcccccagatgggcggcggcaatgaggagaaggcgcgggtggtgcagacgctgatgttcgtggccgggatcaacacgctcatccagagcttcctcggcacgcgcctccccgccgtcatgggtggctcctacaccttcgtcgcgcccaccatctccatcatcctcgccggtcgctacagcggcattgccgatccccacgagaaattcgtgcgcatcatgcggggcacgcaaggcgcgctcattgtggcctccaccctccaaatcatcattgg

SEQ ID NO: 62946 - protein, 148 aa, Zea mays
  misc_feature: Ceres CLONE 1529859
MAAPAPKQEELQPHAVRDQLPSVSYCLTSPPPWPEAVLLGFQHYLVMLGTTVIIPTALVPQMGGGNEEKARVVQTLMFVAGINTLIQSFLGTRLPAVMGGSYTFVAPTISIILAGRYSGIADPHEKFVRIMRGTQGALIVASTLQIII

SEQ ID NO: 62947 - DNA, 755 bp, Zea mays
  misc_feature: Ceres CLONE 1529860
  misc_feature: Encodes the peptide sequence at SEQ ID NO. 62948
  misc_feature (10)..(10): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (363)..(363): n is a, c, t, g, unknown, or other
  misc_feature (509)..(509): n is a, c, t, g, unknown, or other
  misc_feature (517)..(517): n is a, c, t, g, unknown, or other
  misc_feature (535)..(535): n is a, c, t, g, unknown, or other
  misc_feature (572)..(572): n is a, c, t, g, unknown, or other
tttttttttngtgggcgccccccnnnttactncnntacacccatcannnnggagcccnnnnnntaataataaaatccacgcggtggcggccgctctataactagtggatcccccgggctgcaggaattcgtctcacccctagaaaaactcttcgcttctaactccgctgggccaccagctttgaccgccgcctcccttcccctccgctactgctcctccccaccccactcccccgcacgaacggcggcggcggcggcgaggtcgtaccccacatcggcgagcggcggcggcaccgccggaggcaaaggcaagatgttcggacgcgcgccgaagaagagcgacaacaccgagtactacgagatncacggggtgcccaagtcggcgtcccaggacgatctcaagaaggcctaccgcaaggctgctatcaagaaccaccccgacaagggcgagtgaccccgagaaagttcaaggagctcggcacacccctatgaggtttttgagtgatcctnaataaacntgaagatttatgatcaantatggttgaaaattgccctttaaggaatgaaatgggngggtggaaagattcccatggttgaatgccatttgaaaatccttcccccttcattttttttggaaccccttcttttttgaaacgaaggtgggtcggaaaaccacccctggggggtaaaaaagggccaaaagagagagcggtaaaaaaaaatgttcaatctcccacccccaacttttacagtgcg

SEQ ID NO: 62948 - protein, 46 aa, Zea mays
  misc_feature: Ceres CLONE 1529860
  misc_feature (17)..(17): Xaa is any aa, unknown, or other
MFGRAPKKSDNTEYYEXHGVPKSASQDDLKKAYRKAAIKNHPDKGE

SEQ ID NO: 62949 - DNA, 963 bp, Zea mays
  misc_feature: Ceres CLONE 1529869-R
acgattgggtacctcgagcgtctcgtttttttttttttttttaaccaactggggaattactgatgaacaggcagccacccgatggggtctatcatgttttcaccctcctgagactgacaattatcaccggatacttgatctccaaatggaggcccaaggttaaagctcccactccaccaggcaccagttccggttggtcttttcttttgccgcgacggtacaaaatctatgttttatggtattcccagtaatcaatagttacagcacatccaaactcaaatccttgtaatggcgctagcggttagctactgcttatcaacagaaactggggtgggaacgtcaaccctgaccctgtacttgtaccgcttggaaaaaaaaacaaaaatgagcaggttgacggggctaaccaccgcaagcagccagtacaggtagtcaaacctgcccacgttgattttctgcgccagccacaaaggccgcccctcctcattgtcccgggtcggggggtccaccggggtgttgatcgccaaccccacaaaacagccaagcccgccggcaaaggcggggtacgcggacccaacgctgcgcattgggtcgggggcctcctggtacaggaactccaggagcgcgacgagggaaaacacctctgccacccccaattaggcaatatttggataagcacccattaaggccctatagtccggcatggggctttaagaaaaaggccaaagtttcctgggggggacggggttacccgcgggggggtacctttcaaaaaacccccccccggccccgggaagggtttggaaaataaaaggcccctcccccaaccgtcttaatctggtagggccccttccgcggggggctcctttatggtgggtccccaagctgggggtaaaagccttgtatttaaaggtccccggtatatataaaaatagcgcccaactgtggtaaaacctggtgttt

SEQ ID NO: 62950 - DNA, 765 bp, Zea mays
  misc_feature: Ceres CLONE 1529872
  misc_feature (1)..(1): n is a, c, t, g, unknown, or other
  misc_feature (8)..(8): n is a, c, t, g, unknown, or other
  misc_feature (12)..(12): n is a, c, t, g, unknown, or other
  misc_feature (14)..(14): n is a, c, t, g, unknown, or other
  misc_feature (23)..(23): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (69)..(69): n is a, c, t, g, unknown, or other
  misc_feature (551)..(551): n is a, c, t, g, unknown, or other
nttttttntttntnccccccccntattaaacaccaccctnnntnnnnaagccaaannnnnnaacactgnaactccacacggtggcggccgctctaccaccagtggatcccccgggctgcaggaattcgtctcacccctagaaaaacgcacctccgcctccgcgcgccccagtccatcggtgacctctcccgctcctccagctcctctaattccgccccgacccgggctcagccgctgagggtccatcacagagaatggcggcgtccacgcggtggataaggaccctatgaaggtgggggagcgctacgtctagtgggtctaccagaagaaggaggtcggggatgattttctacgtccgccggatggggttcaaaggaagacttcctgtcgcccatggacccgcggatgtcgggaggctttgccagccttgccccatgtcggggagagggcggggggcgcccaaagcggaaagaggatctgcatggccccaccacctacggggctcccccgaccccgggccctcggggcgaaacccccttcccccccgcagngaaaaatcgaggacgaccgcctccccaccagggaatgcttcgccttttccccctagaaaggtgccgccctccccccaaagaattcgaaccccccagtcggggggcgcgttcacccataagatcgtcctcctaccgaagacaaccgcgggaggggccaccccttggggcgccccctcagaaattgggtatgcctgacggtcaacatttccaccct

SEQ ID NO: 62951 - DNA, 602 bp, Zea mays
  misc_feature: Ceres CLONE 1529875
  misc_feature: Encodes the peptide sequence at SEQ ID NO. 62952
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (19)..(19): n is a, c, t, g, unknown, or other
  misc_feature (55)..(55): n is a, c, t, g, unknown, or other
  misc_feature (56)..(56): n is a, c, t, g, unknown, or other
aaaggattnnnngggttgnttgccttcccctcttctggcgaaaaaacccccgtgnnatattattgtttttgaatagaacacgaccaatcgatgatggccttggaaccctaggagcggccgcgcggctcagccttcgaaatgggctccctcgacaagggacgagcggcggcggcggcggcgggcaggtacaagcgcgttccgggcccagcgctgcgggctggcggcgtcggcggcgcgcggaaggtgcgggcgagatccaggctcgcgcgcttcctgctgtccgagaaggtggactatctccagtggatagacggcgccaccgccttcttcttcgtcgtcatcgtcttcgtcgcgtttctcccggagttgggcgtcttcaagcggcccaggctgccgctcccctcgcgccgcgcgggagagggacgcgtcggaggcggaggcgggattgagggccgcagcggcctcctcatgtgagaggcgggcgtggcgtcccagttccagccgacaggctgagggacaattgtcccattgagcggaggggagaggcccatagcttggcggatctcgggacgcccgtatcgagcttcggggcccggaagcag

SEQ ID NO: 62952 - protein, 111 aa, Zea mays
  misc_feature: Ceres CLONE 1529875
MGSLDKGRAAAAAAGRYKRVPGPALRAGGVGGARKVRARSRLARFLLSEKVDYLQWIDGATAFFFVVIVFVAFLPELGVFKRPRLPLPSRRAGEGRVGGGGGIEGRSGLLM

SEQ ID NO: 62953 - DNA, 672 bp, Zea mays
  misc_feature: Ceres CLONE 1529876
  misc_feature: SWISSPROT Homolog: EC 3.2.1.23 Beta-galactosidase
  misc_feature (320)..(320): n is a, c, t, g, unknown, or other
tggagctccccgcggtggcggccgctctagaactagtggatcccccgggctgcaggaattcgtctcacccctagaaaattctttggccgctctggagattgcctggacgcgatcgggctctacgtcaaccccaactaataactaaaacgatggatcggatcatctgcatgcatgcatatgcagtatgctgcttgcctagctgcctgtaacgaatatgaatgcataaaataacgcccctgctgctcccatatgcatcagcagtgtgtaccactatatatgttatatactgtatttcgctaccgaataaaaacataaataanagatccagtgtcgtctgcacctttgttataaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaataacgaagaggcccgcaccgaatcgcccttcccaaaagttgcccaccctgaatggcaatggaaattgtaaaccttaaaatttttgtaaaattcccgttaaatttttgttaaacccccccttttttttaaccaaaagcgcaatactggcaaaaccc

SEQ ID NO: 62954 - DNA, 787 bp, Zea mays
  misc_feature: Ceres CLONE 1529878
  misc_feature: SWISSPROT Homolog: EC 3.2.1.23 Beta-galactosidase
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
agagtaagtcatccccattgaacccaatnnannnnnnnngttatacactatagaaattgggagctcccgcggtggcggccgctctataactagtggatcccccgggctgcaggaattcgtctcacccctagaaaaagacatcgttcttgattgatgtgtgcgacatgaatgatggatttttttaacatcctgaccatcattgtgtcgctcattatcgtattttgtacatcaaaaaaaaaaaaaaaaacgagacgctcgaggtacccaattcgccctatagtgagtcgtattacgcgcgctcactggccgtcgttttacaacgtcgtgactgggaaaaccctggcgttacccaaacttaatcgccttgcagcacatccccctttcgccagctggcgtaatagcgaagaggcccgctccgatcgcccttcccaacaattgcgcagcccctgaatggcgaatggaaattgcacccctttaatattttgttaaaattcccccccaatttctggtaaatcaacctcatttttttaaccccagaaacctgaaaacgcgcacaaattctcctttaactccagaccgaaccttacccgcaaataggagttgaactgtccgctcccaaattcgcgaactataaatcccacctattttaaaataccctggaacctctcttctgtccaaaaaggacctaaaaaatacccgttcttatccaggggccgaatgtgcccacctttatatgttgttacacccctccgccccccttaaattacacatgtgttatattatggac

SEQ ID NO: 62955 - DNA, 641 bp, Zea mays
  misc_feature: Ceres CLONE 1529885
  misc_feature: Encodes the peptide sequence at SEQ ID NO. 62956
  misc_feature (641)..(641): n is a, c, t, g, unknown, or other
agtggatcccccgggctgcaggaattcgtctcacccctagaaaaaaaaggtttaggaagttcatggcgaagtactttctgtcagttccagacacatggagtcttgataatccgtctaagccatgcaaatcccttggtcagagcaatcgcaagttggcggaagtccagattggtgataacctgtcagagcacccaaatgaagttgaggggtgtgcctaatcatgtgcaagatttcctggcaattttgttgaaccctatgcatgttgtaggttggctatatttcactttgtaaaatggagtacatagcacgaccttgcggtttttttacaacttgttgggggagggggggccccctgacccgaccttttacaaaccccccccgctgaatgtaacattaaaatagtggaatttagaaaccctccccatcaaacctccctccccaatccctccttttttgtaagcgaaaaaggcgatatcgcggggccctccggggtaccccaattcccccctttaggggattccgtttaaacccggcctcccttgggcgcatctttttacccacctcccgaaaaagggaaaaacaccctggggttaaccaaacaataagtaccctctttttaaaaatgtccccccctttccccn

SEQ ID NO: 62956 - protein, 71 aa, Zea mays
  misc_feature: Ceres CLONE 1529885
WIPRAAGIRLTPRKKRFRKFMAKYFLSVPDTWSLDNPSKPCKSLGQSNRKLAEVQIGDNLSEHPNEVEGCA

SEQ ID NO: 62957 - DNA, 662 bp, Zea mays
  misc_feature: Ceres CLONE 1529888
  misc_feature: SWISSPROT Homolog: EC 3.2.1.23 Beta-galactosidase
tggagctccccgcggtggcggccgctctatactagtggatcccccgggctgcaggaattcgtctcacccctagaaaaagtgtactgtgcgctagccgccgcctagctgcactgctgtatttttgtttcaggattgctgctgctgttcgcacattccatctttggctcctcccggagccggaggcgcgtttttactgttagccttactcttactccctgtagctccacgtagaagagaaccgatgtcccttgatgatggcgatgatgctgaaacctttttttgaacaatgatacatgatgattgttgcattgtactggtggtaaatcacggtccgtattggcctgttctgttggtgccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggg

SEQ ID NO: 62958 - DNA, 660 bp, Zea mays
  misc_feature: Ceres CLONE 1529891
  misc_feature: Encodes the peptide sequence at SEQ ID NO. 62959
ctctagaactagtggatcccccgggctgcaggaattcgtctcacccctagaaaaaaaaatcctcctcctccttctcctcctaccgcagcccgcagggaggtggagttgtcaacgtgccgaggactggagcggcccgcgtcctctataaacgagacgcccggccatttcctctgctcctctctgttcccccctgcctgcctgcttccagctgcatctctctcctcggtcctcgctcgctcggcttccctctctccgccgagaccgagaggaggcatccctgacgtacggacggcggccatggggacgcacgcgccggagaactaccccgccgagaaggacgctaggagcgcgcgggaaaaggccatcaacgactggctccccatcccttccttccggaaggcccaaagtggtggtaactccgcctttcccacaatgtcccccgccatggtgggggccggggtggctccgcctggcctaaagccatgtccaacctcgggctgggggccctggccatcccggatgctgggggggtctagggggaatcccccctgtaaacctctcgtggcaaaagggtggaaattcccccaaatgggccccccggaaaaggggttcacccttttcccaaattggggggaatcttttcgggcactgtggtttttt

SEQ ID NO: 62959 - protein, 121 aa, Zea mays
  misc_feature: Ceres CLONE 1529891
MGTHAPENYPAEKDARSAREKAINDWLPIPSFRKAQSGGNSAFPTMSPAMVGAGVAPPGLKPCPTSGWGPWPSRMLGGSRGNPPCKPLVAKGWKFPQMGPPEKGFTLFPNWGESFRALWFF

SEQ ID NO: 62960 - DNA, 649 bp, Zea mays
  misc_feature: Ceres CLONE 1529892
  misc_feature: Encodes the peptide sequence at SEQ ID NO. 62961
gcggtggcggccgctttagaactagtggatcccccgggctgcaggaattcgtctcacccctagaaaaaactcgcaatgtctacttgtctaccgtcgctgcgctagccctcctccctgcttcttgcttttgcctgagcctgcagcctgctgcaagcttttgctttggtttaggtgcttcttttccacccctttactgttccccccacttttgcttgctttgtcacgcacacgaaaagctcctgcctttaccttatctccgcacccgtagtgggatttggtgggagctgcgctgctcgcccctcgcgtttctttgctcaattgggggtcacggtcacggcccgcgggtgctgcgcgtgctcgtgggcgggcggaattcggggttcttgcgcggccccggtcccctcggcgattgcggacgctctctgcagatcttcgcgtaactccgggagcgcgccggagatgaactgcgggccgcccgaccagctgccgccggggtcggcgccgtcgtgcttcctcaacctgaactgggaccagtctatggccgccgaccagctcgacccggcgctcagctcgatggtctcctccccggcgtccaactcgacggccgccgccgcggttactgacggccgcgctctccacgggatctctc

SEQ ID NO: 62961 - protein, 63 aa, Zea mays
  misc_feature: Ceres CLONE 1529892
MNCGPPDQLPPGSAPSCFLNLNWDQSMAADQLDPALSSMVSSPASNSTAAAAVTDGRALHGIS

SEQ ID NO: 62962 - DNA, 697 bp, Zea mays
  misc_feature: Ceres CLONE 1529895
tacccgcggtggcggccgctctagaactagtggatcccccgggctgcaggaattcgtctcacccctagaaaaaaaaagctgctcatcaccgacgatggtgccacggctaacacaagcaagcaagcaagtcactgagtagctagcagtatataccaccataaaaacgacacgcacacacgcgtgcgctaataagctaagcttaaggcggtagccgtagctcctctcgatctccggctcggacggacgacgttgccatggctgctcaactgcatcacgcactatacgagctgctgcacgaagcagcagcagagcaacgagctctgctgctcgcgatcaccttctccctgctgaatctgacgatcctgctccgctacctcgcagcgtcagcgtcagcgtgggcgacgaaacccgacggagcagtgccggccagcgacgccgacaagctcttgagcctgctgccggcggcgccccataaagttccccatcattcggaaccttaaacaaatgggggggaaatctccaaaaggatccccccacggtttcccacacaagaccgggccaggacctaaattttctctcgccttggggcccaaaaaaaccgggggggggacttccccgccccactttccaaagaacccggggtccccccccaaaaaagaaaattttttctttaccccccgcccccccccggtggggt

SEQ ID NO: 62963 - DNA, 687 bp, Zea mays
  misc_feature: Ceres CLONE 1529896
  misc_feature: Encodes the peptide sequence at SEQ ID NO. 62964
tctgaactagtggatcccccgggctgcaggaattcgtctcacccctagaaaaaacacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgaatcagttgtagctggtgaatttggcaagactcaatttctctcatctgagttcagaaacgtttgccccgcctcctgcttcccttgagtcttgtcaaccatagttttctctcacctcattctgcgaggtggaccacatctacttttgggcctgtcagtctcccaatactcccttccgaaagaattctctaaaggtttgcattcccccgcttctcttcagggcactagacgccctggccgaagacttatcccttgccggcattcttgtgctacccccttaggaaaatatgactctcctttaaggattctagcgtgggattgattttatcgcgccccccactacttctctacttcggcccttttcaaccatcaacgc

SEQ ID NO: 62964 - protein, 29 aa, Zea mays
  misc_feature: Ceres CLONE 1529896
MSAEVAGGHPYFLSCYFWFIYCIKFRDFT

SEQ ID NO: 62965 - DNA, 772 bp, Zea mays
  misc_feature: Ceres CLONE 1529909
  misc_feature: Encodes the peptide sequence at SEQ ID NO. 62966
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ttttttnnnccttggcgggtccccacgggcggnccnncccccttttnnncccaaactgggactccccgcggtggcggccgctctatactagtggatcccccgggctgcaggaattcgtctcacccctagaaaaaatctcgcaatcgaggcgttttttttttctgcttcgtaagttcgtggtcgatccagcgagcgagcgagcagaccggcggctaaccgcggagggagagatggcgcaggggacgctggaggtgcttctcgtcggagccaggggcctcgagaacaccgattacctgagcaacatggacccctacgcgcttctgcaatgtcgctcccacgagcagaagagcagcgtcgcatctggtatacatctcttatctctgttcagctgctgcggtttgttgcttgctttgcatattagatactttgattcgggttgctgaaattattctttttacaagctacgttttctttattgtactagtaatcaggattctgctgtctgcaaaaaaaactaacaaaacgagacgctcgaggaacccaattcgcccatatagggagtcgtattacgcggcgctccatgggccgtcgtttttacagcggccgggacgggggaaaaaccccgggcggttaccccgccttaatccgcctttggtaccacattccccccttttcccacggctggggggaaataacagaaagaaggccccgcacccgattctgccccttccccaaaaaaatttggccgcagccctggaaagggccaaaacgg

SEQ ID NO: 62966 - protein, 70 aa, Zea mays
  misc_feature: Ceres CLONE 1529909
MAQGTLEVLLVGARGLENTDYLSNMDPYALLQCRSHEQKSSVASGIHLLSLFSCCGLLLALHIRYFDSGC

SEQ ID NO: 62967 - DNA, 712 bp, Zea mays
  misc_feature: Ceres CLONE 1529911
  misc_feature: Encodes the peptide sequence at SEQ ID NO. 62968
  misc_feature (458)..(458): n is a, c, t, g, unknown, or other
  misc_feature (479)..(479): n is a, c, t, g, unknown, or other
ctccccgcggtggcggccgctctagaactagtggatcccccgggctgcaggaattcgtctcacccctagaaaaaagctctccaccaagagcttgtaccccacaccactaggcactagtccactacctaacgctacctgccttttcaccgcgtcgtgcgctaccgccacgttgagctcgcgtccgtcccagatccgccgtgctcctccatcgctcgcgcaagatgaagatcacggtgcgggggtcggagatggtgtacccggcggcggagacgccgcgccgccgcctctggaactcgggccccgacctggtggtgccgcggttccacacgcccagcgtctacttcttccgccgcgaggacgcggaccgggaacgacctggcgggcgcggacgggagcttcttccacggggcgccggatgccgcgcgcgcttgccgaagcgctggtgcccttctaacccnatgggccgggcggctggcgcncgaccaggaacgcccccttctagatcgactggcaccccgggcggggtggtgttttcaggagaggggaagcgcccgacgccaccatcgactatttttttgtggggaatttcccgcccccccaggaggaattaaagggcctcatcccccaccgtcgaattttacggaggaaaaatttcctccctttccccccgggtctggggttccccggggagccccactttaaggggcggggg

SEQ ID NO: 62968 - protein, 129 aa, Zea mays
  misc_feature: Ceres CLONE 1529911
MKITVRGSEMVYPAAETPRRRLWNSGPDLVVPRFHTPSVYFFRREDADRERPGGRGRELLPRGAGCRARLPKRWCPSNPMGRAAGARPGTPPSRSTGTPGGVVFSGEGKRPTPPSTIFLWGISRPPRRN

SEQ ID NO: 62969 - DNA, 686 bp, Zea mays
  misc_feature: Ceres CLONE 1529916
  misc_feature: Encodes the peptide sequence at SEQ ID NO. 62970
  misc_feature (651)..(651): n is a, c, t, g, unknown, or other
  misc_feature (652)..(652): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
agtggatcccccgggctgcaggaattcgtctcacccctagaaaaaattgaccaatctgctccgggcaccatggagaggatcagtggcccgcgcctcgctgtcctgctcgctctcgccgtcctcaccgccgtcgccgcagcggccacggacgaggtgcgcgcgcagtccacctacatcatccacctcgccccaggccacccggcgctgttcgcagcgcgcgacaacagccgcgacgaggggggcctccgtcgtctcctcccgcgccgcctgcgcgcgcccaaggccgcgcgtgctctactcctaccagaacgctgccacggggatatggccacaggctcacacccccaacagggggggggaagcgggccgcccctccggaaaggaggattctgggccctttttttccccgaacagcaatcggggcagctgggggcgcgaccccccaaccccctcggagtgtctgttttatgtctttattaacaaaggaaaccccgggggctgtccccctccttggatacacaaataaaagcgggggcgtggcggcaccacctattcacgcctttatgtgtgggggtcgataaaaacgccggcgggccaagtccaccttattctggatgggagaacgggcgtgtaaccccctttggggtgtannagannntggcgcaatgggccccccccacgcacaa

SEQ ID NO: 62970 - protein, 136 aa, Zea mays
  misc_feature: Ceres CLONE 1529916
MERISGPRLAVLLALAVLTAVAAAATDEVRAQSTYIIHLAPGHPALFAARDNSRDEGGLRRLLPRRLRAPKAARALLLPERCHGDMATGSHPQQGGGSGPPLRKGGFWALFFPEQQSGQLGARPPNPLGVSVLCLY

SEQ ID NO: 62971 - DNA, 681 bp, Zea mays
  misc_feature: Ceres CLONE 1529918
  misc_feature: Encodes the peptide sequence at SEQ ID NO. 62972
ccccgcggtggcggccgctctatactagtggatcccccgggctgcaggaatttgtctcacccctagaaaaaacaggcacagccacactgcccttctctccccttcctctctcctctgcgtcgcttccacctctcaatctcaccccacgcctgccccgagctccaaccctaaaggaacacacccctgcttgcggcggcggggagcggtcttgggcgtccgccgttgctgtggcccagccgtgacagatccgggccccgcgccgttaggtcggtgtttcttcggcgacggtgcagccgctggatgttagtctggcggatcggggcccgtagttcgcgtgattcgagctaggcggtgttgagttgtaacatttgtatcacatgaatgaactcagagcatctcacccctaaaactgtgagcatatcaattcccctcctttaagcaatatgggagctaattgctgcattgctgcaaaggagaggacacaaccatgcattactccattagaagtatcagcgtacaggaatgtgagacattcaccatcatggagctttcggtgggacaatcgcccacctatagaagacattatggaaatccctactctgttctcccaccatagtagtggaagcattcggcctgatacaaagagtgggtccattgccccaactgaaggtttttcttaag

SEQ ID NO: 62972 - protein, 78 aa, Zea mays
  misc_feature: Ceres CLONE 1529918
MGANCCIAAKERTQPCITPLEVSAYRNVRHSPSWSFRWDNRPPIEDIMEIPTLFSHHSSGSIRPDTKSGSIAPTEGFS

SEQ ID NO: 62973 - DNA, 664 bp, Zea mays
  misc_feature: Ceres CLONE 1529922
  misc_feature: SWISSPROT Homolog: EC 3.2.1.23 Beta-galactosidase
cgcggtggcggccgctctagaactagtggatcccccgggctgcaggaattcgtctcacccctagaaaaatgagctcagtgtaaatgattgacggcatagtgccaagtaggggatcgattagtgccattgtctaattttgtttgtaacccagtcatagcaacatatagtgtacaaataatgtaaagccaatggagactgcagctgtgtatctgggtagcaacgctgacttgctgcattgagtagtatgtcctaccagcggattgaattgcttgttctggggtgtgcggcgcgcgccccgttgattgttctgttgtaacttgtaatcccatattaatcgtgtaatatgaaattcaatgcaaatacacggtcacaagctgttttcggtgcaaaaaaaaccagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgtt

SEQ ID NO: 62974 - DNA, 624 bp, Zea mays
  misc_feature: Ceres CLONE 1529923
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (273)..(273): n is a, c, t, g, unknown, or other
  misc_feature (274)..(274): n is a, c, t, g, unknown, or other
  misc_feature (321)..(321): n is a, c, t, g, unknown, or other
  misc_feature (329)..(329): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
ggagctccccgcggtggcggccgctctagaactagtggatcccccgggctgcaggaattcgtctcacccctagaaaaacctagccgccgccagaccattcgtttctcgcgagccatcgcttctgtaattctcaggcatccggaagaaatggccaagtcgaagaaccacacggcgcacaaccagtcgttcaaggcgcacaagaacggcattaagaaaannnnnnnnnnnnnnnnnnnnnnnnnnnnnccnnnccccccaaaaaaaaaagggggnnccccccggggggcccccccccccccaaaagcaccccccccggggggncccccccncccaaagggggaaaaaaacccccccctttttcccccccccaaacccccccccaaaaaaaggggggggggggggggnnnagggggggggaaaaaaaaaaatgggggggggggggaaaaaaaaaacccccccgccccccccacaaaaaaaaaagaggggggggggttgttttttttttttccccccccccccctcttttttttgtggggaaaaaaaaaaaggggtgtgttgttaaaaaaaaaaaaaaaaaaaccccctccctcctttttttttgaaaaaaaaaaagaagggggggtc

SEQ ID NO: 62975 - DNA, 629 bp, Zea mays
  misc_feature: Ceres CLONE 1529924
  misc_feature: Encodes the peptide sequence at SEQ ID NO. 62976
  misc_feature (629)..(629): n is a, c, t, g, unknown, or other
tggcggccgctctagaactagtggatcccccgggctgcaggaattcgtctcacccctagaaaaaagcatcgcttttcctttgcaatcgcatcctacttagctctgttccgtagaaatgaaatccagattgctcttgtactctttccccatcttggccgactcaaccaaacgcctgcattcagataaagtctcacttccgcagccacctcgaccactcttcgagagtgcgagctagttgtagatcggcgaggccgtctccgttcgcacaagccagacctcttcgcgccggcaatggacaggctcggcgcgaatccggcgaactcgtgcccgctgacgccgcttggcttcctggagcgctcggccaccgtcttcggcgattgccactccgtcgtgtaccacgacacggtcttcacctggtcccagacacaccggcgatgcctccgcctcgcctccgcgctcgtctctctcggcatcaaccgcggcgacatcgtaagcctcggtcagcagctccgcggattggcgcctggaaatgaacaagtctgatttggttaaaccattcctcttggcgtaggtgtccgtgctgttgcccaacgtgccggccatgtacgagatgcagttcggagtgcccn

SEQ ID NO: 62976 - protein, 83 aa, Zea mays
  misc_feature: Ceres CLONE 1529924
MDRLGANPANSCPLTPLGFLERSATVFGDCHSVVYHDTVFTWSQTHRRCLRLASALVSLGINRGDIVSLGQQLRGLAPGNEQV

SEQ ID NO: 62977 - DNA, 703 bp, Zea mays
  misc_feature: Ceres CLONE 1529927
  misc_feature: Encodes the peptide sequence at SEQ ID NO. 62978
  misc_feature (703)..(703): n is a, c, t, g, unknown, or other
gcggtgggcggcgctttttaactagtggattccccggggttgaaggaatttcttttccccctaaaaaaaaaagatccctttttcccattaacatgggcattccgggaagcttacaattacttgcagaaggcctccggcattggcgctgggtcttccacccaaaccttaaccttgttgttcttccccttacccaccgtattactgttgttagcgtccttcgccaaaagcacttcttcttccggtaagggaaagcggcggttccttccttcgccgccgggaaccttccccatcgtggggcacctacacaacattcgggccccaaacccacttctcgttccagaagctggtggccaagtacgggcacaacgggttcttgttcttccgcgccggggccccccccaccctgatcgtgtcttcccccaccgccgccaaggccgtgatgcgcacccacaaccacattttcgcgtcccggcggtggtcaatggcctcccaaatcttccgcttacaaaactggcgacgtggcctttttcgccccttcggcaaatacttggcagccaaaccagaaaacttaaagaaaacccccacctggtttaaaaaaaaaaaaaggtttaacctcctttccccattgggccccaaaaaaaaaaaaagtggtcccctcccctcgtgaaaaaaaaccccctccggaggggggggcccccccaan

SEQ ID NO: 62978 - protein, 75 aa, Zea mays
  misc_feature: Ceres CLONE 1529927
MRTHNHIFASRRWSMASQIFRLQNWRRGLFRPFGKYLAAKPENLKKTPTWFKKKKRFNLLSPLGPKKKKSGPLPS

SEQ ID NO: 62979 - DNA, 671 bp, Zea mays
  misc_feature: Ceres CLONE 1529928
  misc_feature: SWISSPROT Homolog: EC 3.2.1.23 Beta-galactosidase
ggagctccccgcggtggcggccgctctatactagtggatcccccgggctgcaggaattcgtctcacccctagaaaaagattttcttcacccgtccacctcgtcttgcgctcctctgtctcggcgacgactgtgctaccgccgccgccgccgcaagacttcgtcgggcactttgccggcgacgatttcccaccaggtgcttgctatggaacttttgaggcgttcagatacaagatccctggattgctaaagatcagatacattgggcaaaccaccgttggcagcgctgcgatttttgggcttttcttgggggctgggagcttgattcactgtggaaaatcctactagtttgtttccctttttttttctgaagtctgaacacacctttgtcgatgggcttcagtgaaaactattcaatgcctgtttcatgtaacagctaatagctcagggttggaaaagaacaatcaagttatgtcctagttttggtgtggatggaaatagaatcaacgttcatctgtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgc

SEQ ID NO: 62980 - DNA, 698 bp, Zea mays
  misc_feature: Ceres CLONE 1529935
  misc_feature: Encodes the peptide sequence at SEQ ID NO. 62981
  misc_feature (633)..(633): n is a, c, t, g, unknown, or other
  misc_feature (698)..(698): n is a, c, t, g, unknown, or other
aagctggagctccccgcggtggcggccgctctagaactagtggatcccccgggctgcaggaattcgtctcacccctagaaaaaaaaaacgccccacagcgcaagcgagcagatcctcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttacctttaatctgtttagttccattgcatcttctgcggttgcggttagtattgctgtttcttgctccttgtttcttgttcttttgcttctaaccatggacgcaggaacctcctccatctcatcagagaagagccacacggcggcagcggcgcggccccctcttcatgaggccggcactcagccctacatgccgtcgctgagcacaggatcgcgcaacccgtcggccaagtgctacggcgataggttcatctcggacaggtcggcgatggatatggacatggcgcactacctgctcacggagcccaatgaggacacagagaacgcggtggcagcgntccccatcaaggaggcgtaccggaagctgctcgccgagaagtggctcaacgaccggacacgcatn

SEQ ID NO: 62981 - protein, 101 aa, Zea mays
  misc_feature: Ceres CLONE 1529935
  misc_feature (81)..(81): Xaa is any aa, unknown, or other
MDAGTSSISSEKSHTAAAARPPLHEAGTQPYMPSLSTGSRNPSAKCYGDRFISDRSAMDMDMAHYLLTEPNEDTENAVAAXPIKEAYRKLLAEKWLNDRTR

SEQ ID NO: 62982 - DNA, 614 bp, Zea mays
  misc_feature: Ceres CLONE 1529949
  misc_feature (509)..(509): n is a, c, t, g, unknown, or other
agtggatcccccgggctgcaggaattcgtctcacccctagaaaaaaacactgaccacgtcagattcgcgatggataattcctgcaacagcgagctgcactgctagttctgggcgaggctgcgcgctccctgccatcttcgtccgcttccggatcgtattctacctcctccgtactcgcagctgaactcctggctaggtgtctacgtattcctaatcagagacagacagacgggagatcgctccgggcgtccggtgggggttctagaatgagtcccttgagagcgcggtatcttctggagcagcggcttatatactcgggattatcggagcaacgattgcacatgcaacgcgtggagatgggccagcacccccacctggacctgaagaatatacgcgatgcgggagaagctgctcttcgtgcggacttaactcgtcatctgcgtcgatacatagtggggtcattctgaaagtgggagatgtgatgaaaagagactccgtggctgactggnctcttatcaatactgacgctataacagaacacccgttaaaaggggtcatccaggtggataaggtatatagcaccgttgcctagggagtctatagctcctatatgg

SEQ ID NO: 62983 - DNA, 836 bp, Zea mays
  misc_feature: Ceres CLONE 1529960-R
ccgattgggtacctcgagcgtctcgtttttttttttttttttgcccctcgaaagacatctccgattataattgccccttagtctataaccagggggtccctctgagtctttgaaatacaataacaggggcaactttgtgaagccttttctttataatggaaaaatccaaatctctctggagtctttggggaaaaaacttcttcaatctcatcccccaatggaaaaatttggcgcggggagtcaggtttcaggtcaccattgccatatctgtcaaagcttttttgactgagtaggctaccattgacatccatctgttgctgcaatgctaatgttaaggccccaccacgggccatggaaagctgcatctggagctgggaaatcttttgctggaccacggaaatggcccccacccacccataaacagggtccctggggcgaacgttggcctcataaaccatactgctcaccgcatcccctctctggggcaggcagctcctgcagtaacttgaaaacattgctgccaccgaaaaccttgtggacgatggcaaacttgtgaggttcctcggcggggaagtagggcgcgaacacgcactcctgtgtgcactggtggcgcaacagcctgcacaacgcgcacgggaacctgctcctacggctgctgctttcgctggcgggccatggtaataacccgccccccctgggggaaaaaacttgtgaacacctccgatccgcccgttttctttgaatattgggagattaatttccccgtaatggggaggccctgtttgcctccgggtcaatcctttcattggcaattttttcgcctttttccagcccca

SEQ ID NO: 62984 - DNA, 629 bp, Zea mays
  misc_feature: Ceres CLONE 1529960
  misc_feature: Encodes the peptide sequence at SEQ ID NO. 62985
gcggtggcggccgctctagaactagtggatcccccgggctgcaggaattcgtctcacccctagaaaaactctcccatctcaatcaaatctacaggggagtagctcttgctcttggcttcgctggctaacaatccgtgaactgaacaccttccgcctcccggcctcctccctgcccagtgctgaagaaccctgccggagatttgtttgttcctgcggtgttattccccccccccccccaaaatctgttggccgctctcccacaatcgcttttccttagatccccggaactggatcgatctgccgccaactctaaaaatccatccgatccatccttgtcgtccaagtctactccccgatggacattatttaccaggacagcagttgtcttgccctacaggaggcgctacatgatgaaggcgtgggaccaatcgacctacctttcatgcttctcagggccatcacaaaagatttctctgatactcaactaattggcaggggtgggtttggagaggtttacaagggagtgcttccaaatgggatggtcgtcgccgtgaagaagcttcttgacaagatcgatgtcctagaggcgaatttccaaagcgaggttgcttgtctcatagaggtcaagc

SEQ ID NO: 62985 - protein, 91 aa, Zea mays
  misc_feature: Ceres CLONE 1529960
  misc_feature: SWISSPROT Homolog: EC 2.7.11.1 Non-specific serine/threonine protein kinase
MDIIYQDSSCLALQEALHDEGVGPIDLPFMLLRAITKDFSDTQLIGRGGFGEVYKGVLPNGMVVAVKKLLDKIDVLEANFQSEVACLIEVK

SEQ ID NO: 62986 - DNA, 829 bp, Zea mays
  misc_feature: Ceres CLONE 1529967
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (14)..(14): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (60)..(60): n is a, c, t, g, unknown, or other
cccctgggnnnaanggtggnnacattttttttannnnnactctannnnnnnnnnnntggngctccccgcggtggcggccgctctattatctactggatcccccgggctgcaggaattcttctcacccctagaaaaagacatcacagggagaagatggtggtcactaggcatgtgagcttgtggctgggttcgtcaaatgccttattgttaccagctggggatcatgcttcgcatcaaacgctcgagatctgcacagcaatgtgttggacatgcatgctcctcgctctctagccatcgaatgcaaactctgagaatgccgcatgcagagttcgcccctttggttcaccacgttgcttcagagcttcaaatggtttttgtgtgttgaaaagtatttgatcttgccggaccttctttcttttgcccccccgcccctttgggagggggggtgccctttccagtttttttttttttctgccccccccttttgtcttttcctttttatcgctcctctttccctccattttccacccatagcgtaaccctccctttccttcctttcttcgcaagactaaaataaatattaattcctctctccgacgcttgccccagtgtttctccctcctcattctatttccttctccctctgccagttttctttgtgcttttcctcttatttacaatccatcccccccctcttaactataactcctcttatatcttcccccatacaattattttcgtcctgaccggggttatttattaccctctcgacaatacccatcaccccaccattcacctattttaccctcccccattcactaccctccat

SEQ ID NO: 62987 - DNA, 656 bp, Zea mays
  misc_feature: Ceres CLONE 1529972
  misc_feature: Encodes the peptide sequence at SEQ ID NO. 62988
  misc_feature (656)..(656): n is a, c, t, g, unknown, or other
gcggtggcggccgctctagtctagtggatcccccgggctgcaggaattcgtctcacccctagaaaaaaaacagcacacattattcttcctccaccccatctcttgagtcgcctggccggcggcttggttacccctctagagctcaacagcagctagctgtgtagcctaagctagaggtttaaccatcagcgcatggccatggcgatctcctctgctcttccgtgctccctcctcgtggcggccctgatgctcctcgcctccgtcatccaagtgcaaggcatcacgaggcactacgacttcaatgtgaccatggcgaacgtgacacggctgtgcgccagcaagagcatcatcacggtgaacgggcagttccccgggcccaagatcgtggcgagggaaggcgaccggctcgtcatccgcgtcaccaaccaagcccagcacaacatctcgctgcactggcacggcatccggcagctgcgcacggggtgggcggacgggccggcgtacatcacgcagtgcccgatccagacggggcagagctacgtgtacaactacaccgtggtggggcagcgcggcacgctgtggtggcacgcgcacatctcctggctgcgcgccaccgtctacgggcccctcgtcatcctgcccaagctcggcgtccn

SEQ ID NO: 62988 - protein, 152 aa, Zea mays
  misc_feature: Ceres CLONE 1529972
  misc_feature (35)..(151): Pfam Name: Cu-oxidase_3 Pfam Description: Multicopper oxidase
  misc_feature: SWISSPROT Homolog: EC 1.10.3.2 Laccase
MAISSALPCSLLVAALMLLASVIQVQGITRHYDFNVTMANVTRLCASKSIITVNGQFPGPKIVAREGDRLVIRVTNQAQHNISLHWHGIRQLRTGWADGPAYITQCPIQTGQSYVYNYTVVGQRGTLWWHAHISWLRATVYGPLVILPKLGV

SEQ ID NO: 62989 - DNA, 651 bp, Zea mays
  misc_feature: Ceres CLONE 1529980
  misc_feature (650)..(650): n is a, c, t, g, unknown, or other
tccccgcggtggcggccgctctataactagtggatcccccgggctgcaggaattcgtctcacccctagaaaaagctccgtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcaattttttttttactgtcaaggataagctagtgacctctgtgtgcatacagcanc

SEQ ID NO: 62990 - DNA, 657 bp, Zea mays
  misc_feature: Ceres CLONE 1529982
  misc_feature: Translation starting site: 322
  misc_feature (657)..(657): n is a, c, t, g, unknown, or other
ctccccgcggtggcggccgctctagaactagtggatcccccgggctgcaggaattcgtctcacccctagaaaaattctttactttaaagttactcccactagccccagcccccgcgccgtcccatcacccccaatcccagccttctcctcctcgacgacaccacacgcccccaaaaaatcccccttcgcctcggattcccacgcggccctcgagtcgccggcgcccgccgacgccacagcgaggtggttccgttcaaggcttgggaggcggaagtagggagcgggaggatccgttcgcgtccagcgcccgttgacgcgcccatgtcgggccacctcgatcgcttcgcgcggccatgttttgaagggcgctcaagtcatgatgaatgcagagaccataagtcagactttgaagtctctgaagacgaaaagaagaccagaatgggctctttgaagaaaaagcaatagatgcatcaactaagattaggcattcattatagaagaacaggaggaagagtggtagccgagtcctttctgtgtctattgaggatgtgcgtgatctagaggagctgcaagctgttgaagcatttagaccagcactactcttgaatgagcgggtgccctgcagacacgatgactatcatatgatgctgagatttn

SEQ ID NO: 62991 - DNA, 729 bp, Zea mays
  misc_feature: Ceres CLONE 1529987
  misc_feature: Encodes the peptide sequence at SEQ ID NO. 62992
  misc_feature (10)..(10): n is a, c, t, g, unknown, or other
  misc_feature (11)..(11): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
cccacccccnnacatgctccgggtgccgcggactcgacatcgncgccgacnnntaaaattggaactccgcgcggtggcggccgctctagaactagtggatcccccgggctgcaggaatgcgtctcacccctagaaaaagcttgccgggcgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtcgatcccgctccgcctgcccgccgcgctcccgctccgccactgcctcccggccctccgcgccgcctccgccgccgccgccgcagtccccgcgcccggggacgacgcgtcgccccccttcctgggcgtggagacgaagacaatcaagaagatcatgcccctggggctcatgttcttctgcatcctcttaaactaccccatccttgcgggatacccaaggacgtgctcctccaatcacccccgaaggggcctcatgcgcccggaaatcattcccggtttcctcacaaaacctgagggtacaatcgggccccaataggcaggtccgggcttgcattggctcccctccttacacccaaaaacctccccccctaatggt

SEQ ID NO: 62992 - protein, 154 aa, Zea mays
  misc_feature: Ceres CLONE 1529987
MESGLVASHRLRVPPPSASAGHHHLIRHRHAHAPVAAAPLRLSLPRHLPRSIPLRLPAALPLRHCLPALRAASAAAAAVPAPGDDASPPFLGVETKTIKKIMPLGLMFFCILLNYPILAGYPRTCSSNHPRRGLMRPEIIPGFLTKPEGTIGPQ

SEQ ID NO: 62993 - DNA, 676 bp, Zea mays
  misc_feature: Ceres CLONE 1529989
  misc_feature: Encodes the peptide sequence at SEQ ID NO. 62994
  misc_feature (492)..(492): n is a, c, t, g, unknown, or other
  misc_feature (522)..(522): n is a, c, t, g, unknown, or other
  misc_feature (545)..(545): n is a, c, t, g, unknown, or other
tccccgcggtggcggccgctctagaactagtggatcccccgggctgcaggaattcgtctcacccctagaaaaaaacctcgcgcaaccatcacagcacagctgcacaggcaaccctgaggcccagacctgatctcgccggcggcgagcttgtgtccatggctgacggggccgatatggacgaagaggctatgcgggccttcttcccgctctccttcggaaaggcggctccgcggcccagctctgctacctcctccgcccactccaacacccttcgcaagcctcaaaaccctagtaaccccaagccttccgcctctaccgccgcggacgacgatggggccgctatgattggtcctcctcgccccgcgcccggcgcccgcgggggaggagacgatgaggacggcggcggtatcatgatcggggccggctcggccacgccgccctccgctcgcggcgaggggggacgacggcgacggcatgattggggccgcctanggcgcccgccagcggatgatgaagacgtcnattgatgatgaggaccaccaccnagaggaaatgggagatgtatggggaaaggtgggattcaatccgaatcccccttaacaaccaaatttgttccggggggcccaaaaagggtgcccctcgcccttgctggtgccccttccgggttccaaagggc

SEQ ID NO: 62994 - protein, 122 aa, Zea mays
  misc_feature: Ceres CLONE 1529989
  misc_feature (113)..(113): Xaa is any aa, unknown, or other
MADGADMDEEAMRAFFPLSFGKAAPRPSSATSSAHSNTLRKPQNPSNPKPSASTAADDDGAAMIGPPRPAPGARGGGDDEDGGGIMIGAGSATPPSARGEGGRRRRHDWGRLXRPPADDEDV

SEQ ID NO: 62995 - DNA, 674 bp, Zea mays
  misc_feature: Ceres CLONE 1529991
  misc_feature: Encodes the peptide sequence at SEQ ID NO. 62996
ctccccgcggtggcggccgctctagaactagtggatcccccgggctgcaggaattcgtctcacccctagaaaaaacacacactacacgctcacagtcacagagtccagaggcgtcagtccaccgcgccaaccccaacaagcaccaccagccactcgaggcaccgaatcacgatggagcccgcgggcacgatcgtgttcgcctccgtcggcgtcaccaacttcggcttcgacgtgttctctgcaaccgtccctgcggcaacgtccgtggaggcaggcgtctccgcggaggacctcgacgagcggcgccacacggacggaatctccgtcaacttcaacgcccaattcgcggacgacgccggcgacgcggtcgcgttcgtgtccgagcgcaccggggcagcgagcctgttcctgtcccggccggggtccgaacccgacccgctcccggccgccgagggcagcctgttccacgaccgccccacggtgcgcggcggccgggtgtacttcgtctccgcgcacgagaagccggaccggccgttccggagctgggcggccgtgtacgcggcagagctaggcgcaggccgggagcggaagccggagccgcagccgcagcggctcacccccgcgcggcgtcgtggacatgaagccccgccgtgtccgcctcgggcgacctcctc

SEQ ID NO: 62996 - protein, 167 aa, Zea mays
  misc_feature: Ceres CLONE 1529991
MEPAGTIVFASVGVTNFGFDVFSATVPAATSVEAGVSAEDLDERRHTDGISVNFNAQFADDAGDAVAFVSERTGAASLFLSRPGSEPDPLPAAEGSLFHDRPTVRGGRVYFVSAHEKPDRPFRSWAAVYAAELGAGRERKPEPQPQRLTPARRRGHEAPPCPPRATS

SEQ ID NO: 62997 - DNA, 986 bp, Zea mays
  misc_feature: Ceres CLONE 1529991-R
agcaacacctctttattccttctctcttttttttgacgtacagcacgtccttttttattcagcaacgaaacaaacaaaaggccgtcctcaacagcaatgcagcgtcattattcttacattattaattacaaaaggaccatcagacgtcgcaggtaagccacagcggctcgtcgaactggcccaaggcgtcctccccggcgggcgggctcatggacagtgactccagcccgagcccggcgcttgctggcccccacaccggcgtgccgttctcataggcgttgcaggtgaggcggcacaagtcccatccctccagggggcacaagtataggtccccctacgggttgaaaatattgggccccgagaatggctcccccacaaaccttcccaaattggtccgtaaacgaaaaacattttagatttcggggttaaaacaccaaccggttttaacccccctcttggacgcccttacgtggtgtaccttcgccccccgggataggtaatacaggtatcccactccctgtaaactctctggggcccccctcccagggttgtaatgctgtaaaatacgggctttggtttttccccgggagtccgttacctgtttaatagcccaaaaaaaagaccagagaaaaaaattccccccatctttttggggggaatacacagggttaaggacaaatagagtgtatattacatttttatattcctcttctcgttagataatcggagatggagaaattataaatattgtcctcacataatggcgcgggtgcggggtgacccataaaaaaataaagtgatcttcctgggggagttcgaattccaggagtatgtaattcaataataacattctctcgccctctcccccgtcctttgtgatacccccctctccgcggacacgtgcttttttatcccgtccgcccccttatctggatgcaatgaccgtctacttcgtggggggtcatacaacccatttattctttgtg

SEQ ID NO: 62998 - DNA, 685 bp, Zea mays
  misc_feature: Ceres CLONE 1529992
  misc_feature: Encodes the peptide sequence at SEQ ID NO. 62999
  misc_feature (596)..(596): n is a, c, t, g, unknown, or other
  misc_feature (619)..(619): n is a, c, t, g, unknown, or other
  misc_feature (685)..(685): n is a, c, t, g, unknown, or other
aagctggagctccccgcggtggcggccgctctagaactagtggatcccccgggctgcaggaattcgtctcacccctagaaaaaagcgccagcggcagagagtcgagaccttctagctaggccgctgccacgtcaaaactagctcctccagacaaccaatcagctagccgaagccggtccattagcatgcagcagcgctagtagacgtcgtctccgggtctccactctccacacagaaacccatacaaaatccgcatccagaatcaccggagatacgagtccgcgcgtacgttgcagttgaattgtgaagagaggctgtgcgcactgctgctgctgctgcttcttcttcttcgacgcgtgcgtacgtgcacatggatgctgctgacctcccgtgatcttcgatctccacacggcggcaagcgatcgagaggcgtggttcccgtggcgtcaaccgacacctagcagctgctagctcatctgcttgatctctagctgagactccgagcaaaataccgcacgaccgagcgcgcggcattgaccgacccatcgccgccgcctcgatcgaccatgacgcttgcgagcacggacaaggtggtngctgggatgcatcgcgttcagcnatcttcggggtgctggggcgtcttcccctcggtgccggtcatggccggtgggccgcaccgccgggn

SEQ ID NO: 62999 - protein, 39 aa, Zea mays
  misc_feature: Ceres CLONE 1529992
  misc_feature (18)..(18): Xaa is any aa, unknown, or other
MTLASTDKVVAGMHRVQXSSGCWGVFPSVPVMAGGPHRR

SEQ ID NO: 63000 - DNA, 698 bp, Zea mays
  misc_feature: Ceres CLONE 1529993
  misc_feature: Encodes the peptide sequence at SEQ ID NO. 63001
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (588)..(588): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (650)..(650): n is a, c, t, g, unknown, or other
  misc_feature (651)..(651): n is a, c, t, g, unknown, or other
  misc_feature (668)..(668): n is a, c, t, g, unknown, or other
  misc_feature (669)..(669): n is a, c, t, g, unknown, or other
tccccgcggtggcggccgctctagaactagtggatcccccgggctgcaggaattcgtctcacccctagaaaaaaagaccagatgccactctgagcttcccattaacctcgagctctggtcatcacaattaattaaaacaaaccgttcccgcagctcgtgccgacaatggcggcctctgttgagcggcacctggccccccacccgtggccggccaatgcgcctcccaagagcttcgacatgttccgctccggcggcccaggaggcaagcgccgcaccggccccgactccgactccgaggacgaggacagcattcccccggactggcggtcgctgtacagcccgcgcctggaggtggagccgtccgcccacgacccacgcgacgaggccacctccgacgcgtgggtgcgacgccacccggcgctcgtccggctcacgggcaagcacccgttcaactcggagccgccggtgccgcggctgatggcgcacggcttcgtcaccccggcgccgctccactacgtgcgcaaccacggggcggtcccccgggcggactgtcacgannnnannnnnggggggggggggggggggggnttnnnggggggnnnccnnnnngggggnnnnnnggggggggnnnnggggggggggggggtttnnggggggcgggggggggnncccggggttgggggggggggggggggggg

SEQ ID NO: 63001 - protein, 177 aa, Zea mays
  misc_feature: Ceres CLONE 1529993
  misc_feature: SWISSPROT Homolog: EC 1.7.1.2 Nitrate reductase (NAD(P)H)
  misc_feature (131)..(131): Xaa is any aa, unknown, or other
  misc_feature (132)..(132): Xaa is any aa, unknown, or other
  misc_feature (133)..(133): Xaa is any aa, unknown, or other
  misc_feature (134)..(134): Xaa is any aa, unknown, or other
  misc_feature (142)..(142): Xaa is any aa, unknown, or other
  misc_feature (143)..(143): Xaa is any aa, unknown, or other
  misc_feature (146)..(146): Xaa is any aa, unknown, or other
  misc_feature (147)..(147): Xaa is any aa, unknown, or other
  misc_feature (148)..(148): Xaa is any aa, unknown, or other
  misc_feature (151)..(151): Xaa is any aa, unknown, or other
  misc_feature (152)..(152): Xaa is any aa, unknown, or other
  misc_feature (155)..(155): Xaa is any aa, unknown, or other
  misc_feature (156)..(156): Xaa is any aa, unknown, or other
  misc_feature (162)..(162): Xaa is any aa, unknown, or other
  misc_feature (168)..(168): Xaa is any aa, unknown, or other
MAASVERHLAPHPWPANAPPKSFDMFRSGGPGGKRRTGPDSDSEDEDSIPPDWRSLYSPRLEVEPSAHDPRDEATSDAWVRRHPALVRLTGKHPFNSEPPVPRLMAHGFVTPAPLHYVRNHGAVPRADCHXXXXGGGGGGGXXGGXXXGGXXGGXXGGGGVXGGRGGXPGVGGGGGG

SEQ ID NO: 63002 - DNA, 640 bp, Zea mays
  misc_feature: Ceres CLONE 1529994
  misc_feature: Encodes the peptide sequence at SEQ ID NO. 63003
  misc_feature (453)..(453): n is a, c, t, g, unknown, or other
  misc_feature (550)..(550): n is a, c, t, g, unknown, or other
  misc_feature (640)..(640): n is a, c, t, g, unknown, or other
tccccgcggtggcggccgctctatactagtggatcccccgggctgcaggaattcgtctcacccctagaaaaagtctgagctcgccagagaagaccctgacagtccgacaccctcgagccactaagtgcagcctcgttgctacatgaatgctgacaaatgtctgaccttgtcggagagcgcatcctgcgcagtggccgcaactgctcatctcaagcacgtccaggacaggtaggttcatcagtctcatcgtcggtttctacgatatactcatgtcacgccagatctctgctacaagcaacttcctacatacgaaagaggtgtgcctgcaatggaggatgccatggcggtcctctggaagagcgtgctgcacggacctcactagctggtgcgggtgctacgacacgacgactgctgtcgtgtgctctcagaacgcgtactgatcacggtgcgatnagtggcgttcgaccgtgccgccaatgatcaactggagcgcacgagcttgctgatcagatcaaagcccgagatcgcctcatgaacgatggtgtcccancccccacttcgtggagctggaaaatggtgattgcttcccgctccagatcttacctcccggctcaaactcatactcgggcgggaagctctn

SEQ ID NO: 63003 - protein, 29 aa, Zea mays
  misc_feature: Ceres CLONE 1529994
MNADKCLTLSESASCAVAATAHLKHVQDR

SEQ ID NO: 63004 - DNA, 751 bp, Zea mays
  misc_feature: Ceres CLONE 1529997
  misc_feature: Encodes the peptide sequence at SEQ ID NO. 63005
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (47)..(47): n is a, c, t, g, unknown, or other
  misc_feature (656)..(656): n is a, c, t, g, unknown, or other
nccccnnnnnnnnnnnnnnnttttattataaaacaaaatgtttcccncccaaactgggactccccgcggtggcggccgctctagactagtggatcccccgggctgcaggaattcgtctcacccctagaaaaagagaagtcttcccctcgcctcgtctccgcccacaacaaacatcacccgaagccgcgtggagccatcatccagatctgagccagcgcgccgggtgatgctgttccggccaccaaagtagccgtcttgcgccccgacccaagagccagggcggacgatggagaggagaagctgcgcgcaacggtgcatcatatcgtgcagacgctggggagctgcgaccctatgacggaggacatcctacaggtcttctccgactacgacggccgcctctcgctcgacaagctctaccccccacacgcagcggcggccgccgctgcgtccggtggtggcgcgccaccaggaggaggaggagggggaggaatcgtacgggagcgcgtcgagacagaggtcctgctgatggcaccgcctcccgctgcgagaggtgttggccgcttgggtctacgccgttgggtcacctcggtggaagctaccagtgagttgccgtgggagcgcctgattttcggaggtaagttggacttcgtatgggnttaattaggggcggacctcccgccttacgaaaaaggaaggtacccagaaaaaagtttcttaaaacctactccgggttcccggtgggaagcccggg

SEQ ID NO: 63005 - protein, 101 aa, Zea mays
  misc_feature: Ceres CLONE 1529997
MTEDILQVFSDYDGRLSLDKLYPPHAAAAAAASGGGAPPGGGGGGGIVRERVETEVLLMAPPPAARGVGRLGLRRWVTSVEATSELPWERLIFGGKLDFVW

SEQ ID NO: 63006 - DNA, 654 bp, Zea mays
  misc_feature: Ceres CLONE 1529998
  misc_feature: Encodes the peptide sequence at SEQ ID NO. 63007
gcggtggcggccgctctatactagtggatcccccgggctgcaggaattcctctcacccctagaaaaaagctcgctcctcctcttcttctcctctttcttctcgaaccatcatcatatatatatagaatcaatatggaaggagcggccgaccataagcggcaggtggacgacaagccgccgtacgccgccgtggacgacaccatgaccaccaccacgaagaagatggtggaggagcagctctcagacgacgccggcggcggcggcgagctgccagagcagaactaccgtggatggaaggccatgccctacgtcatagggaacgagacgtgcgagaagctgggcaccatcggcaccacggccaacctgctggtgtacctcaccaccgtgtacggcatgtcgggcgccagcgccgccaccctgctcagcctctggtcgggcaccgtcaacctggcgccgctcctgggcgccttcctcagcgacacctacatgggccgctacgccaccatcgccttcgcctccatggcctccttcctcggcatgatcgtcctcaccctcaccgccgccgtgccgtcgctccaccctgccgccaacagcagcaccaccggcggcccctcgtccctccagatgggcgtgctcctcgcctccttcgcgctg

SEQ ID NO: 63007 - protein, 174 aa, Zea mays
  misc_feature: Ceres CLONE 1529998
MEGAADHKRQVDDKPPYAAVDDTMTTTTKKMVEEQLSDDAGGGGELPEQNYRGWKAMPYVIGNETCEKLGTIGTTANLLVYLTTVYGMSGASAATLLSLWSGTVNLAPLLGAFLSDTYMGRYATIAFASMASFLGMIVLTLTAAVPSLHPAANSSTTGGPSSLQMGVLLASFAL

SEQ ID NO: 63008 - DNA, 865 bp, Zea mays
  misc_feature: Ceres CLONE 1530001-R
  misc_feature: SWISSPROT Homolog: EC 1.5.3.11 Polyamine oxidase
ccgaattgggtacctcgagcgtctcgtttttttttttttttttgaatggaactccccgatacaaagttttgattaccaaatagatataatttcataagccatgcccccctcttcatgaaaaaaaacaaacaccgtactttttaaacgggatacccgatcacaaatcgggctcatcgaaccacccgctagcttttttggaataatgaaaaggcatatgccgcgaggggatatggctgccacctatactttgttgaaaactgggaaaaaatgaactgaaaaatgcaacatccccactgctcaatttgctggagctttaaaacaattttcctggagcttcctagccatactttccctggacatggtatttgcacatctttttctgggcccatttaatgaaaatttcaccggatcccatacctgaaagataggccccatggacatagcctttgtagtgcccgcttgtgtgccccccggtgaagtatacccccccaaccggggccctaagctggccgtattcctaccggttgaccccaactggccacttaaagaaggtccccttgtagaacctgtaggaccaccacctcgggacaaggatttcggggggctccgggaaattccttgccggagaaatatcttccccaatacctgcatgattctcgccttgggatctgtccttccaaaggctgcttgaatccccccgaactccctccccggggcccgggggacccaggagaaaattgggcgtcgggggaactgctttttcgaaaaccccggcccaaacccccgaagaaaccccctccccgccgggttggggaaaaagaaaaaaaactccccttcctttttcccttaaggggcaaaaaatacg

SEQ ID NO: 63009 - DNA, 661 bp, Zea mays
  misc_feature: Ceres CLONE 1530005
  misc_feature: Encodes the peptide sequence at SEQ ID NO. 63010
gctcttaactagtggatcccccgggctgcaggaattcgtctcacccctagaaaaagccccatttgtttactgggtgtctgggtccagtccccgccccgaatcttttccctcctcccgcaccccaggccgcagcagcagcaccggcgcaccgccacccactcgccccgcctccgtgcccgcgcaactcgcgcctgcagcgtgtgggagatgtgatcggagcccgggcgtcggttcgagtgttttcttctgcctctgggctgtggcgcggggaggaggcaagctggcggtgagatgggtcggtgcggaggaggaagcggagcaggagcaggagggggagctttgggcggctgtgctctcctcaccgccgccttggtttatctcgacgctcgtgatccagggcgctggaggatctaagcaatctcatgcacctgctgttgctcgcaaggttcttctatccataacgaattggcacccacacaattactttgggatgatgtacttcatccatcacaagtacaagatcaaaggctccaacgtttaggccaagaatgcccctcatttcatacttggcaatggaacttccaaaattcctccatctcccgttcaaggaacctggctgcgtttggcaatccccttccaagttcaaccgatatggcgcccg

SEQ ID NO: 63010 - protein, 179 aa, Zea mays
  misc_feature: Ceres CLONE 1530005
LLTSGSPGLQEFVSPLEKAPFVYWVSGSSPRPESFPSSRTPGRSSSTGAPPPTRPASVPAQLAPAACGRCDRSPGVGSSVFFCLWAVARGGGKLAVRWVGAEEEAEQEQEGELWAAVLSSPPPWFISTLVIQGAGGSKQSHAPAVARKVLLSITNWHPHNYFGMMYFIHHKYKIKGSNV

SEQ ID NO: 63011 - DNA, 651 bp, Zea mays
  misc_feature: Ceres CLONE 1530007
ccccgcggtggcggccgctctataactagtggatcccccgggctgcaggaattcgtctcacccctagaaaaagttcggagcctcctgccgcaatttttttttgaggctggtctgtttcgtgacgtcccgcgagaagagaacccccgtggcccctggccgcgacggagcggtcagaagcagcggcggccggcgcggtttcggtttcctggttggcccgagaattccgattcctctcctgatttgtgttgcctggaggccccgtcgctgtccccgcgctctctgtctcctcacgcttggctgttcgccgcggcgccaccgtcggaggcagctgctaatcgcgcgtccggtggccgcgttgcagcggcggagcgtctcttgttgtgcagtgctgcagcggattgtcgcggcctgcccgcggtgagggcggcatccctcttcggaaggcgtgctcgggcggggccagcccaaccgccgatcgtgcgctagagttcctcgctctcaaagtggagaaataagatacctagtggaagatgagatcagttgttcgggtcacttcgccagctccccccgatttatcccgccactatgcggaaggggaacttccaagcaaccaaaattgttcgggctgcaatatggcttaatcgtgtgcgg

SEQ ID NO: 63012 - DNA, 588 bp, Zea mays
  misc_feature: Ceres CLONE 1530010
gcggtggcggccgctctagaactagtggatcccccgggctgcaggaattcgtctcacccctagaaaaacccgccccaccaaacactcccgcagacccacccgtccccgtccgtccacagccagctccgcctcccatccagcgcccgtccacagccaccacagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgtttctttctcggtttgggttctagtctagcagtgtactactactagtcgttaggttggtagccaagaagaggttctttttccacacctcccttggcgcaggtgagtccctgtccctgagcgggatctacccaacacgtgccatctgtttttttacggggggctgttggggttccgccaagttcctttcgttttggtcccccggtttgcctggggggggggaaaacccaaaaaacccaaaaaacccgtt

SEQ ID NO: 63013 - DNA, 644 bp, Zea mays
  misc_feature: Ceres CLONE 1530012
  misc_feature: Encodes the peptide sequence at SEQ ID NO. 63014
  misc_feature (467)..(467): n is a, c, t, g, unknown, or other
  misc_feature (478)..(478): n is a, c, t, g, unknown, or other
  misc_feature (579)..(579): n is a, c, t, g, unknown, or other
tccccgcggtggcggccgctctagaactagtggatcccccgggctgcaggaattcgtctcacccctagaaaaaaaccccacccccaccaccaagggtccaaagccatgcgtgccgccatggcggcggcggtcctccgacccacggccgccaccctccgcttcctctccaccccaccacaccagcgccgccgcgtcttggtcggacacctcccctttgctcgccgacgccgccactcctccaccgctacggccccagcgctggaggactccagcccccgcagtggcgaaggcaaggccgtgcgccgccgccgcgcccgtgaatctccccagggcctcctccgccaccagctcgacatgtgctcccgcaacgccgagctcagcatcgcgctccgcctctacgacgacgccctctccccggacaaaccccttcccggttctcccctccaacactacaactggctgctctnactctgctccnacggcgccgctaccgactctgacagcaatatctccgcaccggctgtaaagggggggtcgaatttctccccaggatggaggcccacggggttccaccccaanaaggtcccccccaaccaaggttggggggccttggcgcgccccccgggaaccttgatggggctttt

SEQ ID NO: 63014 - protein, 179 aa, Zea mays
  misc_feature: Ceres CLONE 1530012
  misc_feature (121)..(121): Xaa is any aa, unknown, or other
  misc_feature (125)..(125): Xaa is any aa, unknown, or other
  misc_feature (158)..(158): Xaa is any aa, unknown, or other
MRAAMAAAVLRPTAATLRFLSTPPHQRRRVLVGHLPFARRRRHSSTATAPALEDSSPRSGEGKAVRRRRARESPQGLLRHQLDMCSRNAELSIALRLYDDALSPDKPLPGSPLQHYNWLLXLCSXGAATDSDSNISAPAVKGGSNFSPGWRPTGFHPXKVPPNQGWGALARPPGTLMGL

SEQ ID NO: 63015 - DNA, 650 bp, Zea mays
  misc_feature: Ceres CLONE 1530031
  misc_feature: SWISSPROT Homolog: EC 3.2.1.23 Beta-galactosidase
gcggtggcggccgctctagaactagtggatcccccgggctgcaggaattcgtctcacccctagaaaaaaggtcagcctccctctccggattccccatcagcatgtccaccgactgcaacaagatcagctaagttatacgacgaccaagctaataagcctaccgaacgtacacgtacgtcccgcgcgctgcacgagtgatgaagccagggaagaaatgaaataaagctagctgtattgccaggagcagcatgcagtatcgatctatatatatactgtactgtagtactctattatatatgtatgtgtggcctgcagtgcgagttgcttcgatccacctacttgttcagacagtttaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccacctttcgccggctggcgtaatagcgaagacgcccgctccgatcgcccttcccaacagttgcgcagcctgaatggcgaatggtacttgtaacgcgtaatactttgtcaaattcgcgttaaattgttgtaaatcagctcatttcttaacca

SEQ ID NO: 63016 - DNA, 560 bp, Zea mays
  misc_feature: Ceres CLONE 1530035
  misc_feature: SWISSPROT Homolog: EC 3.6.1.1 Inorganic diphosphatase
  misc_feature (36)..(36): n is a, c, t, g, unknown, or other
  misc_feature (45)..(45): n is a, c, t, g, unknown, or other
gcggtggcggccgctctagaactagtggatcccccngggctgcanggaattcgtctcacccctagaaaaagaactacaagatacctgatggaaagcctgccaacaaatttggtctcggcaacaagcccgcaagcaaggaatacgccctgaaggtcattcaagagaccaacgaatcatgggagaaattggtaaagagaaatattcccgctggagagctctcgttggcctgattttgcccatggaagccacacattcttttgaactgcttttcgtgagcatgtcgttttgtatgctgtgaccatgcttcttcgtttgcttcccaaccttttttacgaactgtttaacaaaatgatcttgtcggataataatgattcttggccaagttaccagaaccgccaagagtttccccagaaatgcacgctatttttcttttccaaaaaaaaaaaaaaaaaaaccgggcccccccaggggtcccccatttcccccctaataggggggccgtttttttcccccccctcccctggggccccttgttttttaaaacaccgctggggcggggg

SEQ ID NO: 63017 - DNA, 624 bp, Zea mays
  misc_feature: Ceres CLONE 1530038
  misc_feature (31)..(31): n is a, c, t, g, unknown, or other
  misc_feature (51)..(51): n is a, c, t, g, unknown, or other
  misc_feature (258)..(258): n is a, c, t, g, unknown, or other
  misc_feature (271)..(271): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
ggcggccgctctagaactagtggatcccccngggctgcaggaattcgtctncacccctagaaaacgcaggaggcagcgagcgcaataatgcgcacgcagaggagcacagcggcgtcactgctgcggcagtaatgaccgcctggtttcacttccaccacggcgtgcactagcgctacaccgaaggcacctttttctggttccttcaatacgcctactccggccctccgaatcggggcacacgtctgcccccctgctccnggaaatctttgcnaagcggcgccccctactggcccgggaaaaggggaaaaccccgttttcttttggcccggggtttaaaccggggaaaaccccttttcaccggggtttttttttttttgttccccccccccccccaaaaaaaaaaaannnnnnnccggggcccccccggaggaccccaaatttcccccccaaggaggaaggctttttacccccccccctccaggggccccccttttttaaaaaaccgcgggaaagtggaaaaaaaaaaccggggggttcaacccaaatataataaccccgtggaaaaaaaaaccccccctttttttccagggggggggaaaaaaaaaaaaaaaaaaaccccccccc

SEQ ID NO: 63018 - DNA, 585 bp, Zea mays
  misc_feature: Ceres CLONE 1530040
  misc_feature: Encodes the peptide sequence at SEQ ID NO. 63019
tggcggccgcctcttgaactagtgggattcccccgggctgcaggaattcgtctcacccctagaaaaatttggagcgccccaactcttttgctgttacatatccaagctgtcagatatctgtaataacatcttatctcgtttttcatgttggacaatgtagtagagttgtttgtccccagtgtattttggaacgaattttcacagaatctgcttaatgcttcggtggaccccagtctggttttgctattttaccttgtagatctgggccgctgtgcctagcctccgggcttttttgcctccaaggtcccataacccttgcccggggggttgaccccccaattaaccccccgggttttttttttaaaagaggtccttttggggaaatataagacccccttgagggtttttaaacaccgggcccccccacaaaaaaaaaaaaaaaaaagagagccccgcgggggcccccattccccccccttataaggggggttttttacccgccccccccccgcggcgcgttttttttttaacccccgggggggggaagaaaaaaccggggggtgccccccccaaaattattccccg

SEQ ID NO: 63019 - protein, 44 aa, Zea mays
  misc_feature: Ceres CLONE 1530040
MLDNVVELFVPSVFWNEFSQNLLNASVDPSLVLLFYLVDLGRCA

SEQ ID NO: 63020 - DNA, 567 bp, Zea mays
  misc_feature: Ceres CLONE 1530045
  misc_feature: Encodes the peptide sequence at SEQ ID NO. 63021
  misc_feature (183)..(183): n is a, c, t, g, unknown, or other
tggcggccggctctagaactagtggggatcccccggggctgcaggaattcgtctcacccctagaaaactcctcagtgttctcgactcgaccgccgccgtcccagttcgcttcgcgtcacccagagctcgtcggcctccgtccccgcgagaagcgagagcatggacacccaggtgaagcttgcntgtgtggtgaaggtgatgggcaggaccggcctcaggggccaggtgaccccaggtcagagtgaagttctgtgatgacagaaaccgcttctctggaggacgtcaaggggcctggtcgtaagggggaactcctcccccctggcccaaattttaaaagggaggccaggaggctcccctaaaccccggggggggcctggaaataattcggtaattttgcccccttttgccaaatttccgggggacctcccaaaacttgtttttgaattttccccaaaaaaaaaaaaaaagcgggcgccccggggggcccccattttccccatataggggggggtatataccccgcccccccgggggggggtttttttaacaaggggggtgggggggaaa

SEQ ID NO: 63021 - protein, 31 aa, Zea mays
  misc_feature: Ceres CLONE 1530045
MDTQVKLACVVKVMGRTGLRGQVTPGQSEVL

SEQ ID NO: 63022 - DNA, 681 bp, Zea mays
  misc_feature: Ceres CLONE 1530053
aagctggagctccccgcggtggcggccgctctagaactagtggatcccccgggctgcaggaattcgtctcacccctagaaaaaaagccccctctatctctctctttcttgttcttctgtcttcattcgtgcttagagggttggtttgtccctcttcgctttggtggttccgcaacttctgaaccctgattttgtgttgtcgctggttagacgacgacgacgacgacgacgacggcggcgtttctgtagatgcggagaggctctcgagagattgacagaagagagtgagcacacggcgcgacgaacgacatagcatgtatgccgtcctcgccgcgtgctcacttctctttctgtcagcctctttctctcggtggcttatctcccgtctagatccgttgttagtcttagtctcttagtctggtggggggccgggcaaaatccgtgtttgatttcaattcaattaaaggctgctttggtgtcctagttggtttcgattcaattagcctgatttgatgtccaggtttgatttcgattcaactgaaccggtttaatttgatgggggttgtagtacccttttttttttcctatcacaggagacagagcctgcatgccgcattgcctcatggcccgtggctttttttcctcctttacacactgccccccccttatcctcctagatctt

SEQ ID NO: 63023 - DNA, 656 bp, Zea mays
  misc_feature: Ceres CLONE 1530054
  misc_feature: Encodes the peptide sequence at SEQ ID NO. 63024
  misc_feature (534)..(534): n is a, c, t, g, unknown, or other
tccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaaggcgtgtgggtcaaggccggntcgcagaatctcagcgagggtgggctggactacctcggcaacccgaagctgatccaccgcagagcatcctcgccatcttgggcttgccagtcgtgctcatgggcgcactccaggggtaccgc

SEQ ID NO: 63024 - protein, 174 aa, Zea mays
  misc_feature: Ceres CLONE 1530054
  misc_feature (64)..(171): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEGVWVKAGSQNLSEGGLDYLGNPKLIHRRASSPSWACQSCSWAHSRGT

SEQ ID NO: 63025 - DNA, 667 bp, Zea mays
  misc_feature: Ceres CLONE 1530055
  misc_feature: Translation starting site: 171
  misc_feature (531)..(531): n is a, c, t, g, unknown, or other
  misc_feature (532)..(532): n is a, c, t, g, unknown, or other
  misc_feature (544)..(544): n is a, c, t, g, unknown, or other
ccccgcggtggcggccgctctagaactagtggatcccccgggctgcaggaattcgtctcacccctagaaaaactcgttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccccaagacaatggagaactacaggctgctttatgacaccaagggccgcttccgtcttcacccaatcagggatgaggatgccaagnntcagctctgcanggtgagggtctgttcagttgggccagaagggcatcccctacctgaacacctacgacggccgcaccatccgctaccccgaacccgctcattaggggcaacgacaccctcaagatcgattctgaa

SEQ ID NO: 63026 - DNA, 653 bp, Zea mays
  misc_feature: Ceres CLONE 1530058
  misc_feature (249)..(249): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (340)..(340): n is a, c, t, g, unknown, or other
  misc_feature (342)..(342): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (375)..(375): n is a, c, t, g, unknown, or other
ggcggccgctctagaactagtggatcccccgggctgcaggaattcgtctcacccctagaaaaatagtgatgtagttgtaggcttttgaactgcttcaagctggagtgatgttgctgtgtgcttttgtgactgatcatctctggagcttttgtgaatgatctagctagctatctataaatgatctagttgtgaatgatattataattgtgatgcttttgtgaatatataattgtggtgcttttgtgtttnaaaaaaaaaaaaaaaaaaaaaaaaaaaaaaaaaaaaaaaaaaaaaaaaaaaaaaaaataaaaaaaaaaaaaaaaannnnannnnnnnnaananccattcccccccnnnnccctttttaccccttantttcccatcccttggggttacaaccccccgtcttttaaaaacatatcgctggaaaacacgctgccttttcaacaaatagccccttcgcaaaaaccccccctaacaaagaggcccccacaagggagactgcccaccgttagcgcgcccccaatggggaaagaaacctgaaagggttacccatttgggaaattttcccatccattttgtttaaaacaaaaaaattttttttaaacatcaagccttaaaacccgaaaaaacccttttaataaaaaaaaacc

SEQ ID NO: 63027 - DNA, 560 bp, Zea mays
  misc_feature: Ceres CLONE 1530060
  misc_feature: Encodes the peptide sequence at SEQ ID NO. 63028
  misc_feature (104)..(104): n is a, c, t, g, unknown, or other
  misc_feature (111)..(111): n is a, c, t, g, unknown, or other
ccccgcggtggcggccgctcttaactagtggatcccccgggctgcaggaattcgtctcacccctagaaaaagtcttctcccctgcgacaaagacgacgcaagtnccctacntcctccaaaaccctcgccgactcagatccagcttcctcgcaccgccgtcgcatgccgtcactcaggccctactctgcgtcagcacctcgccttgtggcgaggcgtcgggcttggcgtcggtgtcgtctacgggagcattaagcgtctgatccctcaagggaccaaacctaaaaggagggaagtgcttgttccttccttaagggggaaaagggggggcgccacctttaaattcccccctttggaagggggtttttaaatttgggggggggccccccctttccttaaaggaaaaaaaaaaattttttttttaaattttgggagcccctctcggaaaaaaaccccggattttttttttttgggggggggaaaaaaaatctttttccccagggggccggagaaaccggggggggggggaaaaaacacgacctctccccccgaaaagaaaaaaa

SEQ ID NO: 63028 - protein, 29 aa, Zea mays
  misc_feature: Ceres CLONE 1530060
MPSLRPYSASAPRLVARRRAWRRCRLREH

SEQ ID NO: 63029 - DNA, 669 bp, Zea mays
  misc_feature: Ceres CLONE 1530061
  misc_feature: Encodes the peptide sequence at SEQ ID NO. 63030
ccccgcggtggcggccgctctagaactagtggatcccccgggctgcaggaattcgtctcacccctagaaaaaactggaggaaacgatgagcttcggtactgtgggcatggaggaggagagcggcgccgcggcggcggccgcagcggcggaggagatccggcggctgccggccgaggtgaactgggagatgctcgacaagtcgcggttcttcgtcctcggcgcggcgctcttctcgggcgtgtccgcagcgctgtacccggccgtggtggtgaagacgcacctgcaggtggcgccgccgccacaggcggccagggcgacggccgccgccatcctacggcgggacggcctgcgggggttctaccgcgggctcggcgcgtcgctgggcggcacggtgcccgcgcgcgcgctgtacatggcggcgctcgaggccaccaagagctccgtcgggtcggcccgcgtccggctgggcgtgtccgagcccgccgcgtcggccgccgcctccccgcgcgcgggcgtgtccgcggctgtcgcggcgcaggtggtgtggacccccgtggacgtcatcagccagcggctgatggtcagacccccgcgtgctgccgctaccgcgggggcgtggacgctttccgaagatcctcctcggggaggggtccggggctgtaccccggg

SEQ ID NO: 63030 - protein, 194 aa, Zea mays
  misc_feature: Ceres CLONE 1530061
  misc_feature (40)..(124): Pfam Name: Mito_carr Pfam Description: Mitochondrial carrier protein
MSFGTVGMEEESGAAAAAAAAEEIRRLPAEVNWEMLDKSRFFVLGAALFSGVSAALYPAVVVKTHLQVAPPPQAARATAAAILRRDGLRGFYRGLGASLGGTVPARALYMAALEATKSSVGSARVRLGVSEPAASAAASPRAGVSAAVAAQVVWTPVDVISQRLMVRPPRAAATAGAWTLSEDPPRGGVRGCTP

SEQ ID NO: 63031 - DNA, 638 bp, Zea mays
  misc_feature: Ceres CLONE 1530065
  misc_feature: Encodes the peptide sequence at SEQ ID NO. 63032
ccgcggtggcggccgctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgtgtgtcaaaaaaaaaaaaaaaaacgagacgctcgaggtacccaattcgccctatagtgagtcgtattacgcgcgctcactggccgtcgttttacaacgtcgtgactgggaaaaccctggcgttacccaac

SEQ ID NO: 63032 - protein, 63 aa, Zea mays; identical to SEQ ID NO: 28299
  misc_feature: Ceres CLONE 1530065

SEQ ID NO: 63033 - DNA, 475 bp, Zea mays
  misc_feature: Ceres CLONE 1530067
tcccccggggcggccgctcttaatagtggtcccccgggctgcagattcgtctcacccctagaaaaactgttccccacccatatcgtgaacccgccgccgactcagcagcaggagacgcgccaaggagagcccgcaggaggcgactatgagggccaagtggaagaagaagcgcatgaggaggctgaaaggaagcgccgaaagtgaggcagagatccaagtaggctgatggggattgtgggatgggtgggtgacgaccatgggtttgtggttacgattccttcgatgcgtgtggagttcaatggagaagatgcacatccctagttcgtcgtcaccgtttggcatggggtccaatagctcgtcctggaaaacctggccttcagtaagccatccatcgggggtttccagcctaattccccaaattttttgggcctaaaaaaaaaacaacccagccgtttttggaaaaaaccccccctct

SEQ ID NO: 63034 - DNA, 587 bp, Zea mays
  misc_feature: Ceres CLONE 1530073
  misc_feature: Encodes the peptide sequence at SEQ ID NO. 63035
  misc_feature (224)..(224): n is a, c, t, g, unknown, or other
  misc_feature (279)..(279): n is a, c, t, g, unknown, or other
  misc_feature (280)..(280): n is a, c, t, g, unknown, or other
  misc_feature (339)..(339): n is a, c, t, g, unknown, or other
tccccgcggtggcggccgctctagaactagtggatcccccgggctgcaggaattcgtctcacccctagaaaaactacgcattctcagctgctttcgggggactgttccctatgcttagcttccaagttcatgggtttccagatgccgccgcttacgcgcagcctgctgggttccactatggatacgggcatgggcatgggcatggggttccacccatggcgggncatatggggaacaagcacaaagccccatggcgtccaccgacaggcaccgtggggnncacacagcagcaggcagatatttatctgaaggcccctgctctcatgaatgaaatctaangctcgccagcctctcccgtttttaagcttgtttggcaacccctccccgcatgggttggaattttgaaattcggggaagggtcccccctggatttaaatgctttttggcatggcaatttaaccttggaatggcgatttggcctttaaaaatcccccaaaattttcccgggtggggaccaaaaaaaaaaaaaaaaaaaagacccccgggggggccccatttccccccctatggggggccttttatacccg

SEQ ID NO: 63035 - protein, 75 aa, Zea mays
  misc_feature: Ceres CLONE 1530073
  misc_feature (57)..(57): Xaa is any aa, unknown, or other
MLSFQVHGFPDAAAYAQPAGFHYGYGHGHGHGVPPMAGHMGNKHKAPWRPPTGTVGXTQQQADIYLKAPALMNEI

SEQ ID NO: 63036 - DNA, 636 bp, Zea mays
  misc_feature: Ceres CLONE 1530075
  misc_feature: SWISSPROT Homolog: EC 3.2.1.23 Beta-galactosidase
  misc_feature (636)..(636): n is a, c, t, g, unknown, or other
gcggtggcggccgctctatactagtgagtcccccgggctgcaggaattcgtctcacccctagaaaaacaaaagtctggcttaagggaaacattgattggttctggagctcaaattaatagggaagccccatcagcactcttgagaaattaaagctctacatgcagtgtgtacatttgctggtaatgtatatgtaagcaggactaataggattgttctgttctcacacacgcacacaaacacgccaccaaaaaagatggtccaaagttgtatgtatcgtttgctattcacctgttaattaatggctttgtaatcagaaatgattattgttcaaattgtttcttagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttn

SEQ ID NO: 63037 - DNA, 843 bp, Zea mays
  misc_feature: Ceres CLONE 1530082
cctctcgttctctccgcctctacctcccctcccctctaacctcccccccctcctcaatactggaactccccgcggtggcggccgctctagaactagtggatcccccgggctgcaggagttcgtctcacccctagaaaagaggcccgcagccgccgtctgagttccagttccaagtcctccgcgggcgcggagggaggaagaaatcggcaatcgccccaccccaagaccccatcccatcctcccccgccccaagaataggctagcggctggtcctcgaatctaggagcccccgacctgcgcgtccgtccgtcctccctaaatccggccacgcccgccggtgaggagcaggcgaagattgatccgccactcccgaatggcagattcatcggcctctgtcccggacccggacgaataataacttagttctactaagtttctcgggggtcgcccttcactttgcttcccccccccccgctgttgttgtttcctttggtccggcttcaatctggggtcccctcccgcccgctggtttcgtccgctcccccctttaccctccacctttctttccgctctggatttatttccctccgacttccccgttttacgtttccgacacatcccccagggccttaaatattttaccggggaattttttccttttccccgatgtcttccttgctttcttacgctggggaatttccacaatggaaagggctcccccacatttggctcctaagaataattaagtaacctccgcattgggatagccggcacgcccccaatgggttggacccaaacctaatcggtgaggttcccgcgagggatcaaccgcaaccccgccgg

SEQ ID NO: 63038 - DNA, 861 bp, Zea mays
  misc_feature: Ceres CLONE 1530087-R2
ccgattgggtacctcaagcgtctcgtttttttttttttttttaaacgagaaacgaagcgctttttgtaccctccatgcaatgtcacaaaagatccaggacacttcttaacaacacacacaacacaggtcgactgggctagccacctctctactctaaaaggtgaatcacgtcacaacacacaccatcgccgcgaggaagtgctaccgctaccatctcaacaccaggaggtccgtccgtcaacggaaagcacttttaggcaaaacgtaacccacaaaaatcgggcccccctaaatggggcaccggttcgtcttcgtagtacttactactagtagggttaacgggggggtggtggagtggacggtattaaaaaacctactacgacgactgcacgcgcatcctcttcacgtcgttctccggaacgttcgcgtcggccccgttgcctcgtgccgtgcctccccctgctttacggacgttctcgtcagggacaatggcgtatcgttctgacggcgacacccaaactttggctgcaaacggggctgccgtgaataactccagcttcttgcaggcagaaccgtctgagctcagggcatcaatcaacacaggcgtgttcctgtcaactatttcaccgttgccaagctgtccgcttggtccccctcccccaagaaaaaaaaatttttctttccccaaaagggcccaaagggggcctccattccccaaggcaacccgggggaaattttcctgaaccccctggaaaaaattaaacttgtccggggagaaacttgggggcccctccctttttttcccaaaactcccaaactttgttccaaaacttgtttttcccttccccccattcgagtaaa

SEQ ID NO: 63039 - DNA, 972 bp, Zea mays
  misc_feature: Ceres CLONE 1530087-R
actgcacatgtccaaaagatccaggacactgttagacatcacactcaacacatggtcgactggggtagccacctctctactgtaagaggtgaatcacgtcacaacatgacaccatcgccgcgaggcagtgctaccgctaccatctcatcaccaggaggtccgtccgtcgacggagagcacttttaggcagaacgtaacgcacaaaaatctggcgccgctagatggggcaccggttcgtcttcggagtacttactactagtagggttaacgggggggtggtggactggacgctaccataatacctactacgacgactgcgcgcggcatcctcttcacgtcgttttccggcacgttcgcatctgcagcagtttgcctctggccgtgcctccaccagctttacggaaggtctcgctcaaggaacaatggcgaaatcctccgtgaccgggtacaacaagaactttgggggggcgaaaagagggccagccgtgggattaactcccgtgcttccgggggggcaaaaaaaccgtctgggactactgcgggcattcagatacactcccacagggccttggcttccttgggtacttaataatgtttataaccccgtttgtggggagaatcttgttttacagccattatatggtccccctctcctaccccaagggataaaagagagccttttgtatcacgctgacgggcggaagaaatgcgcctgaggtatgctcgggccatacccatgcccgggaatgagaccagcgggtgggggtgataatcttctgtgcgagcccagcctgggagaaaaaatgagatctcagtgcacgaaagagtgaagattggggagacgcttcctatgtgagttgagcaaagaatgcgtgaattttgctcaaaaaatttgattcgctatactccccacctcggtgtaagaaataatgacatataacatggagtgagaagccatttgtttagctcgtc

SEQ ID NO: 63040 - DNA, 687 bp, Zea mays
  misc_feature: Ceres CLONE 1530091
  misc_feature: Encodes the peptide sequence at SEQ ID NO. 63041
ggatcccccgggctgcaggaattcgtctcacccctagaaaaaccctttccctttctggccgcattccctcgtcctccggcagccgtcgccagcttccgatggtccggaaggagacggccatgaggctgcccccgcagcaccagggcctggaggtcaagatccccagcttcttccgctgccccatctcgctggacgtcatgcgctcgcccgttagcctctgcaccggcgtcacctacgaccgcgcctccatccagcagtggctcgactccggcaacaaccacgtgcccggccaccatgctcccgctcccctccaccgacctcgtccccaacctcactctccgcagcctcatcgcccactgggcccacctccccccccctccctgttcccccaccgcccgccggcgacgccggaattcgcccgatccctctttcgggacggaactttcttttccccgcaaccttcttccgccagggggggttttcctccgggagtggaaacccctttccgggccccccccggagattgggagacctatatctttcctaacaaaaaaattcaaaaaaatttcataaaaaaacctcctttttggggcgcctcgggcccctcccccccaaaaaaccgctccggaaaaattttcttaggagaaaaaaccccaaaaaaaaccgcccttttaaaggcgtgtagag

SEQ ID NO: 63041 - protein, 196 aa, Zea mays
  misc_feature: Ceres CLONE 1530091
  misc_feature (20)..(82): Pfam Name: U-box Pfam Description: U-box domain
MVRKETAMRLPPQHQGLEVKIPSFFRCPISLDVMRSPVSLCTGVTYDRASIQQWLDSGNNHVPGHHAPAPLHRPRPQPHSPQPHRPLGPPPPPSLFPHRPPATPEFARSLFRDGTFFSPQPSSARGGFPPGVETPFRAPPGDWETYIFPNKKIQKNFIKKPPFWGASGPSPPKNRSGKIFLGEKTPKKTALLKACR

SEQ ID NO: 63042 - DNA, 795 bp, Zea mays
  misc_feature: Ceres CLONE 1530092
  misc_feature: Encodes the peptide sequence at SEQ ID NO. 63043
cgacctacgtcctctccccacccccccccctccatccttcctcccccccccaccctggtactccccgcggtggcggccgctctagactagtggatcccccgggctgcaggagttcgtctcacccctagaaaaaaacatttttttgtcgaatctgtcgtgagatcctccccgacgagatggcggggaagggagccaaggccacggccgccaagtcggcggacaaggacaaggggaagaaggccggcggccccgtctcgcgctcctcccgcgccgcacctcaggagaattcaactccgaagaaagatgtttatcaattgttcgctgacaaggttagggataacaaacagctggaatcaagatgggcaatcatgcaagacacccgtgtggagtattttcgtggaaaagatttcaatgccttcatcaagaattatccagaagtcagggaaattttggggccagaccaccatttagaagtggaagacattgtttaacactttgttgaccaagaaccttgcgatcaaggggtgaccgaacttatgaaaaactgtgaggtcttggcaagcaaaaagttatccatcttggccttgttcaccttggagatccataaatgaacaaagtggtttccctgaaaaatgattggggtttttatgccttggaaggtttccttaaaaaagcccggaccctttgtggccacaacagttttctcttcctttttgttttggccctcctttttttgcccctcgccaggtccctgctctttttttcccgggttttaccccctatacccagtgtgcg

SEQ ID NO: 63043 - protein, 104 aa, Zea mays
  misc_feature: Ceres CLONE 1530092
MAGKGAKATAAKSADKDKGKKAGGPVSRSSRAAPQENSTPKKDVYQLFADKVRDNKQLESRWAIMQDTRVEYFRGKDFNAFIKNYPEVREILGPDHHLEVEDIV

SEQ ID NO: 63044 - DNA, 659 bp, Zea mays
  misc_feature: Ceres CLONE 1530093
  misc_feature: Encodes the peptide sequence at SEQ ID NO. 63045
  misc_feature (431)..(431): n is a, c, t, g, unknown, or other
ctccccgcggtggcggccgctctattactagtggatcccccgggctgcaggaattcgtctcacccctagaaaaaaagatcgagcagcgagagacgggcaggggaggaaaaaaatctaaccctagcatccgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcccaccaggcggctgcggcggcggctacngctcccgcggcggtggcggatctggcggcggcggtcgcagctaccgtggtagctggggcggcgggcggagatccggcggcgggggccgtcctggcgcgtgctacaagtgcggcgagccccgccacatggccagggactgccctagcgccaacggcgggagctacggcgggagccggctacggggaaggccccccctacgggagtccttaaaacatgtcctccgccgtt

SEQ ID NO: 63045 - protein, 168 aa, Zea mays
  misc_feature: Ceres CLONE 1530093
  misc_feature (6)..(73): Pfam Name: CSD Pfam Description: 'Cold-shock' DNA-binding domain
  misc_feature (124)..(141): Pfam Name: zf-CCHC Pfam Description: Zinc knuckle
  misc_feature (93)..(93): Xaa is any aa, unknown, or other
MAAAARQRGTVKWFNDTKGFGFISPEDGSEDLFVHQSSIKSEGFRSLAEGEEVEFSVSEGDDGRTKAVDVTGPDGSFVRGGGGPPGGCGGGYXSRGGGGSGGGGRSYRGSWGGGRRSGGGGRPGACYKCGEPRHMARDCPSANGGSYGGSRLRGRPPLRESLKHVLRR

SEQ ID NO: 63046 - DNA, 898 bp, Zea mays
  misc_feature: Ceres CLONE 1530098
aaactatcgcttataaaataaacttccatcttcaccccattccttaaatgaaaacatacttgaaactcaccactatggtcgccgctcttcaactaatggatcccccgggctgcaggaattcgtctcacccctagaaaaaatcaacaaaactactgctccgtgcatactcctctcccaaaatttccttgttttttgtttaaaagaaaatccggctcgtccatcttcagtaccgtacgtctgaggcagttctgcatccggaggaacaaatgaaagcgggtgatccatggcttccggcgaccgcgtgaacaaggaccttaatcccctctccaagattggacctcgagcccggccacctcatactaacccacccacctctctgtcctccgcgtacagcgaaggtaataaaatacatggttgccgatagtaagaaaggatccccaacaacccaatatacgatgtgcgtgggaagatatacccattctattctcccccaccccgctcaagagaacctatttacttatcccatcgcattcttcctcccacattcctataaaagcgcccttcccccatagacccaaattaatagaaacccatcccctctttaggcgagttaagtacacaacccgcgtactatatactccctccccccccccaccaaattctaattaactgaattccaattaccaattataccgcgcccctctaacctccagacccgggctcgaattactaccctcatactccgccctaataacaaatatattcaccatttcttcaatatatcgtaccccatcataatattcccagacacccatgactttttaccctcccccaacccccacccccttttttttccctacacccctaatatctaatcccactcttcccgaccaccccg

SEQ ID NO: 63047 - DNA, 642 bp, Zea mays
  misc_feature: Ceres CLONE 1530100
  misc_feature: Encodes the peptide sequence at SEQ ID NO. 63048
tccccgcggtggcggccgctctagaactagtggatcccccgggctgcaggaattcgtctcacccctagaaaaaattccatctcatcgcaacgttacgcaagcatcctccacctcctgccttgcctgcctgcctgcgtcgtagtttgcacaccgcaaccgtgttcttctctctctctctctctctccctctcgtccctgagaaagcgccgccgctctacgttcccctcgcttgcgctcggtccggcaaaggcccgtccttccatggccatcgcctcccgtgcaacgaagcgcgcgctgtccaccttcgccgccgccaagctcccggaggaggcggtcgcggccgcggccgccggcgaggcgatcgccgcccgctcccaccaggcggtgccgctgccaccggcgcccgcgtcgtccgtgaggccgctgcagttcgaggacaccggccgcctgttcgcgggggagccgacgtcggcgctgctgcgcacgctcgccgcgctgcaggcgctgtccgtgggcccgctcgtggacgccgccaccgcgggcgctgcggtcttcccgcggtggccggcagcgcgctggggcgcggatgcggccagtgccacggtataccgccacttcggttcgggggagacggccgaacag

SEQ ID NO: 63048 - protein, 127 aa, Zea mays
  misc_feature: Ceres CLONE 1530100
MAIASRATKRALSTFAAAKLPEEAVAAAAAGEAIAARSHQAVPLPPAPASSVRPLQFEDTGRLFAGEPTSALLRTLAALQALSVGPLVDAATAGAAVFPRWPAARWGADAASATVYRHFGSGETAEQ

SEQ ID NO: 63049 - DNA, 758 bp, Zea mays
  misc_feature: Ceres CLONE 1530101
  misc_feature: Encodes the peptide sequence at SEQ ID NO. 63050
  misc_feature (346)..(346): n is a, c, t, g, unknown, or other
  misc_feature (358)..(358): n is a, c, t, g, unknown, or other
ccccgcggtggcggccgctctagaactagtggatcccccgggctgcaggaattcgtctcacccctagaaaaaactcccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgcacgccgcctgccgctcgccccgctcgccgcctccgattccgccttcgagtcctccgtcggagttaactacgcggagcccgacgactcggagaaggataaggaggtgggagtgttcngatccggtgacnaccagggggcgggtgaagtgggtggatgaccattccctaacccccccctcccctttccaaggacaagttggaagaaggaggtccgggaatacgttaagccgccccaggaagcccaagggctacgttcgaaaaaccggccctaaaaaggtcaaaagggaaaggccctcgttcagattttttcaaccaggccggggtttttttaaagggccccgagggtcctttttccccccgaaaaacacaaacccaaaacccggggggtttggggttttttcaccctaaaaaaaccccttctccaagaaagcctaaaaaaagggttgtggaagaaagtcccccccaccccttgaattgccaaaggggaggaggttttttcacgtggaaaaaaaaaacaccccccctcaag

SEQ ID NO: 63050 - protein, 97 aa, Zea mays
  misc_feature: Ceres CLONE 1530101
  misc_feature (85)..(85): Xaa is any aa, unknown, or other
  misc_feature (89)..(89): Xaa is any aa, unknown, or other
MASSVAVSLRALAAAPLPKSSPATSCPFFVLLAPALPRRLLRLRSARRLPLAPLAASDSAFESSVGVNYAEPDDSEKDKEVGVFXSGDXQGAGEVGG

SEQ ID NO: 63051 - DNA, 674 bp, Zea mays
  misc_feature: Ceres CLONE 1530103
  misc_feature: Encodes the peptide sequence at SEQ ID NO. 63052
  misc_feature (533)..(533): n is a, c, t, g, unknown, or other
  misc_feature (534)..(534): n is a, c, t, g, unknown, or other
ccccgcggtggcggccgctctagttctagtggatcccccgggctgcaggaattcgtctcacccctagaaaaaatccccgactgtagtttgcccggcaagcaaacatctccggcagccatggcgtccactgtaacagccgccaatagcagccatggaagcgccctgcgtacccgtaccgcctccccaaggccggtcgcgggctggagctgcagacgcacgctttccacgcctgcacaccaccaccacgcgcggtcgtcacccagagctcgggttgtcgccgtccgagccgccggaacccagcgggcgacctggttgcccggactggacccgcccccatacctcgacggcacactcccaggtgacttcggcttcgaccccctgggcctcggagaggagcccgaagccttgaagtggtacgttcaggccgagctcgtgcactgccggttcgccatggcaggggtcgccggcatccttttcactgacttgctccgcgtatcaggaatcagggacctccccgtgttggttccgagcanngcgcgcgaaaatcgacttcgcgaaacacacggcgctctttcttcgccagcttcttcttgatgggggttcgctgaaaacaaaaaggtacatgggaccttccaaaattccgggatcccaagccaaagaaagggaatttcctt

SEQ ID NO: 63052 - protein, 158 aa, Zea mays
  misc_feature: Ceres CLONE 1530103
  misc_feature (70)..(152): Pfam Name: Chloroa_b-bind Pfam Description: Chlorophyll A-B binding protein
  misc_feature (139)..(139): Xaa is any aa, unknown, or other
MASTVTAANSSHGSALRTRTASPRPVAGWSCRRTLSTPAHHHHARSSPRARVVAVRAAGTQRATWLPGLDPPPYLDGTLPGDFGFDPLGLGEEPEALKWYVQAELVHCRFAMAGVAGILFTDLLRVSGIRDLPVLVPSXARENRLRETHGALSSPASS

SEQ ID NO: 63053 - DNA, 755 bp, Zea mays
  misc_feature: Ceres CLONE 1530107
  misc_feature: Encodes the peptide sequence at SEQ ID NO. 63054
gcagtggcggccgctcttcaactagtggatcccccgggctgcaggtattcgtctcacccctagaaaaaaccccgcgccccctccgagatcggaatcgcggcgccccgccgccctcctccgccatggcgccgtctctgctcgggggcttcaccaagtcgctggccatgacggtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcgcgtaaatggactcatcatgtgaccactctattgttctttgtatttggatttgggcctttgtggggaaggctttccaggaaagaagggagattccatagaaatttggctggaggttgaagcccgacctgggattatggtcttttaaagagttaattaaagggcgaatttttaaaaactaaaaacttaagggcaaaactattgatttccgaaagaaaccccgcaaaaaaccctttttctccatggcaattttttttctcccccatttttttactaaagggggctttttcttaataaacctttccttggggggaaggggggggggaaaaggagcccagaaattcgccccctattggggcttgggcgtggttaaaaaaaacccccatttgggggggtccgccccgggggggaaacaataaccgcgagcccccc

SEQ ID NO: 63054 - protein, 106 aa, Zea mays
  misc_feature: Ceres CLONE 1530107
  misc_feature (9)..(84): Pfam Name: UPF0016 Pfam Description: Uncharacterized protein family UPF0016
MAPSLLGGFTKSLAMTVLSEVGDKTFFAAAILAMRHPRKLVLAGCLTALIVMTALSASLGWVAPNLISRKWTHHVTTLLFFVFGFGPLWGRLSRKEGRFHRNLAGG

SEQ ID NO: 63055 - DNA, 658 bp, Zea mays
  misc_feature: Ceres CLONE 1530111
  misc_feature: Encodes the peptide sequence at SEQ ID NO. 63056
tacccgcggtggcggccgctctagtactagtggatcccccgggctgcaggaattcgtctcacccctagaaaaaaccttcctccccaactcgccgtctgccttctgcgcctccatttcggcctctgtccctcgcaagttcaatctcacctccaaccatgggtaaagagaagtcccacatcaacattgtggttattggtcatgtcgactctggcaagtcgaccaccacaggacaccttatctacaagcttggaggcattgacaagcgtgtgatcgagaggttcgagaaggaggctgctgaaatgaacaagcggtccttcaagtacgcgtgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatga

SEQ ID NO: 63056 - protein, 167 aa, Zea mays; identical to SEQ ID NO: 16718
  misc_feature: Ceres CLONE 1530111
  misc_feature (5)..(167): Pfam Name: GTP_EFTU Pfam Description: Elongation factor Tu GTP binding domain
  misc_feature: SWISSPROT Homolog: EC 2.7.7.4 Sulfate adenylyltransferase

SEQ ID NO: 63057 - DNA, 882 bp, Zea mays
  misc_feature: Ceres CLONE 1530112
  misc_feature: Encodes the peptide sequence at SEQ ID NO. 63058
atctatccacacccccccaaccaacccacattaaccctcacctcaaaacaaaacccccccaactcaccgcggtggcggcagctcttaaacaagtggatcccccgggctgcaggtttacgtctcacccctagaaaaagtccgccccagtctaatccgattcaaaccgcccgtcccccgtgtccgtgacaagcaagccgagcccaacccaaagagccagctgctcggtgctccacgcgattgcgcataaggagactaatggcagcaacggcgatcacatctccacccgcatgccgtcgaccccctcgcccctccgcttctccaagttctttcaggctaacctgccgatcctggtcacttggtggggcgggcttcatcggtctagcaccttccacaccagcttcttggtagaaccgagaagacacgagggccattgtttggccgaataaacctttttcacgtggttcaaaaagaggtgtgcccaaccccaaccgataaatgggtccaccctcaaggattctgagcctcaccatccgaaaattgaaaggtccaccaggaaagcatactattacctctggtgatgaatagctggtaaaccaaaagactcccattcataactagtggcttggccccctcggatttaacccacaaaatccttatataacataagccaccacctcctctcgtgcttcgagaacctcttattcaaaacacacaaacgtgttttctttgtggcaccacccgctagaaattcgctttttggggcatcttctaatatatacactagttcgccgcacacctttagaaattctcgcatcggggccccgttaaaacttccccctacgcagtaatattatgtggccgaaggatacgcctccgccccgg

SEQ ID NO: 63058 - protein, 52 aa, Zea mays
  misc_feature: Ceres CLONE 1530112
MPSTPSPLRFSKFFQANLPILVTWWGGLHRSSTFHTSFLVEPRRHEGHCLAE

SEQ ID NO: 63059 - DNA, 633 bp, Zea mays
  misc_feature: Ceres CLONE 1530116
  misc_feature: Encodes the peptide sequence at SEQ ID NO. 63060
  misc_feature (416)..(416): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
gcggtggcggccgctctagtactagtggatcccccgggctgcaggaattcgtctcacccctagaaaaagccagcctctgcctctgccccccagactaccccctgcctgcaggctcctgcaactgcaatgtcggcgctcgggacgctctccggcggggccgccggtgtctccggcctcatccgcctccgccgtcgggtggcccccgcgctcgcggcgccgtcgcaccacgccgctgggacgttgaactgcgccgccttgcccgatgccgccccgctcgtctggggacgccagctccgcccgtagctcctcctccccgccacactgctcccgtcgacgtcgcacggcgccaggaggcacacgccactgcggacccgcccgcagtccgtcagggggaaagggccaaaaatttttttttnttgtttttctgaaaaaaaccccgccccgggaaggggggttttttttttatgggggggttctccccccccctatttaaaacctctccccaaaaaaaaattggnnnttttccccccccaaaaatttggggggggtagagagaacccacaaaaggggggggggtgttaaaaccccccccaccccgggggggggggggggtccccccacaaaaaggggggt

SEQ ID NO: 63060 - protein, 58 aa, Zea mays
  misc_feature: Ceres CLONE 1530116
MSALGTLSGGAAGVSGLIRLRRRVAPALAAPSHHAAGTLNCAALPDAAPLVWGRQLRP

SEQ ID NO: 63061 - DNA, 670 bp, Zea mays
  misc_feature: Ceres CLONE 1530118
  misc_feature: Encodes the peptide sequence at SEQ ID NO. 63062
tccccgcggtggcggccgctctataactagtggatcccccgggctgcaggaattcgtctcacccctagaaaaaaggcgtccaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaacttccacttcgttgagaactgggttaagatcggcttccctgccaagattaaggtgaagaaagaccacgcatcggtgccgttcgatgaccagtgctctattctagagaaggaggccgtgaacctgtccctggagaaccctcagacctacccctt

SEQ ID NO: 63062 - protein, 172 aa, Zea mays
  misc_feature: Ceres CLONE 1530118
  misc_feature (31)..(172): Pfam Name: Pro_CA Pfam Description: Carbonic anhydrase
  misc_feature: SWISSPROT Homolog: EC 4.2.1.1 Carbonate dehydratase
MDDPVERLKDGFHKFKTEVYDKKPELFEPLKAGQAPKYVVFACSDSRVCPSVTLGLQPGEAFTVRNIAAMVPAYDKTKYTGIGSAIEYAVCALKVEVLVVIGHSCCGGIRALLSLQDGAPDNFHFVENWVKIGFPAKIKVKKDHASVPFDDQCSILEKEAVNLSLENPQTYP

SEQ ID NO: 63063 - DNA, 665 bp, Zea mays
  misc_feature: Ceres CLONE 1530119
  misc_feature: Encodes the peptide sequence at SEQ ID NO. 63064
ctcaccgcggtggcggccgctctatatctagtggatcccccgggctgcaggaattcgtctcacccctagaaaaaaaggcccaatagagtccacgcgccctcatctcctccccaacccgttgtccactgcctccaggcaaaccggcagcgccgccgccggcgatgaccaccgcgcggctcgtctcaacatcccccgcccgcctaccctccacgtcggcttccccgattcccagaacctcgctgtgtgttgtcggtcgtgcccctgctttctccgctagggcgctcggcttctcgcttcgtctcaagccgtcgcctgccatggccgccgccggcccccctaccgcgcatggagactcaataggatcttctaggattggagaggttaagagggtgaccaaagagacaaatgtgcacgtgaagatcaaccttgatggcactggtgtcgccgagtgtagcacagggataccgttcttggatcacatgctcgatcagttggcatcacatggactctttgatgtctacgttaaagcaataggcgacacccatattgatgatcatcactcaaatgaggacattgctttggcaattggaacggcactacttgaagcacttggtgatcgaaagggaattaaccgatttggtcattttacagcaccgcttgatgag

SEQ ID NO: 63064 - protein, 116 aa, Zea mays
  misc_feature: Ceres CLONE 1530119
  misc_feature (47)..(116): Pfam Name: IGPD Pfam Description: Imidazoleglycerol-phosphate dehydratase
  misc_feature: SWISSPROT Homolog: EC 4.2.1.19 Imidazoleglycerol-phosphate dehydratase
MAAAGPPTAHGDSIGSSRIGEVKRVTKETNVHVKINLDGTGVAECSTGIPFLDHMLDQLASHGLFDVYVKAIGDTHIDDHHSNEDIALAIGTALLEALGDRKGINRFGHFTAPLDE

SEQ ID NO: 63065 - DNA, 678 bp, Zea mays
  misc_feature: Ceres CLONE 1530127
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (333)..(333): n is a, c, t, g, unknown, or other
  misc_feature (336)..(336): n is a, c, t, g, unknown, or other
  misc_feature (342)..(342): n is a, c, t, g, unknown, or other
  misc_feature (344)..(344): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
tccccgcggtggcggccgctctagaactagtggatcccccgggctgcaggaattcgtctcacccctagaaaaagaaatgacaaggtggaaaagagcgaggtgtgttattgttggttttagtacatcgtagtcttcttttactgttgttgtagatgtcttgctaatgttgtcgctgttgtgtagttgcaattcaagcccagggctgccagttttatttcctaatgtaatgtagcaagagcgagaccctgttagacgggtgcgctgaaattctgaacctctgtaatatctgatgttcttgtggataaaaaacttttnnnnnannnnnatnnntcnaanaaaaananatnnncaaattaaaggaaaaaaaaaaaaaaaaacgagacgctcgaggtacccaattcccccctatagtgagtcgaattacccccgcctcactggcccgtcgtttttacaccttcttgaattggaaaaaacccttgcgtttcccaaacttaattcgcctttgaagcacatccccctttttccccagattgggggtaaataagcaaaaaaggccccccaccaatatgcccttttcccaaaattttgccccacccctgaattgggcaaaagggaaaattttaaaacgtttaaaatttttttgtaaaaaattcccggttaaaaattttggtaaaaaaa

SEQ ID NO: 63066 - DNA, 646 bp, Zea mays
  misc_feature: Ceres CLONE 1530130
  misc_feature: Translation starting site: 201
  misc_feature: SWISSPROT Homolog: EC 3.2.1.23 Beta-galactosidase
  misc_feature (572)..(572): n is a, c, t, g, unknown, or other
  misc_feature (629)..(629): n is a, c, t, g, unknown, or other
cgcggtggcggccgctctagaactagtggatcccccgggctgcaggaattcgtctcacccctagaaaaacccctagaaaaagttagtatgtattgtgtgtataaagatctgcgagctttgtgtataacgcaaatgatgaaccttcgggcaactgcgtgtatggttgtatctgtctatctgacataatttgagcacactgtatgtatcgttctcatcgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggnttgagtgttgttccagtttggaacaagagtccactatttaaagaacgtggactccancgtcaaagggcgaaaaa

SEQ ID NO: 63067 - DNA, 643 bp, Zea mays
  misc_feature: Ceres CLONE 1530135
  misc_feature: Translation starting site: 167
  misc_feature: SWISSPROT Homolog: EC 3.2.1.23 Beta-galactosidase
  misc_feature (553)..(553): n is a, c, t, g, unknown, or other
  misc_feature (571)..(571): n is a, c, t, g, unknown, or other
ctggagctccccgcggtggcggccgctctagaactagtggatcccccgggctgcaggaattcgtctcacccctagaaaaactggaatgttgttgttggacgaatgaattcccttcgatcggttagctttaatctgtctcgttagtgtgtcgtgttcgtgtagtaccatgccacagctacgccatgccgtgtgctctgtcacgtgggggcccacttatgggtctcctgctgctgtcagaacgaataagagaagatggaattgtgatgaaacaataaaaatgcatggtttaaattgtcttgttggtgttgcttaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgccctttcccacagttgcgcagcctgaatggcgaatggaaattgtaagcgtnaatattttgtaaaaattncgcgttaatttttgttaaatcagctcatttttttaaccaataggcgaaatcggcaaatcccttataatcaaa

SEQ ID NO: 63068 - DNA, 641 bp, Zea mays
  misc_feature: Ceres CLONE 1530136
  misc_feature: Encodes the peptide sequence at SEQ ID NO. 63069
  misc_feature (261)..(261): n is a, c, t, g, unknown, or other
  misc_feature (554)..(554): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (597)..(597): n is a, c, t, g, unknown, or other
tccccgcggtggcggccgctctagaactagtggatcccccgggctgcaggaattcgtctcacccctagaaaaaacctctagcccgacaggtgaagccgccgccgctgcagtgtccatagccaccgcaggagactgagatggggggttttgtcaagacccacaagagcaatgcatacttcaagcgtttccaggtgaagttcaagagaaggcgcgctggcaagacagactacagggccccagataggctgattaaccaagacnaaaaaaaaaaaaaaaacgagacgctcgaggtaccccattcgccctatagtgagtcgtattacgcgcgcctccctggccgtcgtttttaacacgtcctgactgggaaaaaccttggcgttaccccactttaatccccttggaaacaattccccttttccccaggtggggttaaaaacaaaaaagccccccccccttaccccttttcacaaattttgccccccccctaaagggggaaggaaaaatttcaccccgcaaaaatttttttaaaaaaccgcccaaaatttttttttganaccccccccccctctttttttttttttttctccccccannnangggggcaaaatgggaaaaactccttttaaaaaaaaaaaaaaacg

SEQ ID NO: 63069 - protein, 70 aa, Zea mays
  misc_feature: Ceres CLONE 1530136
  misc_feature (42)..(42): Xaa is any aa, unknown, or other
MGGFVKTHKSNAYFKRFQVKFKRRRAGKTDYRAPDRLINQDXKKKKNETLEVPHSPYSESYYARLPGRRF

SEQ ID NO: 63070 - DNA, 686 bp, Zea mays
  misc_feature: Ceres CLONE 1530153
  misc_feature: SWISSPROT Homolog: EC 3.2.1.23 Beta-galactosidase
  misc_feature (638)..(638): n is a, c, t, g, unknown, or other
gctggagctcaccgcggtggcggccgctctagaactagtggatcccccgggctgcaggaattcgtctcacccctagaaaaattgtactggtttatcagtgtatgtaactcttgctgacacaggtctagaaacgaaaggcggttgtttgttcacagatcgagccttctcttcaccctctatatgttctgatggttttctgagtcgtctgcctgaagccttgctagcgttgttttccttctgagctgtgaaaacctttttttcccaattttttttctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagacccgagatagggttgagtgnttgttccagtttggaacaagagtccactattaaagaacgtggactcca

SEQ ID NO: 63071 - DNA, 676 bp, Zea mays
  misc_feature: Ceres CLONE 1530154
  misc_feature: Encodes the peptide sequence at SEQ ID NO. 63072
ctggagctccccgcggtggcggccgctctagaactagtggatcccccgggctgcaggaattcgtctcacccctagaaaaagagaccacactggcttgacccgacaacttttggattttcaacatgatacaatagatgaggtaggtgcagaacacggtccattcatggatttgaaagcgagattcatggacttcaaacagagaaactatgtggagaatttttcaaattaccaaaatcttgctgaacagcaaacaccaaagttcatggtgattgcttgtgctgactccagagtctgccctaccgctgttttgttattcatgatcaatcggtgagaactgaaccgccacttttcagcgttgtgcgtcgtcgcgacaccttttttttgcttttgcccaaattttacccccaccacgatttagcataggcatgccggttacccctccccccccggttgtatgatagttgtatgtaaatgtgatgataacatataaagatgtacatagtgtataatagacattctccatgtattgtttcgttttcatgatgtagcagtacgtacaggattttctttcaaaaaaaaaaaaaaaaacgagacgctcgaggtacccaattcgccctatagtgagtcgtattacgcgcgctcactggccgtcgttttacaacgtcgtgactgggaa

SEQ ID NO: 63072 - protein, 55 aa, Zea mays
  misc_feature: Ceres CLONE 1530154
  misc_feature: SWISSPROT Homolog: EC 4.2.1.1 Carbonate dehydratase
MDLKARFMDFKQRNYVENFSNYQNLAEQQTPKFMVIACADSRVCPTAVLLFMINR

SEQ ID NO: 63073 - DNA, 669 bp, Zea mays
  misc_feature: Ceres CLONE 1530157
  misc_feature: SWISSPROT Homolog: EC 3.2.1.23 Beta-galactosidase
ggagctcaccgcggtggcggccgctctagaatagtggatcccccgggctgcaggaattcgtctcacccctagaaaaactagaaaaacctaatccaggacgaactgacccaatgtatgttgtatgctcgagaaagaaaatagggtaactaaacaatatatttggcaaggtttgtccctcctttctctttgttgattctagtgtttgatgaaattttattcaacaatttctctagtgtgcatatatatttgcagtgctatcaagaaacaaatagaaggaaaaaaacaagaagcaagttgtttggccctgatcgcaggacctattggtgagctgatgtttccgtgagtaatgtaacgacagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaac

SEQ ID NO: 63074 - DNA, 701 bp, Zea mays
  misc_feature: Ceres CLONE 1530163
  misc_feature: SWISSPROT Homolog: EC 1.11.1.12 Phospholipid-hydroperoxide glutathione peroxidase
  misc_feature (391)..(391): n is a, c, t, g, unknown, or other
  misc_feature (392)..(392): n is a, c, t, g, unknown, or other
tggagctccccgcggtggcggccgctctagaactagtggatcccccgggctgcaggaattcgtctcacccctagaaaaactagcaaaggtggccttttcggcgacagcatcaagtggaacttttccaagttcttggttgacaaggagggacgtgttgtggatcgctatgctccaaccacttcacccctgagcattgagaaggatatcaagaagctgcttgggagctcttaatcagtatctgggtgcaaagctgtagaaaaacatgtatcaacaatgccctgagcgataaaatatatgataagttgtattaataaagtattgtcgtacttgagaggttgcagtatctgctctatttcccttgcatacactccgtacttgtattccctcgagnngggaaatttttttgggaccccgcgcaacctggccgagatttttaagagcatcgtgactggagaataccctgagcgtctaccctacttaatctgccttgcagccacatccccccctttctccaggctggccgtaataagcgaaagaggccccgcacccgattcgccctttcccaaacagtttgcgcaagcctggaatggcgaaatggaaatttgtaaagcgttaaatatttttgttaaaatttcgcgtttaaattttttgttaaaatccagcttcattttttttaacccaattagcgccgaaaatccgga

SEQ ID NO: 63075 - DNA, 712 bp, Zea mays
  misc_feature: Ceres CLONE 1530166
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
ctggagctccacccgcggtggcggcccgctctagaaactagtggatcccccggggctgcaggaattcgtctcaccccctagaaaaannnnnnnnnnnnnnnnnnnnnnnnnnnnnnnnncccttcagcaccctccaccgactggctcaggggtgaactaaaacctagaccacgcgcgacgacggcccgcctgatcgatcgaccaaccattccgccgtcgccgccggccggatcatcggtcgtcgtcatgatgatatctatcaatctacgcgtgatgatcgatggctacttgtctactgctatgtactactaaataaaatctctccccgtgtgtgtacacgtacgcttgcatgtgcatgttaacatgtacctacgacgtcgggcgatggtataatgtgtgacgtgtgaaacccacccaaaaaagaaagagaccggatccatccaagaaacggccatgtccttttgggctgttgggtttatccaatcccaactttttggtgtgtcacaaaatttttctttggggaaaaaaaaaaaaaaaaccggaaccccggggcccccatttccccctttaggggagttttttttccccccgccccccggcccggttttttaaaacccccgggatggggaaaaccccgggcgtttccccaatttatttccccttggaaaaatacctccctttttcccagagggggggaaaaaaacaaaaaccg

SEQ ID NO: 63076 - DNA, 627 bp, Zea mays
  misc_feature: Ceres CLONE 1530176
  misc_feature (134)..(134): n is a, c, t, g, unknown, or other
  misc_feature (152)..(152): n is a, c, t, g, unknown, or other
  misc_feature (161)..(161): n is a, c, t, g, unknown, or other
  misc_feature (212)..(212): n is a, c, t, g, unknown, or other
gcggtggcggccgctctagaactagtggatcccccgggctgcaggaattcgtctcacccctagaaaaaacggatcgaaaacgaattaccctcggtgccctccctctcggcggcggcgcaagtccccttcatctnccggcgcgcaaatggcangtggcaggnttgcacatgctaccctcagggccccagcgtggtgaaggagaatctcattgnactgaccctgggtctgatccctgaagtattgttgaagatgccccactgaaccagccaaggaaaactgattctttcacaaaatctttaaaaagggcaaaacaacttcttctccaaggaaaatttccccccgttccccccaaaagtttttttttcccttgttttttaaaacacctcctgaagggccacaaaaaagaaagcttgggaaaatttgttttaaaaaaaacaaacccttttaaaaccgaaaaaaaaaaaaaaaaggggccgcccgggggcccaaaattccccaaaaaaagaggaataacacgcccccctcggcgcggttttttaacaccctgggatggaaaaaacaccgggttcccaaaaataaaaaccttttggaaaaaaacccccttttcctcagggggggaaaaaaaaa

SEQ ID NO: 63077 - DNA, 640 bp, Zea mays
  misc_feature: Ceres CLONE 1530177
  misc_feature: Encodes the peptide sequence at SEQ ID NO. 63078
tccccgcggtggcggccgctctagaactagtggatcccccgggctgcaggaattcgtctcacccctagaaaaaaccaaaatgtaagaaaacgcagtacgcacgccccggcgctggccgctagtcaccccaaagctccgcctccgcacctcctctcactcgcccagccgcggctatggcggccaccacgtccacggcggcggcggcggcagtatccttctccctcccctcacccccgcactgccgcggggcccggcgccgccgcgcgccttccctcctccgtgccgcgtccaccgccgcgcccccctcccccgacctctccatccagctctcgccccgcgggtccctgcccgcgtctaccaacggcgccgccaccgcgcttggaccccccgtgtccgcctcctttgcccgtgaccgcgccgaggacctgcaagccgaggcccgcgcgatggcccgcgccgctggcgccacagtctacagtcccgagctcctcgccgcgcgctacggctcccgccccttcaaggtggcactccgagcagcggaagtgctgtccaagctggcgtcgatcggggtgaaagtcctactggacgagcggaaaggggagtcgtccctcgagaggaggcccgccatgggcagtggact

SEQ ID NO: 63078 - protein, 64 aa, Zea mays
  misc_feature: Ceres CLONE 1530177
MARAAGATVYSPELLAARYGSRPFKVALRAAEVLSKLASIGVKVLLDERKGESSLERRPAMGSG

SEQ ID NO: 63079 - DNA, 652 bp, Zea mays
  misc_feature: Ceres CLONE 1530182
  misc_feature: Encodes the peptide sequence at SEQ ID NO. 63080
  misc_feature (354)..(354): n is a, c, t, g, unknown, or other
  misc_feature (478)..(478): n is a, c, t, g, unknown, or other
  misc_feature (573)..(573): n is a, c, t, g, unknown, or other
ttccccgcggtggcggccgctctagaactagtggatcccccgggctgcaggaattcgtctcacccctagaaaaaacttccgagcgatttcctcgtcatttctctcatccgctgcgctccctctcccactcggcgaagaagggggaaaaaagctcgaaagcgggagccggcgagcgagatgggcgcagggagcagccgcgcggacgcgccgtcgcggcgccgggcgcgcctcagcctcggcgggtgcttcggggccggatcctcctcgtccgcgcacgacggcgggagcttcgccgcggccgggccctcctcctcgcgcgccatcgaggtacaatcacgacagtcagggcggacnagtgagtgccctgaattttcaggcttctctagctgctaaggatctccagggttcccagtgagtcaaatccagggctggcatcgtcttcaagcaccataagccatcatctcagattcaatcaccntcaattaccatgaaaacaaggaagatgggcctggggtctgaaaacgctgaaaacaagtggtcttcaaagctcatctaggaaacctgtcatgggtnaaggggaagtctcattaatgaagcttgttgatggtgacatatcaggagaaaggaatagtttctgtaggatcagaagctg

SEQ ID NO: 63080 - protein, 71 aa, Zea mays
  misc_feature: Ceres CLONE 1530182
MGAGSSRADAPSRRRARLSLGGCFGAGSSSSAHDGGSFAAAGPSSSRAIEVQSRQSGRTSECPEFSGFSSC

SEQ ID NO: 63081 - DNA, 654 bp, Zea mays
  misc_feature: Ceres CLONE 1530186
  misc_feature: SWISSPROT Homolog: EC 3.2.1.23 Beta-galactosidase
  misc_feature (286)..(286): n is a, c, t, g, unknown, or other
  misc_feature (293)..(293): n is a, c, t, g, unknown, or other
agctccccgcggtggcggccgctctagaactagtggatcccccgggctgcaggaattcgtctcacccctagaaaaaatacctttctcggccttttggctaagatcaagtgtagtatctgttcttatcagtttaatatctgatatgtggaccatgtgtccacttcgatattaaatttattttttgtgggggaggaatcacaacagtggcttgccactgggttcctcaagcgtcgtccggccgttgcactattggctggaccaggcgcaccccaaaaaaacaaaaaanaactttnaaaacaaaaaaagaacagaacaaacctaaaaacaaaaaaaaaaaaaagaaaaaaaaaaaaaaaaaatttctaaaaaaaaaaaaaaccgagccgctcgaggtccccaattccccctatagggagccttattacgcccgctcactggccgtctttttacaacttctggacgggaaaaacccgggggttccccaatttaatcgcttggaagcacatccccttttccccagtgggcttaatagcaaaaaggcccgcacgaatgccctttccaaacatttgcccaccctgaagggcaaatgaaatttgaaaccgttaatattttgtaaaaattcccggttaatttttgtaaaatcagcccattttt

SEQ ID NO: 63082 - DNA, 669 bp, Zea mays
  misc_feature: Ceres CLONE 1530190
  misc_feature: SWISSPROT Homolog: EC 3.2.1.23 Beta-galactosidase
  misc_feature (540)..(540): n is a, c, t, g, unknown, or other
tggagctccccgcggtggcggccgctctagactagtggatcccccgggctgcaggaattcgtctcacccctagaaaaaaaaggaaggtgaagagcatcaaaccggcggcggcggtcaaaaagtgacgtacagtacgtgtggagtgtaatggagcttccatgcatgcatgagtggatccatgccatgttatgaatctagtccttcctttcttgtatcttccatgtgacgccgcgtgtgcgtccccttcatgtgtgatcatgccagatgaatactccaaataagacgttgtgactgtgccaaacaaaaaaaaaaaaacgagacgctcgaggtacccaattcgccctatagtgagtcgtattacgcgcgctcactggccgtcgttttacaacgtcctgactgggaaaaccctggcgttacccaacttaatccccttgcagcacatccccctttcgccagctggcgtaatagcgaagaggcccgcaccgatcgcccttcccaacagttgcgcaccctgaatggcgaatggaaaatgtaaacgtnaatattttgttaaaattcgcgttaaatttttgttaaaatcagctccatttttttaccccataggcccgaatccggccaaaatccccttatgaaaccccactaatagacccgaaataggggtttgagtgg

SEQ ID NO: 63083 - DNA, 661 bp, Zea mays
  misc_feature: Ceres CLONE 1530193
  misc_feature: Encodes the peptide sequence at SEQ ID NO. 63084
  misc_feature (661)..(661): n is a, c, t, g, unknown, or other
ggcggccgctctaaactagtggatcccccgggctgcaggaattcgtctcacccctagaaaaactcaaagtttgtttccgtggtttggtcctggctttgcgtactacgtgatggattcagctgcctgtactgtactgcgtgcatgcatgtaaccatgaaaacaaaagggtggtattcctgcattgcacggctgcaacgtgtaattccgtctttaatcaatgttttttctgtgcttattaaatgaaaaggcaacctaagctggaatcctatatacttttgaaatacacaaaagaaaaaaaaaaaaaaaaacgagacgctcgaggtacccaattcgccctatagtgagtcgtattacgcgcgctcaatggccgtcgtttaacaacgtcgtgactggaaaaaccctggcgttacccaacttaatcgccttgcagcacatccccctttcgccagctggcgtaataccgaaaaggcccgcaccgatcgcccttcccaacatttgcgcagcctgaatggcgaatggaaattgtaagcgttaatattttgtaaaaattcccgttaaatttttgttaatccacctcattttttttaaccattaggccgaaaatccgcaaaatcccttataaatccaaagaataaaaccgaaaaaggggtgaagtgttgtn

SEQ ID NO: 63084 - protein, 33 aa, Zea mays
  misc_feature: Ceres CLONE 1530193
MHVTMKTKGWYSCIARLQRVIPSLINVFSVLIK

SEQ ID NO: 63085 - DNA, 644 bp, Zea mays
  misc_feature: Ceres CLONE 1530196
  misc_feature: Encodes the peptide sequence at SEQ ID NO. 63086
tggagctccccgcggtggcggccgctctagaactagtggatcccccgggctgcaggaattcgtctcacccctagaaaaaaggccactcgtacctgctgctctaactccgggtcaccattttttgatgagtagagggggctccccgtctcggccctcctgccggttgaggccagcagagtgatgagtgaacggagtcatgcttgtgagattaggctttgtcgttgtagcctccgtcgcagctttaactcttcagagagctaacagtggggccaggcacagcaaagactatgtccaagcaaggaaaaggaaggataaggctaacaattctgaacatggggagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaacaataggg

SEQ ID NO: 63086 - protein, 126 aa, Zea mays
  misc_feature: Ceres CLONE 1530196
  misc_feature: SWISSPROT Homolog: EC 3.2.1.23 Beta-galactosidase
MLVRLGFVVVASVAALTLQRANSGARHSKDYVQARKRKDKANNSEHGEKKKKKNETLEVPNSPYSESYYARSLAVVLQRRDWENPGVTQLNRLAAHPPFASWRNSEEARTDRPSQQLRSLNGEWKL

SEQ ID NO: 63087 - DNA, 667 bp, Zea mays
  misc_feature: Ceres CLONE 1530204
  misc_feature (297)..(297): n is a, c, t, g, unknown, or other
  misc_feature (308)..(308): n is a, c, t, g, unknown, or other
tccccgcggtggcggccgctctagaactagtggatcccccgggctgcaggaattcgtctcacccctagaaaaaaagaagtttatactatgctactcattccccacaacatatgaatcgatagacatcgtttccagaagttagtctcttgagcctgtttaaaaatgtttaagtggtagaccattatgttaggtgtaaatgtgtacataaaagttatcataaggagtaatggtagcagaagcatgcagttgtaagttaaaaaaaaaaaaaaaaacgagacgctcgaggtacccaattcngccctatagtngagtcgtatttacgccgccgctcactgggccggtcgttttacaccgtccgtgacttgggaaaacccctggccgtttacccaaacttgaatccgcctttggagcaaaatcccccctttttcacccacccgggcgtaaataaccgaaaaaaaggccccgccaccgatttccccccctttcccaaaaaaatttgcccccaaaccttgaaatggggcaaaaaggggaaaattttttaaaagggtttaaaaaatttttttgtttaaaaaaatttccccccggttaaaaaattttttttgggttgaaaaaacacacccccctcttttttttttaaacccccattgtgggcccaaatatttcggaa

SEQ ID NO: 63088 - DNA, 899 bp, Zea mays
  misc_feature: Ceres CLONE 1530211
tatttatttcaacccccttatccttaacataacagaattttttaaaagtcaccaaacctggagctccccgccgtggcggccgctctttcactagtggatcccccgggctgcaggaattcgtctcacccctcgaaaaaagaaaaaaccacctttacacgcaatctagcaatatctgagtggtgatacgattttctggactcggctgggctaacatcctgtgtagtaggcgctgatgaaaggactatggatctgctcaaattaagtgttgtatttgtatcctccatattggtgaagacttatttacagttataacggaaaaggacctggcagctgtgttgtatactctctactcagacttattagtctacctgacctcgtatattatgcggccgcttatcatataagcgaagccagtaagcggaatgttaaatttccgccagtcctcaaaccgaaaagcctcctgtatattttacccccccccaattttttttggttattgtctatcgttcccctatattttagacactccacccaactatttttccccccctaaatatctttttctcggtttcagggggtaattaacctttactcttatatatcacccgcctgactatattccctccatgtataataagccgcaaatttcgtataacattctttcaattgttttccaaccctttgcccctcttatttgtttctcgaccgttcttttctccccttcttctccccataatcgccaaatatatataatctcctcccctccactattgatttatcataaacggacttggtgaaattcgcccaccggcaaagacggcactcttatattgttttatttcctacacaactattctattactctgacttaaatatattcactcgtattgatgttttct

SEQ ID NO: 63089 - DNA, 678 bp, Zea mays
  misc_feature: Ceres CLONE 1530224
  misc_feature: Encodes the peptide sequence at SEQ ID NO. 63090
ggagctccccgcggtggcggccgctctagaactagtggatcccccgggctgcaggaattcgtctcacccctagaaaagaccattgtgccctgttgaactcatgtattaccttgtgaagtccgttgtgtctggtttctacctgaccgtttcgttatctgatgctgtttctttaatatctgatgctgcttcattaaccatacttctatatggtttgtggtgttgctgtttgtttaatctgtcagctgcttgacgtttcactgaaagaaagacgtttcagtgagcgcagaaaaagttggtgattcggtgagaaacgttacaaccttatcacatgctctgaatttcgccaaagtgggtagatgcttgtgattatataactacagatttgcgaggcaaagctggagttctgagtagggcatggtattttgtgttttgctgagaagttgtcatcactatgcggtaagttgcaattacttttagcttagcagataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaataacgaagaagccctcacccatcc

SEQ ID NO: 63090 - protein, 49 aa, Zea mays
  misc_feature: Ceres CLONE 1530224
MYYLVKSVVSGFYLTVSLSDAVSLISDAASLTILLYGLWCCCLFNLSAA

SEQ ID NO: 63091 - DNA, 637 bp, Zea mays
  misc_feature: Ceres CLONE 1530227
  misc_feature: Encodes the peptide sequence at SEQ ID NO. 63092
ctccccgcggtggcggccgctctagaactagtggatcccccgggctgcaagaattcgtctcacccctagaaaaaaaaaaggcaagacgcggtatccaattccccctctcgcgtacataaacgacggagaaaaggacacaacccagcccgccctaaaaccctcacaccatcatgtcgctctccacacacagccacccggccgccgccgccgccgggagcggaaaatccctttttccggctggcccggcggcgcagtccgtacatttccccaaggcacggccccctgtccccgccgccgtctccgccgcgactgcggctgttcacgcggaggatagggtttcgtcgctgactcaagtctccggcgtgctggggtcgcagtggggcgacgagggaaagggcaagctcgtcgacgtgctcgccccccgcttcgacatagtcgcgcgttgccaggggggagcgaacgctggacatactatctacaactcagaaagcaagaaatttgctctgcatcttgttccatctggtattctccatgaaaggacactagtgtgttgttggcaatggagcagtgatccatgttccagggttctttggagaaattgatggtcttgagtccaatggagtccgctgcgatggaa

SEQ ID NO: 63092 - protein, 143 aa, Zea mays
  misc_feature: Ceres CLONE 1530227
  misc_feature (62)..(143): Pfam Name: Adenylsucc_synt Pfam Description: Adenylosuccinate synthetase
  misc_feature: SWISSPROT Homolog: EC 6.3.4.4 Adenylosuccinate synthase
MSLSTHSHPAAAAAGSGKSLFPAGPAAQSVHFPKARPPVPAAVSAATAAVHAEDRVSSLTQVSGVLGSQWGDEGKGKLVDVLAPRFDIVARCQGGANAGHTIYNSESKKFALHLVPSGILHERTLVCCWQWSSDPCSRVLWRN

SEQ ID NO: 63093 - DNA, 707 bp, Zea mays
  misc_feature: Ceres CLONE 1530230
  misc_feature: Encodes the peptide sequence at SEQ ID NO. 63094
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (412)..(412): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (586)..(586): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (608)..(608): n is a, c, t, g, unknown, or other
  misc_feature (609)..(609): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (637)..(637): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (659)..(659): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (675)..(675): n is a, c, t, g, unknown, or other
ctggagctcaccgcggtggcggccgctctagaactagtggatcccccgggctgcaggaattcgtctcacccctagaaaaaatttccagatgtacatgatttatgtctcacacacacatggtggcttacacacacacacacgcgcccatcggccatcgatgcgtcctcagtctgggcagcgcgtcttcaacagaagcagaaattacaatataatgctgggaacagccctatatgtatacccattgaaatgccgctgcccaagttatttaaaaaaacaaacctctagtgtgtgttattagcccatagctgttctgggccgccgagggcgaaatcgaagtgtcgtcgttgtgtaaaaagacaaacacaaaacctacatgcttaatgactcgtatatattttaactnnnnnnnaanaaaaaaaaaaaaaaaaaaaaaaaaaaaaaaaaaaaaaaaaaaaaaaaaaaaaaaaaaannnnaaaaaaaaaaaaaaaaaaaannnnnannnnnnnnnnnnnnnnnnnnnnnnnnnnnnnnnnnnaaaaaaaannnnnnnaaaaaaaaaaannnnnnaaaaaaaaaaaaannnanaaaaaaaaannnnnnnnnnaannaaannnnnnnnaaaaaaaaaaaaaaaanaannnaaaaannntttnnnaanaaaaaaaaaannnnanaaaaaaaaaaagggaaaattgttttttttttt

SEQ ID NO: 63094 - protein, 31 aa, Zea mays
  misc_feature: Ceres CLONE 1530230
MVAYTHTHAPIGHRCVLSLGSASSTEAEITI

SEQ ID NO: 63095 - DNA, 653 bp, Zea mays
  misc_feature: Ceres CLONE 1530234
  misc_feature: SWISSPROT Homolog: EC 3.2.1.23 Beta-galactosidase
tggagctccccgcggtggcggccgctctagaactagtggatcccccgggctgcaggaattcgtctcacccctagaaaaactaattcgaactgtgaaactgcgaatggccattttactcgtcataccctgattaccaagggaaatacgcaaacaatgtagaccagcccataggccactgggagtgcgagaatgttcaccaacatcatgcgagctcagaatttgcaatacatatgtacccattgtaaaatgcatttagcacgagcaaattaccagctacactgattcttaagatccctaaaaaaaaaagaaaaagctgaaaaaaaaagaagcacaagccacaagaagcgcaggaaaaaaaagaaaaaaaccaaaaccctcaaggtacccaattccccctatagtgagtcgaattacccccgctcacgggccgtctttttacaacgcctggactggaaaaaccctggctttccccaacttaatcgccttgaagcacatccccctttcgccagctggcgaaaaaccaaaaaggcccgcaccgatcgcccttcccaacatttgcgcaccctgaatggcgaatggaaattgtaagcgttaatattttgttaaaattcgcgttaaattttggttaaatcagctcatttttttaacaatag

SEQ ID NO: 63096 - DNA, 702 bp, Zea mays
  misc_feature: Ceres CLONE 1530235
  misc_feature: Encodes the peptide sequence at SEQ ID NO. 63097
  misc_feature (373)..(373): n is a, c, t, g, unknown, or other
  misc_feature (446)..(446): n is a, c, t, g, unknown, or other
  misc_feature (447)..(447): n is a, c, t, g, unknown, or other
  misc_feature (476)..(476): n is a, c, t, g, unknown, or other
  misc_feature (477)..(477): n is a, c, t, g, unknown, or other
  misc_feature (663)..(663): n is a, c, t, g, unknown, or other
  misc_feature (668)..(668): n is a, c, t, g, unknown, or other
ggagctcaccgcggtggcggccgctctagactagtggatcccccgggctgcaggaattcgtctcacccctagaaaaacgttgcaggagtcgagttcggcaaaagagtcatcgcacataagatatgccaagtctgcggaggctctggtcttgtaacgaacaacgactattacgttcgatgccaaaagtgtggtggttttcttccgtggcagtcttggcgaagattcttcacggggtgaacgtggtctctgatcagtggtcttcagtactcgactagcgctgtagctaacgcctcgtttggattagcgctactacagtttagtgactaaagcttagtcacttttagcctactacagaacgaagctattgactaangtggagtgactaaacttaagtcttaagtcgccaaatgcgtgactaaaaagaactaaaggagattttttccccnnaaggaaatatttaccaattttgacaaaannccccgggcccccaggggtccaaattcccctaaaagagagtaatttacggcctcccgggcgccttttttccaccttgggaggggaaaaacccggggtttcccaattttttttttttggggaattccccctttcccgggggggaaaaaaaaagaaagaggccccaaattccttctaaaaaattggggnccccnggggggggggggaaaaattcccccctcttttttt

SEQ ID NO: 63097 - protein, 50 aa, Zea mays
  misc_feature: Ceres CLONE 1530235
MPSLRRLWSCNEQRLLRSMPKVWWFSSVAVLAKILHGVNVVSDQWSSVLD

SEQ ID NO: 63098 - DNA, 660 bp, Zea mays
  misc_feature: Ceres CLONE 1530236
  misc_feature: Encodes the peptide sequence at SEQ ID NO. 63099
  misc_feature (1)..(1): n is a, c, t, g, unknown, or other
  misc_feature (45)..(45): n is a, c, t, g, unknown, or other
  misc_feature (49)..(49): n is a, c, t, g, unknown, or other
  misc_feature (50)..(50): n is a, c, t, g, unknown, or other
nggtgagtgccgcccgcgatgctcttcctacctttttcaaaaagnggannccccgggctgcaggaattcgtctcacccctagaaaaactcggacgccatggaggaagctcgcgaccacaggctctcctccaccgccggccgccccttcctctctggcttctgcgccgcggcgctccgacgtaagcccctcggcgcccgcgcctccgccgccgccgccgccaccggcgagggccttgtgcggcagctcggcgtcctcgacctcgtgctgctcgggatcggtgcgtccatcggcgccggcatattcgtcgtcactggcaccgtcgcccgcgacgccggcccaggtgtcacgatcagttttgttcttgctggaactgcgtgcatgctgaatgctctgtgctatgctgaactggagtctcccccccctgctgtggttgggggagcatacttgtacacctacgcagcgttcaatgagatcaccgcccttcttggtcttcactctgttcatggtggattaccatatcggcgcagcaagcattggtcgcagcttagaaagctacttgtatccagttcctgggagctaatcccggtccttgaaggggcaaattcccagcctgggcaggccacgggggagaagtttcttgggggggggttgtaataaat

SEQ ID NO: 63099 - protein, 185 aa, Zea mays
  misc_feature: Ceres CLONE 1530236
MEEARDHRLSSTAGRPFLSGFCAAALRRKPLGARASAAAAATGEGLVRQLGVLDLVLLGIGASIGAGIFVVTGTVARDAGPGVTISFVLAGTACMLNALCYAELESPPPAVVGGAYLYTYAAFNEITALLGLHSVHGGLPYRRSKHWSQLRKLLVSSSWELIPVLEGANSQPGQATGEKFLGGGL

SEQ ID NO: 63100 - DNA, 647 bp, Zea mays
  misc_feature: Ceres CLONE 1530238
  misc_feature: Translation starting site: 100
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaaaaaaaaaataatctagcctccatggatgctcaaccttcgtcatgtaacaataatcagtgctactcttcattacataattttgatgctatatatataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatca

SEQ ID NO: 63101 - DNA, 661 bp, Zea mays
  misc_feature: Ceres CLONE 1530240
  misc_feature: Encodes the peptide sequence at SEQ ID NO. 63102
aaagctggagctccccgcggtgggcgggccgcccctagaaacagtggatcccccggggctggaggaattccgtctccccccttagaaaaaaaacccagccccagggcgcccgggggcttgatccggcccacgcgttctacccgtcccctccggcttcccccttcttccctaatcgccgtcgccgggggtgcaggcacagcggctgcttccgctcccgctcccgaagggggggaggcggcaggcaattgggcgcggcgggtgcggccgtcgcacctaggttgctggcgctggcggcggcctacctcctcctcatctccctcaagttccgccgcgtgctggacctggccgccaccgacctcgcggacgaccctgccgccgccgccgccttctcctctccgtcctccgccgaccacctgcccccgcccgggtccgcttccgccacctcctcctcctcctcgcccccgttcccggtccgccccttctggcaccgctacgaccgtgtgtccctccccgacctcgcgtcccgcaaccgctccgcgctcgaccgcatggccgacgacgcctgggcgctcggcctcaccgcctgggaggacgccgccgccttcgcgggggacccctgggcgctgctcgccgccgccacctcccgcgcctccgacgccgt

SEQ ID NO: 63102 - protein, 37 aa, Zea mays
  misc_feature: Ceres CLONE 1530240
MADDAWALGLTAWEDAAAFAGDPWALLAAATSRASDA

SEQ ID NO: 63103 - DNA, 702 bp, Zea mays
  misc_feature: Ceres CLONE 1530242
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
ggagctcaccgcggtggcggccgctctagaactagtggatcccccgggctgcaggaattcgtctcacccctagaaaaaaaattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggcgatgcaggcgagggacagtaatctttggagggggtgcaaagttgttcgagccccaatgttttagatgctctatgctgtcgaagctgtgctgtgccattattgtagctgatttcgtctccattcacttctttttccttgttagtaggctggtagtggtcgaattagtaccccattgctttgtgttgccgctagtccatgtggactggtattgttcccctggatttatttggcaagcgtgtccgtgctcgctctagcgttttatgagctttaagaaaaaagaaaaaaaacagacctcgagtaccattcgctaagagcgatacccctatggctctaccgtgactgtctactaccgcgnnnnnnnnnnnnnnnnnnnnnnnnnnnnnnnnnnnnnnnnnnnnnnnnnnnnnnnnnnnnnn

SEQ ID NO: 63104 - DNA, 637 bp, Zea mays
  misc_feature: Ceres CLONE 1530244
  misc_feature: Encodes the peptide sequence at SEQ ID NO. 63105
  misc_feature (263)..(263): n is a, c, t, g, unknown, or other
  misc_feature (464)..(464): n is a, c, t, g, unknown, or other
aaagctggagctccccgcggtggcggccgctctagaactagtggatcccccgggctgcaggaattcgtctcacccctagaaaaaacccatccattccacctccgttcaccccgtccatttgatttgcgttcactgcgttgcgtttccttggaggggattgttctctcctctcctttggattggaggtccctccttcttctcctctctctctcagaggaaggcctgagatccaggaagaagacagcaatgggggaaaggtgcangtgaacgtgttctgagccgcctcacagcgtcagggagcgcgatggcgaatcatctcttgcccaccccatgagcctgtgcgcgtcctccccagctgaaaaacctggaaaaggtatgctgcaaccccaccagatatatggccagtaccacaaatgcgatccttgaggctttacagcgagaaactcaaagaatggggctttttnagaatatccgagaggcactcatgaggcgatagtctcccccccttgggtttgcctttgcataccccctaagacttgggttctgggagtattttgagaggtcacatcccctgaaatctctcttttagagaatcaaagattcccgtgaacacgggcatttcaggaaaacagttttg

SEQ ID NO: 63105 - protein, 31 aa, Zea mays
  misc_feature: Ceres CLONE 1530244
MSLCASSPAEKPGKGMLQPHQIYGQYHKCDP

SEQ ID NO: 63106 - DNA, 625 bp, Zea mays
  misc_feature: Ceres CLONE 1530248
  misc_feature: Encodes the peptide sequence at SEQ ID NO. 63107
  misc_feature (504)..(504): n is a, c, t, g, unknown, or other
  misc_feature (509)..(509): n is a, c, t, g, unknown, or other
  misc_feature (532)..(532): n is a, c, t, g, unknown, or other
  misc_feature (533)..(533): n is a, c, t, g, unknown, or other
  misc_feature (538)..(538): n is a, c, t, g, unknown, or other
  misc_feature (539)..(539): n is a, c, t, g, unknown, or other
tccccgcggtggcggccgctctagaactagtggatcccccgggctgcaggaattcgtctcacccctagaaaaaaagcgaggcctcttcgttcacctctgtctcgctttcctttcccgttcaccccaagcccccaacctgcgagctgcgacaagttcgtctctctcgtggccacgactggacgccgcccccgcctccgtcccctcgcagattcccaggttaaatccgccagggggaaatctccatcaagtggctcgtgctaattatgcgatcttcatgggctgactcagttgcgaacgccgaggaatcggcgcccgcgactgctgctgctaatggctctgttgcaactcatagcacctcgcgccctacgcgcagctcctacgtgcctccacatcttcgtgggcgctcagctggtgctgctgttgaagctcaaacacgcttagtaccaccagcccaaggtggaccactgccattgggtgctgcacaaccctcctgtgaggggtccngctgntgtgggtcgccccctgcgcgggnnatgtnnatggttgtgatgctggtggcaccattggcgctcctcgccaggaccatggtggcggatgccggggccctggtgctttggactccccg

SEQ ID NO: 63107 - protein, 120 aa, Zea mays
  misc_feature: Ceres CLONE 1530248
  misc_feature (81)..(81): Xaa is any aa, unknown, or other
  misc_feature (82)..(82): Xaa is any aa, unknown, or other
  misc_feature (90)..(90): Xaa is any aa, unknown, or other
  misc_feature (92)..(92): Xaa is any aa, unknown, or other
MRSSWADSVANAEESAPATAAANGSVATHSTSRPTRSSYVPPHLRGRSAGAAVEAQTRLVPPAQGGPLPLGAAQPSCEGSXXCGSPPARXMXMVVMLVAPLALLARTMVADAGALVLWTP

SEQ ID NO: 63108 - DNA, 653 bp, Zea mays
  misc_feature: Ceres CLONE 1530252
  misc_feature: Encodes the peptide sequence at SEQ ID NO. 63109
  misc_feature (653)..(653): n is a, c, t, g, unknown, or other
tggagctccccgcggtggcggccgctctagaactagtggatcccccgggctgcaggaattcgtctcacccctagaaaaagcgaaaaaatctttttctcgcctctcatcgctcctcgccatttctctctcctcccctccgtctcacccgccgcccgccgcgaaaatctgcgcacggacgcgccggctgcccgcggagagtatcgggtgggagcgcgccccgtcgagtgttgattacaggtgctcttattggttatgggatcaatgtgcaatttttttctttccgtttgagagcctttctagtttcttgggcaggctcttgagctaccaagcatgtcagaatcaaatgtgaagtggattgatgggcttcacttcacatcattgtactggcctccaccccaggatgtggagcagaagcaggcacaaatcttggcctacgtcgagtactttggccagtttacagctgacagtgagcagttccctgaagatgtagctcagctcattcaaagttcctatccatcaaaagaaagtcgcttgatagatgaagtattggcaacttttgttcttcatcatccggagcatggtcatgcagttgtacatccaattctttcacgcatcatagatgggacactgtgctatgataggcatggtcctcn

SEQ ID NO: 63109 - protein, 107 aa, Zea mays
  misc_feature: Ceres CLONE 1530252
MSESNVKWIDGLHFTSLYWPPPQDVEQKQAQILAYVEYFGQFTADSEQFPEDVAQLIQSSYPSKESRLIDEVLATFVLHHPEHGHAVVHPILSRIIDGTLCYDRHGP

SEQ ID NO: 63110 - DNA, 782 bp, Zea mays
  misc_feature: Ceres CLONE 1530255
  misc_feature: Encodes the peptide sequence at SEQ ID NO. 63111
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
ccctttttctcccnnnttnnttatcgccccattcggggggtgccctccaccccgaggagctccccgcggtggcggccgctctttactagtggatcccccgggctgcaggaattcgtctcacccctagaaaaaaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccgggcccccgaatctagtccttcccttcctgaatcttccatgtgacccggcgtgtgccgtcccctcatgtgtgatgatgccaaatgaatactaccaataaaaactttgttgtgaactggtgtgcgaaaaaaaaaaaaaaaaaaaccaagacgcttcgagggtaccccaatttcccccctataagggagtgcgtaattaacccccccgcttcaccggggccgtcaattattaccaaccgtttccgacccgggggacaaccccttgggcgttggcccaaacaggacccccgcctgtggcgatacaaatcccgcccttttcggcca

SEQ ID NO: 63111 - protein, 63 aa, Zea mays; identical to SEQ ID NO: 28299
  misc_feature: Ceres CLONE 1530255

SEQ ID NO: 63112 - DNA, 635 bp, Zea mays
  misc_feature: Ceres CLONE 1530256
  misc_feature: Encodes the peptide sequence at SEQ ID NO. 63113
ggagctccccgcggtggcggccgctctagaactagtggatcccccgggctgcaggaattcgtctcacccctagaaaaacctcttgagtctcgcgcgggctgcagggcatccgggctccggcttccggcatccaccaggcgtccttagaatacggtgcagcgagcagcaagtcgccgagcagccgagccaccgccgagcacagggcgccgccgagcagccgagccgccgccgagcgccgagtcttctctgagtgacttcggtacagacgacaaactttctccacacataccgcgccactccgccactcaccgtgctgacggatggggtggtgctccccgtccacttcccggcagcttctctccacggcctcactcttcgccttcggcgcgggtctcctcaccttcggcatccacctctcctacgtccacatcgagccccagcgcgctcgcacgctcgctcgggaccaattcgtccgcgactacctccgcaagaagcacgacaagtagctcgccttctgcggtccccaggcgattgcttggtagtcggagacgatggccctggtcccatcgaggtccgacagcgaggccttgatcccagaggtggagatgaatgccggcgccgaccagaccgcaaca

SEQ ID NO: 63113 - protein, 61 aa, Zea mays
  misc_feature: Ceres CLONE 1530256
MGWCSPSTSRQLLSTASLFAFGAGLLTFGIHLSYVHIEPQRARTLARDQFVRDYLRKKHDK

SEQ ID NO: 63114 - DNA, 638 bp, Zea mays
  misc_feature: Ceres CLONE 1530258
  misc_feature: Encodes the peptide sequence at SEQ ID NO. 63115
agctccccgcggtggcggccgctctagaactagtggatcccccgggctgcaggaattcgtctcacccctagaaaaaaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatacacaaataagacgttgtgactgtgccatcgtcgcctcaaaaaaaaaaaaaaaacgagacgctcgaggtacccaattcgccctatagtgagtcgtattacgcgcgctcactggccgtcgttttacaacgtcgtgactgggaaaaccc

SEQ ID NO: 63115 - protein, 63 aa, Zea mays; identical to SEQ ID NO: 8705
  misc_feature: Ceres CLONE 1530258

SEQ ID NO: 63116 - DNA, 665 bp, Zea mays
  misc_feature: Ceres CLONE 1530260
  misc_feature: Encodes the peptide sequence at SEQ ID NO. 63117
  misc_feature (617)..(617): n is a, c, t, g, unknown, or other
ctccccgcggtggcggccgctctagaatagtggatcccccgggctgcaggaattcgtctcacccctagaaaaaatacaggatgggaaggggatttctgagaaccattcaggctgatgatcagtagcacatgataatttatctacatagacatgtgtccgcgcacctactagcaaaattgataccttacaaccacttaaggaaagatcacattctacatatatggactcaatcactcaattagagcatctgtttgaagagaatgtgataaagacaaataacaaagtggtcaatcctgtatctgatgctgaagggattgctgtatcagatgtgttggaatccttaacagaacaagattgggaaaaatgcaatatacatggggtatgcgccttcacaaataatggagccagcttccgctgaggaagatcataccacaatgatccagtcctattgcattgtccccttggggtgaaccaagttaatatcaaggtgaagctgttgattctgctctatggggcgtccaagatgaccctggtaatgacatgtggtcaatgccttctccaagaacctggtttccagccctcatcaagtcgttggagctgatggcaaagacgcttcntagcgtcgtatacgaggcaagagccgaccctacgagaatgctgctttt

SEQ ID NO: 63117 - protein, 65 aa, Zea mays
  misc_feature: Ceres CLONE 1530260
MDSITQLEHLFEENVIKTNNKVVNPVSDAEGIAVSDVLESLTEQDWEKCNIHGVCAFTNNGASFR

SEQ ID NO: 63118 - DNA, 637 bp, Zea mays
  misc_feature: Ceres CLONE 1530265
  misc_feature: Translation starting site: 385
ggagctccccgcggtggcggccgctctagaactagtggatcccccgggctgcaggaattcgtctcacccctagaaaaaccccaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatctccgcaagcagctggaggatggccgcacccttgcggattacaacatccagatagagagcaccctccacctggtgctccgtctcaagggtggcatgcagatctttgtgaagacactcactggcaagacaatcacccttgaggtggagtcctcggattacattgacaatgtcaaggccaagatccaggacaaggagggcttccacccgaccagcagcgcctcattcttcccgggaaacacctggaaaagggcccccccctggcggactaaaaatccaaaaggaaaaccccccccccccgggggcccccccccggggggggatggaaatttttggaaaaacttgacgg

SEQ ID NO: 63119 - DNA, 635 bp, Zea mays
  misc_feature: Ceres CLONE 1530267
  misc_feature: Encodes the peptide sequence at SEQ ID NO. 63120
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
ggagctccccgcggtggcggccgctctagaatagtggatcccccgggctgcaggaattcgtctcacccctagaaaaaagtccaccaccacacaagaagaggcccccagccagccagtccacagctctccactcgagaaacctccagtccagctccacccttcgtccactccagacttccagaggcaccacacacaccatggctcccagcaagcttgcggtggtcgtcgccttggtagcgtctctcctcctggtcaccaccagcaacaccaagcttggcctgttcgtgctcggccaggctgctccgggcacctacccaccacgggatcctccgccgcaccagatcgtcgaccccgccaaagactgcgggggcgcgtgcgacgtgcggtgcggcgcgcactcgcggaagaacatctgcacccgggcgtgcctcaagtgctgcggcgtctgccgctgcgtgccggcgggcacggccggcaaccagcagacgtgcggcaagtgctacaccgactggaccacgcacggcaacaagaccaagtgcccgtgactccttgtccttgacgaacactacgnnnnnnnnngggggggnnnnnnnnnccccccccccccccccggggggcccgggggcccccttttt

SEQ ID NO: 63120 - protein, 115 aa, Zea mays
  misc_feature: Ceres CLONE 1530267
  misc_feature (4)..(115): Pfam Name: GASA Pfam Description: Gibberellin regulated protein
MAPSKLAVVVALVASLLLVTTSNTKLGLFVLGQAAPGTYPPRDPPPHQIVDPAKDCGGACDVRCGAHSRKNICTRACLKCCGVCRCVPAGTAGNQQTCGKCYTDWTTHGNKTKCP

SEQ ID NO: 63121 - DNA, 629 bp, Zea mays
  misc_feature: Ceres CLONE 1530272
  misc_feature: SWISSPROT Homolog: EC 3.2.1.23 Beta-galactosidase
tccccgcggtggcggccgctctagaactagtggatcccccgggctgcaggaattcgtctcacccctagaaaaaagtatatgtgtgtcgtcaaaatcatgtttttatactactactatgtgtgcatgcacacttcatgtgtaatgctttacttgtaatttattgcgaataaacaaagagagtacgtcttcgccacttgttatcaataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggtttgaagtgttgttccagtttggaacaagagtccactattaaagaacgtggactccaacgtcaaagggcg

SEQ ID NO: 63122 - DNA, 616 bp, Zea mays
  misc_feature: Ceres CLONE 1530281
  misc_feature: Encodes the peptide sequence at SEQ ID NO. 63123
  misc_feature (264)..(264): n is a, c, t, g, unknown, or other
  misc_feature (284)..(284): n is a, c, t, g, unknown, or other
  misc_feature (308)..(308): n is a, c, t, g, unknown, or other
  misc_feature (323)..(323): n is a, c, t, g, unknown, or other
ggagctccccgcggtggcggccgctctagaactagtggatcccccgggctgcaggaattcgtctcacccctagaaaaaggcccacccccactctcttcttctccactcggccgggcactctccttgccccggcctcacaccatcacatgtccacaatgctgccgtcctccagatcgagatctgggccgaacgagtcccccgtcagcaggggcaggccgagcacgccatcctccaaccaccgcccctccacgccgtcctccaaancacgcccctcccacccgggncgcaccaggaagagcagcgtctgnacgccattcacgccngcgctcccgcaaaaacggggcggggcccctcaagtccgaagcctacttcgccgcgttcggccggcgcgcaaaatcccccgcctctcgttcgaccgctccccggaaatccggggaaaaccaaaccctttccttcaaaacgcccgggtggcccaaaatcgggcacaaactccccggaaaaaacccttcccccggaggggggagggccaaaatttggggggcccccggtttttttattccccccccccgaaggaaacccctttaaaaaaaagggagaaggggttctcaaaccgcgt

SEQ ID NO: 63123 - protein, 156 aa, Zea mays
  misc_feature: Ceres CLONE 1530281
  misc_feature (40)..(40): Xaa is any aa, unknown, or other
  misc_feature (54)..(54): Xaa is any aa, unknown, or other
MSTMLPSSRSRSGPNESPVSRGRPSTPSSNHRPSTPSSKXRPSHPGRTRKSSVXTPFTPALPQKRGGAPQVRSLLRRVRPARKIPRLSFDRSPEIRGKPNPFLQNARVAQNRAQTPRKKPFPRRGEGQNLGGPRFFYSPPPKETPLKKREKGFSNR

SEQ ID NO: 63124 - DNA, 647 bp, Zea mays
  misc_feature: Ceres CLONE 1530290
  misc_feature: Encodes the peptide sequence at SEQ ID NO. 63125
  misc_feature (493)..(493): n is a, c, t, g, unknown, or other
  misc_feature (578)..(578): n is a, c, t, g, unknown, or other
  misc_feature (579)..(579): n is a, c, t, g, unknown, or other
agctccccgcggtggcggccgctctagaacagtggatcccccgggctgcaggaattcgtctcacccctagaaaaactgcagccgccggccctcagcaagcaagcaagggacagacgcggcggggatgggcagcggggtccgggcgctgatgcgccggaagcaggtagactccgagcggacgcccgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctgtcatttctgatagccggaatagcagctgcgctttcagccttctgctatgcggagctgggctagccgttgcccttcagcaagaagcgcctatcattattcgtacatctgcgttggcaaaagagttgcaatgtttgattgggctggactttgatacttgaatacacngattgtggaatcagcccgttgccccgtggcatttctcctaatctagcccttatttttttggaagaccaggatagtcctgccatgnnatttttacaccgaccatgagatcccatgggcttggatgtccgtttgtagatcccttgtagcttctttt

SEQ ID NO: 63125 - protein, 88 aa, Zea mays
  misc_feature: Ceres CLONE 1530290
MGSGVRALMRRKQVDSERTPAAGSAHQLRKELSVTQLVAIGVGSTIGAGVYVLVGTVAREHSGPALTLSFLIAGIAAALSAFCYAELG

SEQ ID NO: 63126 - DNA, 656 bp, Zea mays
  misc_feature: Ceres CLONE 1530292
  misc_feature: Translation starting site: 148
ggagctccccgcggtggcggccgctctagaactagtggatcccccgggctgcaggaattcgtctcacccctagaaaaaacaccctagtctcagagcagccggatccacaacctgcctctctcgtcccctggtggcgtccgcggcaggatggcggaatctacggcaaggacggtgaaagatgtcaacccttcctactccgtcaaggcctactcgacccacctcaagcgctcctgcaaaatagagctccctgagtgggttgacattgtgaagactgcgaggttcgaggagcttcctccttatgatcctgactggtgctacatcagggctgcatccattgcccggaagatcttacctaaggcaaggcatcattgtaggtggctttccgacgatctacagtggccgccataggaatggctcccgcccaccacacttctgctagagcagtggagctgttgcacgcaacatcctgcagcagctgcagattatgggcatcatccatgtcgatccccagggtggacccctcttcgccaaccaggggaaggcgtgatctggaaccctctgggttggaaggttcccttgtttaagcgtcgagaattgctcttcttttggtttgcatgggtgtttaggaatgaacgggatcagaaaagcatcccctg

SEQ ID NO: 63127 - DNA, 566 bp, Zea mays
  misc_feature: Ceres CLONE 1530294
tgggctccccgcggtggcggccgctctagaactagtggatcccccgggctgcaggaattcgtctcacccctagaaaaagtcgagaggtagaatgcgtagtggatctcttgagcggtttcctttaaatcaaaaggtcatttcgagaccacttgggccatacagaacaattctataactgcctctagatgatgggattatatgtatattatatactctgttattattgtttgaagaaagcggcatgaaatttgtgtccaccccagcctttggtttgttttcttattctttagaagctctgaactgtgtaacgtggacgaccgagaaccctcgtctattcttctcataatatataagaatgcacacatgaaaaaaaaaaaaaaaaaaacaagctaccagcccacatgctttttctttcccctccggtccccgtctgtctccctctcgtcgcatcggggaccggtttccccagtcccccccccctagaaaaaaaaaaaaaaaacggaggcccctggagggcccccattccccccctaagggaagccaattaacccccgcctccctggccc

SEQ ID NO: 63128 - DNA, 665 bp, Zea mays
  misc_feature: Ceres CLONE 1530303
  misc_feature: Encodes the peptide sequence at SEQ ID NO. 63129
ctccccgcggtggcggccgctctagaactagtggatcccccgggctgcaggaattcgtctcacccctagaaaaaactcgctcatcactgggtgggccgttgtggtggctgcctggctgtggctggtgcgagaaataaagtagccagtatcaggcgcaagttgcgattctcgggagttcggtgaggagtcacagaaaaagtttggaggtgaggcagaggtttccttccagggttcggcaagaacgaggcgactctcaatctgaagcctttcgtctgttccgtctagctgccccccctcggattctgccatggagcgggaggccagcatccagctgggcgcgctggagaagcatgaggagcttccgggggatggagaagcagaagagcttccgcgggatcatgtccctcgagcggcggagcaaggacagcccggggaaacgcggagacacaccgctccacctcgaggcgatggtctggagcgtggcccactcgcatacgatcctcacggtactcgatcgggcgctggcacccgatatggccgccaagcagaaccaggacagctagactccgctgtagctctacgcccataacggccacgccagatgtcgtgcacgaaatcctcaaagggctgatgccgtgcattacggcaggaatcaagccagcaag

SEQ ID NO: 63129 - protein, 70 aa, Zea mays
  misc_feature: Ceres CLONE 1530303
MRSFRGMEKQKSFRGIMSLERRSKDSPGKRGDTPLHLEAMVWSVAHSHTILTVLDRALAPDMAAKQNQDS

SEQ ID NO: 63130 - DNA, 646 bp, Zea mays
  misc_feature: Ceres CLONE 1530304
  misc_feature: Encodes the peptide sequence at SEQ ID NO. 63131
tctgaactagtggatcccccgggctgcaggaattcgtctcacccctagaaaaatagtctccttccccagatccaaatcacgcagaagctgtcgtccctgcacatggcggttctcggttgcctttggtgcaatctatgctcaggtagagaagaaggcgtcgaggcggatctccaggagttccaggactttgacgagttctaggcgtgggttagcggcaacccctagtcggttgcctgtgaaggccgcgtttatctacgtttcgttttcgcactttgattattgtaaagactatatggatgtcttagacatatgatgtaatcgactattattcccctttttaatactatttgagcactgtgtgacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccacagttgcgcagcctgaatggcgaatggaaattgtaagcgttaatattttgttaaaattcgcgttaaatttttgtaaatcagct

SEQ ID NO: 63131 - protein, 32 aa, Zea mays
  misc_feature: Ceres CLONE 1530304
MAVLGCLWCNLCSGREEGVEADLQEFQDFDEF

SEQ ID NO: 63132 - DNA, 651 bp, Zea mays
  misc_feature: Ceres CLONE 1530309
  misc_feature: SWISSPROT Homolog: EC 3.2.1.23 Beta-galactosidase
  misc_feature (36)..(36): n is a, c, t, g, unknown, or other
gtgacgcgggctcgcagccgtcagcgaggttcaatngaactagtggatcccccgggctgcaggaattcgtctcacccctagaaaaatcgcgtgtcaaagtactcgtggtctatttcatcttacccttatttattcatctacttttcattcagggatgaattcagtttccatattgcattttgttgcaatgaaaaagtaacatgtgcatctgattggttcaaattagctttgtggtcgatgtcgtttgtaaagctacatgatcgcttaaggttacatttcgctgtttgttcagtgttttatatacacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagccttgaatggcgaatggaaattgtaagcgcttatattttgttaaaaattcgcgctaaaatttttgttaaatcagcttcatttttttaaccaaaaaggcccaaaatcgggcaaaatccccttataaaatcaaaa

SEQ ID NO: 63133 - DNA, 684 bp, Zea mays
  misc_feature: Ceres CLONE 1530323
  misc_feature: Encodes the peptide sequence at SEQ ID NO. 63134
  misc_feature (250)..(250): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (261)..(261): n is a, c, t, g, unknown, or other
  misc_feature (262)..(262): n is a, c, t, g, unknown, or other
  misc_feature (346)..(346): n is a, c, t, g, unknown, or other
  misc_feature (348)..(348): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
ctccccgcggtggcggccgctctagaactagtggatcccccgggctgcaggaattcgtctcacccctagaaaaaaaggtgctgtactctcagaggtatgatttgtctgtagagcttccttgcgtgacgtgaggggtgatggatgggtggatctgattttagcatactacactacactcagtgttttgatatatgtaaatatagttgcacggttggtgaccaaatgaattccgcaaatcaacaagaggttnccnnnnnnnannaaaaaaaaaaaaaaaaaaaaaaaaaaaaaaaaaaaaaaaaaaaaataaaaaaaaaaaataaaagaaaaaaaaaaaaaaataaananannnnnannnnnacccctttcccccctttttttggactattagggggctgaaataacccccccctgaagaccttggaaaggcaaaatccccccaaaaaacactcttaatgcccttccaacaaggccccctttataaacccggttatcagaaaaaaaccccggctacaaaacccctttcccatttggagctcccccctttttggcaaggggatttaaaaacaaaaataccctccccaattccccttttcaaatatttgccaaaaccttttagtgctctaaaaaaattttgccaaaaaactcttttttcaattcacgggtataattttttttcaaaca

SEQ ID NO: 63134 - protein, 76 aa, Zea mays
  misc_feature: Ceres CLONE 1530323
MPFQQGPLYKPGYQKKTPATKPLSHLELPPFWQGDLKTKIPSPIPLFKYLPKPFSALKKFCQKTLFSIHGYNFFSN

SEQ ID NO: 63135 - DNA, 667 bp, Zea mays
  misc_feature: Ceres CLONE 1530327
  misc_feature: Translation starting site: 175
  misc_feature (572)..(572): n is a, c, t, g, unknown, or other
agctccccgcggtggcggccgctctagaactagtggatcccccgggctgcaggaattcgtctcacccctagaaaaaacaccactgtactcgcctgtagctcgccggagatccatgcctttgtgagctcgagtggagagaaaaaaaaaaggagcagcgaagagcgaacgaccgagatgctggagaagctgtgggacgacgtggtggccgggcctcgcccggagacgggcctcgagaagctccgcaaggccaccaccgcccgcccgctcgtcgtcgtcgacaaagaaataactacatgcatcttctcatctgctggatcgagtacatagaacacttgtgcaacacattcggcgagaacccacgggtcatctttatatcctactttctttaagtctaccagtgtgagtccgtagttatccactatcacccccacgggatgttgtacccattgacacttaaataagggtattttcatgcttaggccataatcaagttctcatgttttctctatgaatccaaaatattctgtccctgtaggtcaaaagcatcgatacgaacaccgctattttgtgcnaaaaaaaaaaaaaaaacgagacgctcgaggtacccaattcgccctatagtgagtcgtattacgcgcgctcactggccgtcgttttacaacgtcgg

SEQ ID NO: 63136 - DNA, 668 bp, Zea mays
  misc_feature: Ceres CLONE 1530330
  misc_feature: SWISSPROT Homolog: EC 3.2.1.23 Beta-galactosidase
  misc_feature (47)..(47): n is a, c, t, g, unknown, or other
  misc_feature (188)..(188): n is a, c, t, g, unknown, or other
  misc_feature (576)..(576): n is a, c, t, g, unknown, or other
  misc_feature (642)..(642): n is a, c, t, g, unknown, or other
  misc_feature (668)..(668): n is a, c, t, g, unknown, or other
tggagctcaccgcggtggcggccgctctagaactagtggatcccccngggctgcaggaattcgtctcacccctagaaagtatcgaggtagatacatcagatggtgtaagggagtaccagttgttagttcatggcttcaagcttagcctcccttcaatttgttcgatgatgtattacttcacaataaancattattatttagatgtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgtttaaatttttgttaaatcagctcattttttttaaccaataggccgaaattcggcaaaatcccttataaatcaaaagatagaccgagattaggggttttgaagtggtnttgtcccagttttgggaaccaaagagtccacctaatttaaaaaacgtgggacacccacgtcaaggncgaaaaacgtctaatcagggcgatgn

SEQ ID NO: 63137 - DNA, 618 bp, Zea mays
  misc_feature: Ceres CLONE 1530334
  misc_feature: Encodes the peptide sequence at SEQ ID NO. 63138
ggctgcaggaattcgtctcacccctagaaaaaaaaaacaaggagcgctacatccaggtcagcagtttccatttgctatccgaccccatcttcatcccgttgtcgcagcagcggccatccaaacagcgatggacggtggctagaacagccggaacccgcacaaggcctccgcggactaccgcagcgaccgcaagtcagcctccgggatgagcggcgaccccaagaagggcggccgcggcggcaagttcacctgggagggcgccgacgactacggctacggctacgccgacgaggacctcggactcatctcctataaaggcaacatcaacagcggacgcgctagccaggtccagggaggcgccgccgctaataaggacgacgacgagtaggccatcgccgcctcggctcgcccgcccggtcccgtctatcgccagcaagatccaacaagcccttctgtctgtttaattccagtatcagttcgattctcatgttgaataatcatgatcatgtgggtttcgggaaaagatgaagaaaccgagacgctcgaagtacccatttcgccctatagtgagtcgtattaagccgcgcatactgggccgtcgttttacaacttcgtgac

SEQ ID NO: 63138 - protein, 60 aa, Zea mays
  misc_feature: Ceres CLONE 1530334
MSGDPKKGGRGGKFTWEGADDYGYGYADEDLGLISYKGNINSGRASQVQGGAAANKDDDE

SEQ ID NO: 63139 - DNA, 653 bp, Zea mays
  misc_feature: Ceres CLONE 1530335
  misc_feature: Encodes the peptide sequence at SEQ ID NO. 63140
  misc_feature (562)..(562): n is a, c, t, g, unknown, or other
  misc_feature (565)..(565): n is a, c, t, g, unknown, or other
tggagctccccgcggtggcggccgctctagaactagtggatcccccgggctgcaggaattcgtctcacccctagaaaaaattccatctcatcgcaacgttacgcaagcatcctccacctcctgccttgcctgcctgcctgcgtcgtagtttgcacaccgcaaccgtgttcttctctctctctctctctctccctctcgtccctgagaaagcgccgccgctctacgttcccctcgcttgcgctcggtccggcaaaggcccgtccttccatggccatcgcctcccgtgcaacgaagcgcgcgctgtccaccttcgccgccgccaagctcccggaggaggcggtcgcggccgcggccgccggcgaggcgatcgccgcccgctcccaccaggcggtgccgctgccaccggcgcccgcgtcgtccgtgaggccgctgcagttcgaggacaccggccgcctgttcgcgggggagccgacgtcggcgctgctgcgcacgctcgccgcgctgcaggcgctgtccgtgggcccgctcgtggacccccacggggggggctttcggggttccnggnggtggccctgcagcgcgctgggccgcgccgcggccagggccacggcgtaccgccacttctgcgcgggcgagaccgccgacgaggccgc

SEQ ID NO: 63140 - protein, 128 aa, Zea mays
  misc_feature: Ceres CLONE 1530335
  misc_feature (99)..(99): Xaa is any aa, unknown, or other
  misc_feature (100)..(100): Xaa is any aa, unknown, or other
MAIASRATKRALSTFAAAKLPEEAVAAAAAGEAIAARSHQAVPLPPAPASSVRPLQFEDTGRLFAGEPTSALLRTLAALQALSVGPLVDPHGGGFRGSXXWPCSALGRAAARATAYRHFCAGETADEA

SEQ ID NO: 63141 - DNA, 639 bp, Zea mays
  misc_feature: Ceres CLONE 1530360
  misc_feature: Encodes the peptide sequence at SEQ ID NO. 63142
ggagctccccgcggtggcggccgctctagaactagtggatcccccgggctgcaggaattcgtctcacccctagaaaaaacatttactgagatcgtgtcgggctactgttcctgcattactccaagctccagcggtggtttcattttgtactgctatatcagctttgcgaaactgtggattttatttcaccgtttcgaagattattctctcaataggtaattgaacttgtttcaaatacgttttgccaaatctttgtgcagtcgccgaatggtatctagtgtcactattctttgtctaacactcttacaaacaaagagtattggtcggaagacaattctcgatcttctcattctatagtgagtcgaattacgcgcgttcactggccgtcgttttacaacgtcgtgactggaaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgtcaatattttgttaaaattcgcgttaaatttttgtaaatcagctcatttttttaaccaataggccgaaatcggccaaatcccttaaaaatca

SEQ ID NO: 63142 - protein, 72 aa, Zea mays
  misc_feature: Ceres CLONE 1530360
GAPRGGGRSRTSGSPGLQEFVSPLEKTFTEIVSGYCSCITPSSSGGFILYCYISFAKLWILFHRFEDYSLNR

SEQ ID NO: 63143 - DNA, 617 bp, Zea mays
  misc_feature: Ceres CLONE 1530362
  misc_feature: Encodes the peptide sequence at SEQ ID NO. 63144
ctccccgcggtggcggccgctctagaactagtggatcccccgggctgcaggaattcgtctcacccctagaaaaaacccaccgcatcgccagtcgccacgcgacagcgacgccccgcatccccgcggacgccgacggctgggcctaccgcctgcgcctctgggggcggcgggtccagacgccacgcgcactctagaagagttgttgtgcggcgccgggcgcggcggccgttggatcccgtgccgtgccgccgccttcgccccgcccgtcctcggcgcgtcagcgaccccctcactgtggctgcgtgcctgcgtcggccagcccgcttgctttgcccctcgcttcgcttcaaatggtagagccgctgcaggctgagcgaccgcgagcttgacccgggcgcaagtcggcttgcacccagccatgtcggcgcctggattcgatgacccccagcttccgccgctgcggctccgcgcctcttgcggcggcgcgatcgccagcccacgctcctgctcctcctctgatactttcgtcagcatgccttccacaccctcaggtatgctgaatcccgggcggtctatggtcacccacacctcgcgcaccgtcggaagcgtcctcctcg

SEQ ID NO: 63144 - protein, 66 aa, Zea mays
  misc_feature: Ceres CLONE 1530362
MSAPGFDDPQLPPLRLRASCGGAIASPRSCSSSDTFVSMPSTPSGMLNPGRSMVTHTSRTVGSVLL

SEQ ID NO: 63145 - DNA, 633 bp, Zea mays
  misc_feature: Ceres CLONE 1530372
  misc_feature (475)..(475): n is a, c, t, g, unknown, or other
  misc_feature (511)..(511): n is a, c, t, g, unknown, or other
  misc_feature (520)..(520): n is a, c, t, g, unknown, or other
  misc_feature (530)..(530): n is a, c, t, g, unknown, or other
  misc_feature (579)..(579): n is a, c, t, g, unknown, or other
  misc_feature (594)..(594): n is a, c, t, g, unknown, or other
  misc_feature (601)..(601): n is a, c, t, g, unknown, or other
  misc_feature (615)..(615): n is a, c, t, g, unknown, or other
ctccccgcggtggcggccgctctagaatagtggatcccccgggctgcaggaattcgtctcacccctagaaaaaacccgcctcggcgcctcctccctctctcccaacatcgcccgctctctcctcgctgttctccgctgtcatctcccccggagaagcgtggctcctgtagccggcctcctacctgcccctcctccgcgcgccgagcaccagacgacgcgacacggccgagcacggtcgctgcttccgcggcggcgccgctccactctcgtgctgcagctagcggaacagagatccgtggggacatgaacagggtttctcctctctgttggtatgaactaaattgatcgatggtcctattgaatatagagctactattatatggcatattctgtcatgcaaatgatggtggttgtaagttgtgattgaggaactccattgtttgagaaatggatgaaacaccaactagttctgggncatctgaagatagttcatgtgaaccctattggtggnccacagacnttatagaaangatagagtctgcttccatatcaggaaacatgatgttttgggtaatctanggtctcatcctgaanggatcancattactgtggtcnacaggatcttattcaggt

SEQ ID NO: 63146 - DNA, 631 bp, Zea mays
  misc_feature: Ceres CLONE 1530375
  misc_feature: Encodes the peptide sequence at SEQ ID NO. 63147
gcggtggcggccgctctagaactagtggatcccccgggctgcaggaattcgtctcacccctagaaaaactctccactgccagctccggtccgaagagggagggaggaccggaggaggacgcccgttgccactgctgcgccgctcccgcctccctctctccatccgccgaggtcgaaaagccaccatgatctccgcgcgcaccgccgcagcttcccccgcttccctgtggaagcagggaggacgaagcgagggccgcggcagctgcgacggatgtcggacttacaggaacactttgcggagggccgcagcagcgaaggtgcgtgccttgccgtcgagggcggtggaggcggtcaaaatgggctccgccgcggagatggagcaggaggaggcggaggtggccgcggccgcggccggcgtcgtcgtcgaggaccactacggcgaggacagcgccaccgaggagctgcccatcttgccctgggccttctccgtcgcaagcggttacaccctcgtgagggatccacatcacaacaagggtcttgctttcacggagaaagagagggatgcacaccacttgcgggggctgcttcctcctgcaggtgtgcctcaagaactccaaattaagaagatcatg

SEQ ID NO: 63147 - protein, 149 aa, Zea mays
  misc_feature: Ceres CLONE 1530375
  misc_feature: SWISSPROT Homolog: EC 1.1.1.40 Malate dehydrogenase (oxaloacetate-decarboxylating) (NADP(+))
MISARTAAASPASLWKQGGRSEGRGSCDGCRTYRNTLRRAAAAKVRALPSRAVEAVKMGSAAEMEQEEAEVAAAAAGVVVEDHYGEDSATEELPILPWAFSVASGYTLVRDPHHNKGLAFTEKERDAHHLRGLLPPAGVPQELQIKKIM

SEQ ID NO: 63148 - DNA, 626 bp, Zea mays
  misc_feature: Ceres CLONE 1530383
  misc_feature: Encodes the peptide sequence at SEQ ID NO. 63149
agctccccgcggtggcggccgctctagaactagtggatcccccgggctgcaggaattcgtctcacccctagaaaaaacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaacaaggttcatttcatccttaagcacaagaatcctaagactggaaagtatgttgagcatcacctcaaa

SEQ ID NO: 63149 - protein, 164 aa, Zea mays
  misc_feature: Ceres CLONE 1530383
  misc_feature (24)..(164): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGSTNKVHFILKHKNPKTGKYVEHHLK

SEQ ID NO: 63150 - DNA, 622 bp, Zea mays
  misc_feature: Ceres CLONE 1530393
  misc_feature: Encodes the peptide sequence at SEQ ID NO. 63151
ctccccgcggtggcggccgctctagaactagtggatcccccgggctgcaggaattcgtctcacccctagaaaaagcttcgctcttgtctcagctcagctcctgccagtcgcaactcgcgtcctctccaaaaacagcccacagctgaagcgagaacacgaatgctcagtgatatttctctcgaggtctgcacactcgtctcctaccgagaccgtcggcggccatcgtcgcacacgctgtgctcatgctaagtgtcgaggctcacacgtactactactacccgaccgcgaggccgagacggaagctatgcgcctgcagaaacgtcttgcaggaaaccgccccgcgtgacgcagaggcaaatccctgccgtcacggcgagaggaagagcaggagaaggggcgacggtgcttattacatcgacaaggacggcggcggcgtagccaggaccttcgaccggaagaaaatatccagaaagaggggtacggtaaatgactatgacagtgccagtgtgccacaccactcctttaattttagttcccactcaatgctgcagatcaatcccagttcttagatcttttttttttaaatcagaacataaaggtcgttccttttccagattcactc

SEQ ID NO: 63151 - protein, 108 aa, Zea mays
  misc_feature: Ceres CLONE 1530393
MLSVEAHTYYYYPTARPRRKLCACRNVLQETAPRDAEANPCRHGERKSRRRGDGAYYIDKDGGGVARTFDRKKISRKRGTVNDYDSASVPHHSFNFSSHSMLQINPSS

SEQ ID NO: 63152 - DNA, 695 bp, Zea mays
  misc_feature: Ceres CLONE 1530394
  misc_feature: Encodes the peptide sequence at SEQ ID NO. 63153
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (387)..(387): n is a, c, t, g, unknown, or other
  misc_feature (388)..(388): n is a, c, t, g, unknown, or other
  misc_feature (406)..(406): n is a, c, t, g, unknown, or other
  misc_feature (647)..(647): n is a, c, t, g, unknown, or other
  misc_feature (695)..(695): n is a, c, t, g, unknown, or other
gcggtggcggccgctctagaactagtggatcccccgggctgcaggaattcgtctcacccctagaaaaaaccggccaccgcgaatccagagccccacgccccgtccgaaccccagagcagagcaaagcctcctcgacctccctgtccccagccttgggggatggcccgcacgaagcagacggcgcgcaagtcgacgggcggcaaggcgccgcggaagcagctggcgacaaaggcggcgcgcaagtcggcgccggcgacgggcggcgtgaatattccgcaccggctggggccgggcaccgtcgcgcttctctatatccgcaagtaccagaagagcacggagcttcttttttctcccccccctcggggggacaagaagggggggnnnttnntccctctttcacttccancacccaccctccaattaaaatacatacaccacttccccccccttggggggggggccggccaaagccttaccattggggggcatctttcgagggagccaaacctccggtgcccatcccaagctaaggccgagctcgcctcgatggccgtagggtaattcgggggtcgggcgcgcacgtaccgctcgggcaaagtccgacccatgcgtggttcccaagggcaagaccctaggcccccaaccgnctgtcaaaattaccttatctgtcaaccccatccattgattcgtaatgn

SEQ ID NO: 63153 - protein, 133 aa, Zea mays
  misc_feature: Ceres CLONE 1530394
  misc_feature (75)..(75): Xaa is any aa, unknown, or other
  misc_feature (76)..(76): Xaa is any aa, unknown, or other
  misc_feature (77)..(77): Xaa is any aa, unknown, or other
  misc_feature (83)..(83): Xaa is any aa, unknown, or other
MARTKQTARKSTGGKAPRKQLATKAARKSAPATGGVNIPHRLGPGTVALLYIRKYQKSTELLFSPPPRGDKKGGXXXPLSLPXPTLQLKYIHHFPPLGGGAGQSLTIGGHLSREPNLRCPSQAKAELASMAVG

SEQ ID NO: 63154 - DNA, 639 bp, Zea mays
  misc_feature: Ceres CLONE 1530400
  misc_feature: Encodes the peptide sequence at SEQ ID NO. 63155
ctccccgcggtggcggccgctctagaactagtggatcccccgggctgcaggaattcgtctcacccctagaaaaaatgatctagcccgtccgaactccgaaggaaccacttcacactactctccgcggctctgccgtccgttctcctctcgccgccgccggccgcgcctccaccctcgcggcactcgcatggcggcgccggctctccgtatcactgcgcggctgggacttgcacttgacggtgccaccgccgcgagacggcgcgaggcctcggcgcctgtggcggtgccggccgcgccgtggctgaagaaagcggcggtccggtgccagcgagccgtcggtgccgctgttgccgagaagaaggatgcgccggtatcggttgcgcaggaaagaagcggcgacgagggcgcggcgccggagctcaccgtcgtgatgaagttcggcgggtcgtcagtggcctcggccgagcggatgcgggaggtggcagacctcatcctcagcttccccaagagcacccgggcgtcgtgctctcagcgatgggaaagacccccaacaaactcctcatggcttgggaaaaaagcattggcttgtggtgccaccaaacgctccgaacttgatgaacctctcctttgaaaaaaatt

SEQ ID NO: 63155 - protein, 147 aa, Zea mays
  misc_feature: Ceres CLONE 1530400
  misc_feature: SWISSPROT Homolog: EC 2.7.2.4 Aspartate kinase
MAAPALRITARLGLALDGATAARRREASAPVAVPAAPWLKKAAVRCQRAVGAAVAEKKDAPVSVAQERSGDEGAAPELTVVMKFGGSSVASAERMREVADLILSFPKSTRASCSQRWERPPTNSSWLGKKALACGATKRSELDEPLL

SEQ ID NO: 63156 - DNA, 1084 bp, Zea mays
  misc_feature: Ceres CLONE 1530403-R
  misc_feature (723)..(723): n is a, c, t, g, unknown, or other
aaaaagtggggtccgggccccccctcgaggtcgacggtatcgataagcttttttttttgtttttgtcttttttttttttgaaatttgaatatatgtataatatatgaataagctgctggagataataatcttaaagctaccgcgcgttacatatggggcaactattttttttctaaaataacctgctatttcttttattttcttttctcttccactcggaatatcgttttgaaaagcttttacctcgctgtcagcttgccggccagcatcaataggtttattggggcctaataggcccaaaaatttataaaacaacggcttttttattcctggttagccaatagaatatgttcttaatagaacgggaaaaaaatatggaaactgaggcttgacccctaaacgggggggccccccctttgtttgtggggaacccccccctattccaaataaatacgccgggagtggtttttccgatagggggccgtgacaaatttgacggggcgtccatccgatcttatcttgggtgtggcccgcttatggtattctccatctattcaggaggtactctttttcttgaaggggatgagcccacacacccctcattaggcagccgcgacttgattccgtggggagaaaatatataaacgtccctactttgtctgcgggtgtgacgctaactctctaacgcgtatatcgattttatcgggagactacgaatgttanatcttcctcccagaaagttttgtgttattcttctgtaggtggtgtgggaaaagacggggtgatgaagcacttttatcctcgccagacagcacctgcctggtctatttatttcgcggcgacggacttaattgccctcttctgtgtaggagccttttatgaagatatactcacgccggccgcggcatatatttggctcccccgacccgtctgttataaggtggaagttctagtgtcacggctgggatgtgctatcatctccccatagaatgcttcgatatccgtacatttacccctggcatttgaaattaagctatgcgggggttattctttgaggtatctatcatagatatggatcgaaagc

SEQ ID NO: 63157 - DNA, 602 bp, Zea mays
  misc_feature: Ceres CLONE 1530403
  misc_feature: Encodes the peptide sequence at SEQ ID NO. 63158
gcggtggcggccgctctagaactagtggatcccccgggctgcaggaattcgtctcacccctagaaaaaatccacacacacacaacacagcagagagattactacgatccaacagttctagagcaagagagaggaagacacaccgcagagttagcaggctaataacttgcaggagcagcaggaatggcggcgacgcgtcgcctctcttgctttctcctcgccgtgcttctggcaggagtggccgctgccaccgccttcgacgaagcggctgctgccggcttcgggcttggccacggcgcgcgtttcgcgcgcaagcatggacgtgctgccgctgagatgccccagccggagccacaacctaaaactaagccggagccccatatgcagccactgccccagccagaacctaaaccgaaacctatgccacatccagagccaaagcctgaacctcaaccaaagcccaaccctgaacctcaaccaatgcccaagcctcaaccaaaatccaaaaccacagccagaacctaagcccgagcccaaacaaagcctgaccctccacacatcccaccagcagctatcaactgaggaagtggctattaacaatta

SEQ ID NO: 63158 - protein, 113 aa, Zea mays
  misc_feature: Ceres CLONE 1530403
MAATRRLSCFLLAVLLAGVAAATAFDEAAAAGFGLGHGARFARKHGRAAAEMPQPEPQPKTKPEPHMQPLPQPEPKPKPMPHPEPKPEPQPKPNPEPQPMPKPQPKSKTTART

SEQ ID NO: 63159 - DNA, 687 bp, Zea mays
  misc_feature: Ceres CLONE 1530405
  misc_feature (309)..(309): n is a, c, t, g, unknown, or other
  misc_feature (389)..(389): n is a, c, t, g, unknown, or other
  misc_feature (391)..(391): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (400)..(400): n is a, c, t, g, unknown, or other
  misc_feature (411)..(411): n is a, c, t, g, unknown, or other
  misc_feature (484)..(484): n is a, c, t, g, unknown, or other
  misc_feature (522)..(522): n is a, c, t, g, unknown, or other
  misc_feature (627)..(627): n is a, c, t, g, unknown, or other
  misc_feature (643)..(643): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
ctccccgcggtggcggccgctctagaactagtggatcccccgggctgcaggaattcgtctcacccctagaaaaaaaatcctcctcctcctcctgccgcagcccgcagggaggtggagttgtcaacgtgccgaggactggagcgcccgcgtccggcgtctctataaacgagaccgcccggccatttggtctgctcctctctgttctcccctgcctgcccgcttccagctgcatctctctccgccgagaccgagaggaggaggaggcaagggaggcatccctgacccccggacgggggccatggggacgcnggcgccggataatatacccccccaaaaaggacgccagggagccgtttttttaccgccccccccgagggggggggggtggncnttnnncccnaaaaccccaantggtggtacctccccccttccaaaaagaccaccgccttgggggggggccggctttgttaaacctttccttaanaaatgttccagacttggggggggggcccttggaatccngggggttggggggtgcccccggggataccccgcttttaaagccgggtgggaaaaggtgtgaaaatccccaaaatgggccccccccaaacgtttcctcccctttcncccccaggggtggggncccgcgcccctccgcgacacccnnnggccccttcccaccctgcg

SEQ ID NO: 63160 - DNA, 657 bp, Zea mays
  misc_feature: Ceres CLONE 1530406
  misc_feature: Encodes the peptide sequence at SEQ ID NO. 63161
tggagctccccgcggtggcggccgctctagaactagtggatcccccgggctgcaggaattcgtctcacccctagaaaaaagcccacacttggcctggcctcgttctgctgaagctcgacccgttccccctaatcttctccaatccctttcttctgggctctgacagggtgacgaatcccatgggcgccgcggcgaggaagcccgccgccgctggggtgttgccaatctggctctgcctcgtctgcgcgtcgagagcgcagccgtacatcggcgtcaactacggcgaggtggcggacaacctgccgtcggcggacgagacggctaggctgctcaagtcgacgtccatctccagggtgcggctgtacagcgtggacgcgaggctgatcctctcactggcggagtccagcatctccgtggtggtgggcgtggcgaacggcgacatcccctcgctggccgcggtaccagcagctcgcgtcccggtggctggccgccaacgtgctggcccttcgtcccggagaacaccatcttccgccgtgaccgtcggcaacaaggtgcctggattccgggggacacccaccttgggggcccgccctgcctccgggccatgaaagaaccctccaagccccccccccgggggggggggggggcgggccccct

SEQ ID NO: 63161 - protein, 142 aa, Zea mays
  misc_feature: Ceres CLONE 1530406
  misc_feature: SWISSPROT Homolog: EC 3.2.1.39 Glucan endo-1,3-beta-D-glucosidase
MGAAARKPAAAGVLPIWLCLVCASRAQPYIGVNYGEVADNLPSADETARLLKSTSISRVRLYSVDARLILSLAESSISVVVGVANGDIPSLAAVPAARVPVAGRQRAGPSSRRTPSSAVTVGNKVPGFRGTPTLGARPASGP

SEQ ID NO: 63162 - DNA, 656 bp, Zea mays
  misc_feature: Ceres CLONE 1530410
tacctggagctccccgcggtggcggccgctctagaactagtggatcccccgggctgcaggaattcgtctcacccctagaaaaaaccgaggactcccttctttcctcccactcccatctgctctcctcgccgccacctgcgccgtcagagcacggagcagtccgcgaccacgctttcgctgccgctctccgacaggcgacggagccgcagctccagtcgcagtcggctcccctgaattcgggctcgccaaataccctccaatcgtctgcgtccgtcgtccgggacttccggtgcaactgaatccggcaccacctgtgccgcctgtcatggcacttggaagaggagggaggagggactcaagaggttaaggtaccgtatttatagatgtggctgaagaaactgggtgttgctattatgaagactaagacgagtaggagcttacagaagtctgggagaggtaaccatgtccaaagagaaagggccaaactgggttcttggtgctgggcggggttttgcttaccacgctttcaggcaaggttgggtgcaaaccaaagccagtggttaaaccggaagcccccaaaatattcctcccaaaacttaaggaaagggctgaaactgcaaacctgctttcaaatttcctccgggttcaggggacca

SEQ ID NO: 63163 - DNA, 663 bp, Zea mays
  misc_feature: Ceres CLONE 1530411
  misc_feature: Encodes the peptide sequence at SEQ ID NO. 63164
  misc_feature (296)..(296): n is a, c, t, g, unknown, or other
  misc_feature (663)..(663): n is a, c, t, g, unknown, or other
ctccccgcggtggcggccgctctagaactagtggatcccccgggctgcaggaattcgtctcacccctagaaaaaaagcttcatcgtcgagagggaaacagcccggatcaccagctaaggcccctaaatgaccgctcagtgataaaggaggtgcggggtgcaaagacagccaggaggtttgcctagaagcagccaccctttaaagagtgcgtaatagctcactgatcgagcgcccttgcgctgaagatgaacggtgctaagcgatctgccgaagctgtgggatgtcaaaatgcatcngtaggggagcgttcccccttagagggaagcttacgcgaaagcggggggcgacaaagcggaagcaagaatgtccggcttgagtaacgaaaacctttggtgaaaatccaatggccccgaaaacccaaaggttccctcccgcaaggttcctcccccggaaggggaattcagggcccaaaatcagggccaaagggggtattcctatggaacacagggcaattttcccggtccccccccccttttggggccggaagggacaaaaaaaacctttggttaccccaaaaaaaggctttaaggttttaaaggaaccccggggggcccccgctcttttttgggggaaaaaaaagggtgaaaaaataaaacccccccn

SEQ ID NO: 63164 - protein, 44 aa, Zea mays
  misc_feature: Ceres CLONE 1530411
MNGAKRSAEAVGCQNASVGERSPLEGSLRESGGRQSGSKNVRLE

SEQ ID NO: 63165 - DNA, 779 bp, Zea mays
  misc_feature: Ceres CLONE 1530414
  misc_feature: Pfam Name: ACC_central Pfam Description: Acetyl-CoA carboxylase, central region
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (18)..(18): n is a, c, t, g, unknown, or other
  misc_feature (39)..(39): n is a, c, t, g, unknown, or other
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (59)..(59): n is a, c, t, g, unknown, or other
  misc_feature (239)..(239): n is a, c, t, g, unknown, or other
  misc_feature (248)..(248): n is a, c, t, g, unknown, or other
  misc_feature (269)..(269): n is a, c, t, g, unknown, or other
  misc_feature (274)..(274): n is a, c, t, g, unknown, or other
  misc_feature (281)..(281): n is a, c, t, g, unknown, or other
  misc_feature (285)..(285): n is a, c, t, g, unknown, or other
  misc_feature (294)..(294): n is a, c, t, g, unknown, or other
  misc_feature (296)..(296): n is a, c, t, g, unknown, or other
  misc_feature (300)..(300): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (306)..(306): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (325)..(325): n is a, c, t, g, unknown, or other
  misc_feature (328)..(328): n is a, c, t, g, unknown, or other
  misc_feature (331)..(331): n is a, c, t, g, unknown, or other
  misc_feature (336)..(336): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (348)..(348): n is a, c, t, g, unknown, or other
  misc_feature (349)..(349): n is a, c, t, g, unknown, or other
  misc_feature (351)..(351): n is a, c, t, g, unknown, or other
  misc_feature (355)..(355): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (382)..(382): n is a, c, t, g, unknown, or other
  misc_feature (383)..(383): n is a, c, t, g, unknown, or other
  misc_feature (392)..(392): n is a, c, t, g, unknown, or other
  misc_feature (393)..(393): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (419)..(419): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (425)..(425): n is a, c, t, g, unknown, or other
  misc_feature (430)..(430): n is a, c, t, g, unknown, or other
  misc_feature (431)..(431): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (443)..(443): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (453)..(453): n is a, c, t, g, unknown, or other
  misc_feature (454)..(454): n is a, c, t, g, unknown, or other
  misc_feature (467)..(467): n is a, c, t, g, unknown, or other
  misc_feature (468)..(468): n is a, c, t, g, unknown, or other
  misc_feature (481)..(481): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (493)..(493): n is a, c, t, g, unknown, or other
  misc_feature (494)..(494): n is a, c, t, g, unknown, or other
  misc_feature (500)..(500): n is a, c, t, g, unknown, or other
  misc_feature (502)..(502): n is a, c, t, g, unknown, or other
  misc_feature (504)..(504): n is a, c, t, g, unknown, or other
  misc_feature (507)..(507): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (517)..(517): n is a, c, t, g, unknown, or other
  misc_feature (518)..(518): n is a, c, t, g, unknown, or other
  misc_feature (522)..(522): n is a, c, t, g, unknown, or other
  misc_feature (524)..(524): n is a, c, t, g, unknown, or other
  misc_feature (525)..(525): n is a, c, t, g, unknown, or other
  misc_feature (531)..(531): n is a, c, t, g, unknown, or other
  misc_feature (532)..(532): n is a, c, t, g, unknown, or other
  misc_feature (536)..(536): n is a, c, t, g, unknown, or other
  misc_feature (538)..(538): n is a, c, t, g, unknown, or other
  misc_feature (539)..(539): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (573)..(573): n is a, c, t, g, unknown, or other
  misc_feature (577)..(577): n is a, c, t, g, unknown, or other
  misc_feature (584)..(584): n is a, c, t, g, unknown, or other
  misc_feature (590)..(590): n is a, c, t, g, unknown, or other
  misc_feature (596)..(596): n is a, c, t, g, unknown, or other
  misc_feature (615)..(615): n is a, c, t, g, unknown, or other
  misc_feature (616)..(616): n is a, c, t, g, unknown, or other
  misc_feature (623)..(623): n is a, c, t, g, unknown, or other
  misc_feature (630)..(630): n is a, c, t, g, unknown, or other
  misc_feature (650)..(650): n is a, c, t, g, unknown, or other
  misc_feature (655)..(655): n is a, c, t, g, unknown, or other
  misc_feature (712)..(712): n is a, c, t, g, unknown, or other
  misc_feature (718)..(718): n is a, c, t, g, unknown, or other
  misc_feature (731)..(731): n is a, c, t, g, unknown, or other
  misc_feature (770)..(770): n is a, c, t, g, unknown, or other
nnnccaaaaaaaaaaatnaaggtaagtaagtgaggattncnccaggnnnnnnnnnnttnttttgattccccgcggtggcggccgctctagactagtggatcccccgggctgcaggaattcgtctcacccctagaaaaattgataaggatgaaggaactgtgtgcacacttgttgaagcatatggtattgaatttatatgaacatgttggggtcaggatgcatcgtctttctgtgtgccngcgggaagncaaggtcgggttggtttgtgntgggnaagcaanaggngcttggagngnggtngnnncnaagggnnntgggnnntcangcnccnttggnattttcnnnngnngnggangaaannngccnnntttggnnnnnngtnnaatattggnnannnnngggggggnnntttnnngggngnnngnggtgnnttgnnnnnnttnagnnnttggnntgcttttgagcgnnggagggggggggngnnnnngnnnanngggggncncntanctgcgnnngnncttnannctgagnntttnannactggcgggtggannnnattctggtggattacantaanaagctgntggttncagaanaggtgtatgaagaaataanncaacaanaatagcngagaagtgaaatgtaattanataanatcgactacattctaatatatcatataaataagcagaaaagcgacatgagaattaantaatanataagtagtcctncccggatgactctcaattaataatgtaaggataagcatnatccacaag

SEQ ID NO: 63166 - DNA, 645 bp, Zea mays
  misc_feature: Ceres CLONE 1530416
  misc_feature: Encodes the peptide sequence at SEQ ID NO. 63167
  misc_feature (361)..(361): n is a, c, t, g, unknown, or other
  misc_feature (576)..(576): n is a, c, t, g, unknown, or other
  misc_feature (594)..(594): n is a, c, t, g, unknown, or other
  misc_feature (645)..(645): n is a, c, t, g, unknown, or other
gcggtggcggccgctctagaactagtggatcccccgggctgcaggaattcgtctcacccctagaaaaagtcttcttctcccatctcatcgtcccatcccatcccatctcgaactcgtctcacttgtccattcatccgtgttgcttcaccgccttctcttcggattgggattgtaatcagaatcggattgcatcgttacacactcaaggcacatacagcagcaccaatgatgagcgacgcgtggccgtcatccccctactcctcgtcggcgcccgacggggaggtcctgcgctccctgcaccgcctggcgcgggacctgtcggcggccgaagcgccggcgccgttcctgcggccggtcttcncagcggtggccaggcgggcgcgcctgctggccgccgtgttcgacgacctgctgctgtgcgttgcggccgcgggcccgctgctgctgctgccgcgctccgcgtccctgtgcctccgggagctcctgctcgtgctgcagcggttcaaggcgctcgtggccgactgggccacgcgcagccgcaagcgcctgctgcttcagtcgaacaaagttgccccncgggcccgggacctccancacgacttcgccacgctgatcaacctgcctcccgccccggagctccggctn

SEQ ID NO: 63167 - protein, 140 aa, Zea mays
  misc_feature: Ceres CLONE 1530416
  misc_feature (46)..(46): Xaa is any aa, unknown, or other
  misc_feature (123)..(123): Xaa is any aa, unknown, or other
MMSDAWPSSPYSSSAPDGEVLRSLHRLARDLSAAEAPAPFLRPVFXAVARRARLLAAVFDDLLLCVAAAGPLLLLPRSASLCLRELLLVLQRFKALVADWATRSRKRLLLQSNKVAPRARDLXHDFATLINLPPAPELRL

SEQ ID NO: 63168 - DNA, 674 bp, Zea mays
  misc_feature: Ceres CLONE 1530418
  misc_feature: Encodes the peptide sequence at SEQ ID NO. 63169
  misc_feature (405)..(405): n is a, c, t, g, unknown, or other
ggccgctattgttctattaggatcccccgggctgcaggaattcgtctcacccctagaaaaaaactgtcgcaccctcgggacgccgcggcggcggccagcacgttcgaggctgcggcggcgaggtgggctgtcgttcgaggtcagcgaggacaggtcgtctgggagcacctgaggctgtgcgaggtgccggcaggctatgacatttctagagtaagtaacactctgggggcatctcccgctcgcttagctgtgcccgccaggccatggagcgtgaggacgccgacggcgctctcgattcgtgggctcaattctgcactctttccaacgagcttctcgccggagacggtgatctcgccgtcggcccacgcctagctcccgtcgttgggtgacctctgcacacgcggnctcgccacggtccgtccgcgactaccttcctccactccctcgaggaaacattttcaaaccattgcagccaagaaagttctgggcagcacttttcatcctttattggcatggcttccccccgtaaacagaaattaaattcctgtgtttaagggaacatttgggcccttgaggaaaatccttaagagtaaaggcacctgcgaagagacatattgcccttggaaacaagggcgcttacccaagagacaaaaagggggctccctcggctcccg

SEQ ID NO: 63169 - protein, 41 aa, Zea mays
  misc_feature: Ceres CLONE 1530418
MEREDADGALDSWAQFCTLSNELLAGDGDLAVGPRLAPVVG

SEQ ID NO: 63170 - DNA, 637 bp, Zea mays
  misc_feature: Ceres CLONE 1530420
  misc_feature: Encodes the peptide sequence at SEQ ID NO. 63171
agctccccgcggtggcggccgctctagaactagtggatcccccgggctgcaggaattcgtctcacccctagaaaaagtccgctcgaccaccacgagggagtgggctgtgactcggacagcaccaaaacctcgcccgccatggcgtcgccgtcgtcgtctccgccgccgaagctgccgatccccggccgccgcaacatactcatcaccagcgccttaccctatgtgaacaacgtcccgcacctcgggaacatcatcggatgcgttctgagcgccgacgtgttcgcgcgctactgcaggctacgcgggtacaacgcgctctacatatgcgggacggacgagtacgggacggccacggagaccaaggccatggaggaggagtgctcgcccaaggagatctgtgacaagtaccatgctatccacagtgaggtttacaagtggtttgacatagaatttgacaaatttgggcgtacatcctctcctcaacagacaacaatctggcaagcaattttccataaattgatggtaaacagttggctatcagataacaccatgcagcagctgtactgtgatacatgtcaaaggtttttgggcagatagactttgtagagggagcatgcccaaacatgaggggtgtact

SEQ ID NO: 63171 - protein, 152 aa, Zea mays
  misc_feature: Ceres CLONE 1530420
  misc_feature (20)..(152): Pfam Name: tRNA-synt_1g Pfam Description: tRNA synthetases class I (M)
  misc_feature: SWISSPROT Homolog: EC 6.1.1.10 Methionine--tRNA ligase
MASPSSSPPPKLPIPGRRNILITSALPYVNNVPHLGNIIGCVLSADVFARYCRLRGYNALYICGTDEYGTATETKAMEEECSPKEICDKYHAIHSEVYKWFDIEFDKFGRTSSPQQTTIWQAIFHKLMVNSWLSDNTMQQLYCDTCQRFLGR

SEQ ID NO: 63172 - DNA, 640 bp, Zea mays
  misc_feature: Ceres CLONE 1530421
  misc_feature: Encodes the peptide sequence at SEQ ID NO. 63173
agctccccgcggtggcggccgctctagaactagtggatcccccgggctgcaggaattcgtctcacccctagaaaaagtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccgggcagactatcaccctcgaagtggagtcctctgacaccattgacaacgtcaagggcatgatccaagaaaaaggagggcatccctccagaccaagcaccggctcatctttgctgggaaacacactgggggacgggggacaccctggccaaattaaaaattcagaaaggaaaaccccccccccctggggtgcgcgccccagggggaagcatgcaaatcttccgggaaaaaccccggcc

SEQ ID NO: 63173 - protein, 164 aa, Zea mays
  misc_feature: Ceres CLONE 1530421
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGQTITLEVESSDTIDNVKGMIQEKGGHPSRPSTGSSLLGNTLGDGGHPGQIKNSERKTPPPWGARPRGKHANLPGKTPA

SEQ ID NO: 63174 - DNA, 648 bp, Zea mays
  misc_feature: Ceres CLONE 1530422
  misc_feature: Translation starting site: 265
  misc_feature (379)..(379): n is a, c, t, g, unknown, or other
  misc_feature (380)..(380): n is a, c, t, g, unknown, or other
acccgcggtggcggccgctctagaactagtggatcccccgggctgcaggaattcgtctcacccctagaaaaatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgagggggtggacgtcaccttcaaggtcaaatatggtgatacacttaaaaggttttatnnggtgtgccatgggagtcattttgacatgaatttatctgctctacggggcgaggattgatactgcctttaagttgggtcctgacgttgactttgttctgacttacaccgatgaggatggtgatattgtcatgctagatgatgatgatgacttgcgtgatgcagctctccgtcagagattaaaccctctcaagattactgttcaactgaagaaaaaacaacccactgaaaaaaaaatacttcctgcacaagtgaaatccgctgctcagga

SEQ ID NO: 63175 - DNA, 645 bp, Zea mays
  misc_feature: Ceres CLONE 1530423
  misc_feature: Encodes the peptide sequence at SEQ ID NO. 63176
ctccccgcggtggcggccgctctagaactagtggatcccccgggctgcaggaattcgtctcacccctagaaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccacccgcccccgatgagatccagctcgcgaagcagcgcgcgcaggagatcgcggcgccgatcttttacgccgcagaggcctagcgtcctcgcgtcgactacgcgacgatgacagcggcggctttcgtgtaggcctgggcagcactgggtggcggtggccgcatcgggcgggaggagaattcggcttctcctccttttggccgggggggggcccggggcttcctttcccccaatttttcttcccaagaaaagcgcccccctcaataccccccttttttggggggaatttccgggtgccaagccaaaaaaatttgaaactcccaatggggaaggggtggggggtttttttt

SEQ ID NO: 63176 - protein, 71 aa, Zea mays
  misc_feature: Ceres CLONE 1530423
MADDHYSSKRKYDDPSPPPRRTGFSSGPPPASPLAGGAPSYNSVPPAPDEIQLAKQRAQEIAAPIFYAAEA

SEQ ID NO: 63177 - DNA, 624 bp, Zea mays
  misc_feature: Ceres CLONE 1530426
  misc_feature: Translation starting site: 116
  misc_feature: Pfam Name: Ribosomal_L36 Pfam Description: Ribosomal protein L36
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaaaatagattcatagtttaagaaaggaatacccatatatgaaaataagagcttccgttcgtaaaatttgtacaaaatgtcgactgattcgcaggcgtgggcgaattagagtcatttgttccaatccgaagcataaacaaagacaggggtaatctttcgaaaaagaagcttttctttctaatagcttttctttctaattaaagtaaaaagtacccacggaaatgcccaaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccaacagttgcgcagcctgaatggcgaatgaaaatttgtagcgttaatatttttgtaaaattcgcgttaaatttttgttaatcagctcattttttttaacaataggccgaaatcggcaaaaa

SEQ ID NO: 63178 - DNA, 667 bp, Zea mays
  misc_feature: Ceres CLONE 1530427
  misc_feature (480)..(480): n is a, c, t, g, unknown, or other
ggctccccgcggtggcggccgctctagaactagtggatcccccgggctgcaggaattcgtctcacccctagaaaagttccccacccatatcgtgaacccgccgccgactcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgacgacatggttgtgttacgattcttcgatgcgtgtgagttcatggagagatgtcacatcctagttcgtcgtcaccgtttgccatgtgtccaatagctcgtcttggaaacctgcacttcagtaggccatctatcgtgggttctagctatatccagagtttttgtgctagacaaatcagtcagtcgttttgtgaccttactatgatggagcttttattgctgctnatatcgacctaccctataagtaattggcaaaaaaaaaaaaaaaacgagaccctcggaggtacccatttcggcctaaagtgagtccgattaccgcccgctcccgggccgttcttttacaacgtcctgactgggaaaacccctggggttaccaaacttaatcgctttgaagaaatcccccttttccccg

SEQ ID NO: 63179 - DNA, 639 bp, Zea mays
  misc_feature: Ceres CLONE 1530431
  misc_feature: Encodes the peptide sequence at SEQ ID NO. 63180
tccccgcggtggcggccgctctagaactagtggatcccccgggctgcaggaattcgtctcacccctagaaaaactctcggtgcgtgcgtttgcgtggctgtggcaatatacggtgcgtgtgggggcggcggcgacgagggttttgctgctccgtacaccgcgtgcagcggcgacgcgaccgcagctggtcgcgcccccgggatcaggagggggaggagccggcggaggctcctgtggtggctgcgggggcgggagcgggagcgccatgaggggcggtggccgtggcggcggcgggagacagccttcctacacggcgccggatggggcggatgcggcggcgatcccggtcgcctcaaggaagatggtgcagagcctcaaggggatcctggccgaccgctcggagggcgagatctacgccacgctctgcgactgcggaatggaccccgacatagccgtcgagaggctcatctcccaggatacttttcatgaagtcagaagaaaaaaaaaaaaaaaacgagacgctcgaggtacccaattcgccctatagtgagtcgtattacgcgcgctcactggccgtcgttttacaacgtcgtgactggggaaaaccctggccgtaccccaacttaatcgccttgcagc

SEQ ID NO: 63180 - protein, 93 aa, Zea mays
  misc_feature: Ceres CLONE 1530431
  misc_feature (26)..(85): Pfam Name: DUF1296 Pfam Description: Protein of unknown function (DUF1296)
MRGGGRGGGGRQPSYTAPDGADAAAIPVASRKMVQSLKGILADRSEGEIYATLCDCGMDPDIAVERLISQDTFHEVRRKKKKKRDARGTQFAL

SEQ ID NO: 63181 - DNA, 642 bp, Zea mays
  misc_feature: Ceres CLONE 1530443
  misc_feature (226)..(226): n is a, c, t, g, unknown, or other
  misc_feature (239)..(239): n is a, c, t, g, unknown, or other
  misc_feature (240)..(240): n is a, c, t, g, unknown, or other
tccccgcggtggcggccgctctagaactagtggatcccccgggctgcaggaattcgtctcacccctagaaaaatttcttcttcttcttcttcctcctcctcttgccgctgttcatatagctggatggatcaggacttgtgctgatcggtcgatggattccatccatgtgtactcgtctgctgttctttccttcccaattcccatgttccaatggagtctggattcnttaaaaaaaattnnaccaatttcaatgtacttaaaaaacaactaaccaaatttcatggaattactctttgtacatagtaaaaaaaaaaaaaaaaacgagccgctcgaagaacccaattcccgcccctcggggttcccatttccccccttaaggggccgttttttccccccctcatggccggtatattacaaccgttaccaaggaaaaaccccttgcataaacaacctttttcccctggtggcatacccccttttacccccttggcgataacccaaaaaagcccttccgaatcctctttgcaaaatgtgacttgcccgcattggcaatgggaatttttacgcgttaaatttttgtaaaatcccctgatatttttttgcaatacgccctaatcttttaaaccctgggcaaaaacccga

SEQ ID NO: 63182 - DNA, 651 bp, Zea mays
  misc_feature: Ceres CLONE 1530445
  misc_feature: Encodes the peptide sequence at SEQ ID NO. 63183
  misc_feature (374)..(374): n is a, c, t, g, unknown, or other
  misc_feature (385)..(385): n is a, c, t, g, unknown, or other
aaagctggagctccccgcggtggcggccgctctagaactagtggatcccccgggctgcaggaattcgtctcacccctagaaaaaataccaacctacaattgtcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaaccttctacctaaaggtgtcaatangtcaagaagtngatactatatacttatgcttgtctctgtatagcctaatagtcctaattcaaataacaggtgctgcttgcagccttggatatttgcggatgcggagtgaagttaccatggcatcgttgctaagaatagaaaagtaatgtggttattcaaaaaaaaaaaaaaaacgggcccgtcgaagtacccaattcgccctatagggggtcgaataccgccgcctcctggccgtgttttttcaccgccgggaatgggaaaaccttggggttcccac

SEQ ID NO: 63183 - protein, 74 aa, Zea mays; identical to SEQ ID NO: 56369
  misc_feature: Ceres CLONE 1530445

SEQ ID NO: 63184 - DNA, 493 bp, Zea mays
  misc_feature: Ceres CLONE 1530447
aatctggagctccccgcggtggcggccgctctagaactagtggatcccccgggctgcaggaattctctcacccctagaaaaagaaccagaactcgtgccacctcctcctgttccttgccatctccgaaattcccatctgaaatcctagggcgcgcgtgcatcgagctctccccgcttcaccatatatcgagctccgccccgcgcctcaatccttcccgaaaaaggggccttttttttttccctgtattttaccccgggggaaaggtcccccctttttaattttaaaagggtccccggtttaattttgggaaaaaaaaacctaaccccccgtgagaaccccccgggttttcaaccttccggggcccggcggggggtaaaaaatttttttcccccccctcttgttaaaaccccaaaaaatggggccccccccaaaaacccccttcccaacccccttggggggcccccacccccctaaattttttttttgaaaaaa

SEQ ID NO: 63185 - DNA, 638 bp, Zea mays
  misc_feature: Ceres CLONE 1530449
  misc_feature (200)..(200): n is a, c, t, g, unknown, or other
tcaccgacaggtgggcggccgctctagaactagtggatcccccgggctgcaggaattcgtctcacccctagaaaaaacgtacctccggcgccccctccgacaccggtcctccggcctgcgcaggctagctagctctatataccaccgtgccctcgccgcgcaggcaggggagatcaaagggtccgagcaaaaagccggcngcggcgagccacccagcagctaaagcgatcatatatacttatatactatccagcaacaaaaaaaaaaaaaaaccggacgcctcgaggtccccaatttccccctaaggggggtcgtattacccccccctccctgggcccgccttttttcaaccccctgggattggaaaaaacccttgggtttcccccaatttaatgcccttttgggaaccccccccccccttttccccccctgggggtaaataaacgaaaaaaagccccccccccaatttccccctttccaacaaatttttcccccctcccaatggggccaaaaggaaaaatttttcacccctcaaaatttttttttaaaaaaaccccccgcaaaaaatttttttttaaaacccccccccttttttttttaaaccacaagggggccgaaaaaatttaaaaaattccctt

SEQ ID NO: 63186 - DNA, 712 bp, Zea mays
  misc_feature: Ceres CLONE 1530451
  misc_feature: Encodes the peptide sequence at SEQ ID NO. 63187
catagctggagctcctcgaggtggcttgcagatctagaactagtggatcccccgggctgcaggaattcgtctcacccctagaaaaactcctcgtcttactccatcttgggtttgctatcgaaatcctgcaccgccgcaggagtctctgctgttggtcataatgtccgtcagaactaaggccaaggaggacctcgctggcgcttcctcctcctactgcatagagaagaccgacgccaacgacagctgctacggctgggagatgctgtactgtggcgggacgagcttcaacaccatgggtccgaaggtggtggggggggcgcatggcaacctgctgtcaacgactcggctgcgggcgctcgtgggcgttgataagaacttctttgacgactggatgcactgcttgccactgtgttgtcttctactgtggaggcgaatgctataactggggtatcaacgataacggaggcgtcgggtattgagataatcatcagtgcaaccaggccactgttgcttctcaggagggagagtgcaagacgtctaagaatgtgttggaagagaccctacagtgactgtaactgatgatcgcaaatctttatatttcggacatcatcagaatggacatcttcgagactggttcctctaagaatgatattgaggactctccagtgatcatgatcgctgatgacgcaaccaacgtttcatgtgctgctga

SEQ ID NO: 63187 - protein, 93 aa, Zea mays
  misc_feature: Ceres CLONE 1530451
MSVRTKAKEDLAGASSSYCIEKTDANDSCYGWEMLYCGGTSFNTMGPKVVGGAHGNLLSTTRLRALVGVDKNFFDDWMHCLPLCCLLLWRRML

SEQ ID NO: 63188 - DNA, 716 bp, Zea mays
  misc_feature: Ceres CLONE 1530455
  misc_feature: Encodes the peptide sequence at SEQ ID NO. 63189
caaagctggagctcaccgcggtggcggccgctctagaactagtggatcccccgggctgcaggaattcgtctcacccctagaaaaacttctccgcttttcccccatctccttctgggcgcaccaggaaaaaaattgatacattcctcggcagctgcgcgagtcctctgttgataccccggcgacccaaagcccccgtccgagcagcagcagcagccgccgcctaaaagtaacaggattggggatttttttttttgcttcgtgttctccttctcctgctgtaggcgttgattcgggtgatgagagatgggcttcttggcgtgcttgtgccgatgccctcaggacggggacgacgacgagaaggagggggagcagttcagaatcaaccaccaggtcgcctcagtggactacccaaaatcttctgaaagcagcccattgaaggctgagagagtggttcatatggacggagcgcagctaattggtagacatgatgaagcaacaatcttcacgttgcgtcagcttgctgaggctaccaataatttcaggcaggactctcttttggggcgaggtggattcggttgcgtctacaaggcaactcttagtaatggacaggttgttgcagtcaaacaacttgatctaaatgggcttcaagggaacagagaattcctcgtggaggttctcatgctcaacctcctgcatcaccataatctagtcaatct

SEQ ID NO: 63189 - protein, 137 aa, Zea mays
  misc_feature: Ceres CLONE 1530455
  misc_feature: SWISSPROT Homolog: EC 2.7.11.1 Non-specific serine/threonine protein kinase
MGFLACLCRCPQDGDDDEKEGEQFRINHQVASVDYPKSSESSPLKAERVVHMDGAQLIGRHDEATIFTLRQLAEATNNFRQDSLLGRGGFGCVYKATLSNGQVVAVKQLDLNGLQGNREFLVEVLMLNLLHHHNLVN

SEQ ID NO: 63190 - DNA, 637 bp, Zea mays
  misc_feature: Ceres CLONE 1530466
  misc_feature: Encodes the peptide sequence at SEQ ID NO. 63191
  misc_feature (384)..(384): n is a, c, t, g, unknown, or other
ctcaccgcggtggcggccgctctagaactagtggatcccccgggctgcaggaattcgtctcacccctagaaaaacctcgtctttgggaagagggtggaagcccatgttgtgctgaggtatagccttctcactaactcttggactacaggagagatgatgaacacaccaaggtgcttgtttggctccgcaagcttcggtgagaaggctattgtagctggcggtattggccagaacggtacattggactctgctgagctttatgattctgagatgcagacatggaccactcttccaagcatgaatagggcacggcagatgtgctctggtttcttcatggatggcaagttctatgtcatccctcggaaatgggagaggcgcaatganatccttagttgtgctgaggagtttgacttggaaagcaacacctggcgcttgatccccgaatggcacaaggccttaatgggggaaatgtggccccccctcttgttgctgttttgaaaaagaaactttagccggctagacaatggaacaagggaggtttggaaaatttacagggaaaatttggcggggtccccccttggatgtgtaccccggaggttttcacccagtcctggggggggggatttttttttcccag

SEQ ID NO: 63191 - protein, 114 aa, Zea mays
  misc_feature: Ceres CLONE 1530466
  misc_feature (5)..(50): Pfam Name: Kelch_1 Pfam Description: Kelch motif
  misc_feature (77)..(77): Xaa is any aa, unknown, or other
MMNTPRCLFGSASFGEKAIVAGGIGQNGTLDSAELYDSEMQTWTTLPSMNRARQMCSGFFMDGKFYVIPRKWERRNXILSCAEEFDLESNTWRLIPEWHKALMGEMWPPLLLLF

SEQ ID NO: 63192 - DNA, 622 bp, Zea mays
  misc_feature: Ceres CLONE 1530468
  misc_feature (398)..(398): n is a, c, t, g, unknown, or other
  misc_feature (483)..(483): n is a, c, t, g, unknown, or other
ctccccgcggtggcggccgctctagaactagtggatcccccgggctgcaggaattcgtctcacccctagaaaaaaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttggtttcctcgaangatcagcatctactcttgattgtggactttgtcgcatctgatatcaacttcataaatctttatccaagatggcgctgcaaaacantggtggctcaaacagggatgatgccttctacaggtacagatgccccgaatgattaccagatagaaaggccgtggtattggtatcaaaacaaagttgggaaactggttgactaaccaaaagactttgcaaggccatttcc

SEQ ID NO: 63193 - DNA, 725 bp, Zea mays
  misc_feature: Ceres CLONE 1530471
  misc_feature: Encodes the peptide sequence at SEQ ID NO. 63194
  misc_feature (260)..(260): n is a, c, t, g, unknown, or other
  misc_feature (480)..(480): n is a, c, t, g, unknown, or other
  misc_feature (481)..(481): n is a, c, t, g, unknown, or other
gctggagctccccgcggtggcggccgctctagaactagtggatcccccgggctgcaggaattcgtctcacccctagaaaaaccctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcnggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaacccccatcacaccgtctttgatgccaagcgtctcattggcagggagtttagtgatgcctctgtccagagtgatattaagctgtggcccnntcagggtcattctgggcccggtgagaagcaatgatagttgtcagcacaaggggggagagaaacagtttgcagcccaagaagatcccctcctggttcccaacagaatgcttgaaatccctaaaactaccttgccagcccaatcaaaaaagttttgtcccgggccctgcctattttaagactcccaaggcgggccccaaagaatcctgggggaattctggccccaagggggcgggatcccaaaaga

SEQ ID NO: 63194 - protein, 100 aa, Zea mays
  misc_feature: Ceres CLONE 1530471
  misc_feature (90)..(90): Xaa is any aa, unknown, or other
MGRQSASISARPTLASGVWQHDRVEIIANDQGNRTTPSYVAFTDSERLIGDAAKNQVAMNPHHTVFDAKRLIGREFSDASVQSDIKLWPXQGHSGPGEKQ

SEQ ID NO: 63195 - DNA, 678 bp, Zea mays
  misc_feature: Ceres CLONE 1530472
  misc_feature: Encodes the peptide sequence at SEQ ID NO. 63196
  misc_feature (45)..(45): n is a, c, t, g, unknown, or other
  misc_feature (391)..(391): n is a, c, t, g, unknown, or other
  misc_feature (595)..(595): n is a, c, t, g, unknown, or other
  misc_feature (624)..(624): n is a, c, t, g, unknown, or other
  misc_feature (651)..(651): n is a, c, t, g, unknown, or other
  misc_feature (658)..(658): n is a, c, t, g, unknown, or other
ctcaccgcggtggcggccgctctagaactagtggatcccccgggnctgcaggaattcgtctcacccctagaaaaaatccctcccgatcagatccctcgacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaggggcaagccgccgctccctccctcgccgccgggcaccctgcacatcgtggggcacctacacctcatcgggccccagacccacatctcgctccaggaggtggtggcccccccccgggggggggggggggggttcttccncccctgccccttcccccccctgatcgggtcgtggcccaacgcccccaaggccgtggggggggccgccgacccatctttgcgtcccggccggggtccatgggccccccaatccccggctacaaccctgggaagtggcccttcgagccccctcggcaacaactggggccgaaaaccaggacggcgaggggccccccccccccgtcncggacgcacaaggggccactcccccgggncccggagcccggcaagaaaaaaaacgnaccgcanccgccgcgaagccctgcacc

SEQ ID NO: 63196 - protein, 192 aa, Zea mays
  misc_feature: Ceres CLONE 1530472
  misc_feature (97)..(97): Xaa is any aa, unknown, or other
  misc_feature (165)..(165): Xaa is any aa, unknown, or other
  misc_feature (175)..(175): Xaa is any aa, unknown, or other
  misc_feature (184)..(184): Xaa is any aa, unknown, or other
  misc_feature (186)..(186): Xaa is any aa, unknown, or other
MALQAAYEYLQQAVGHGAWSSTQTLTLLLIAVPTVLLLLASLAKSTSSSGRGKPPLPPSPPGTLHIVGHLHLIGPQTHISLQEVVAPPRGGGGGFFXPCPFPPLIGSWPNAPKAVGGAADPSLRPGRGPWAPQSPATTLGSGPSSPLGNNWGRKPGRRGAPPPRXGRTRGHSPGXRSPARKKTXRXRREALH

SEQ ID NO: 63197 - DNA, 629 bp, Zea mays
  misc_feature: Ceres CLONE 1530475
  misc_feature: Encodes the peptide sequence at SEQ ID NO. 63198
  misc_feature (286)..(286): n is a, c, t, g, unknown, or other
  misc_feature (309)..(309): n is a, c, t, g, unknown, or other
  misc_feature (311)..(311): n is a, c, t, g, unknown, or other
  misc_feature (312)..(312): n is a, c, t, g, unknown, or other
ctcaccgcggtggcggccgctctagaactagtggatcccccgggctgcaggaattcgtctcacccctagaaaaaagcctcctccgtctgctcaagacgagggaggagcagagaccgaactctgccgtctcttcctcctccctctgcacccccacgagctccatggccgccaccgccatgattgggattaccaacctacgttgccgccacgacccgctctcctcccttccccgggctacgtcgtcggccgcccggtcctgtacgctgcttcctcctcgatgccgccngcattcttcttgctgctcccttncnnctctcgtctctccgtgccgggcccgggtccgaccaacagcacccctgaagggcatggctgccggcggacacgggcttctgggtccagccaaaaatgaagccaccacgcctaaacaataatcggtgggccgacctttcccgccccctttatcgtccccaggttcccccggttgggacgggaaaagcccgccgggggtttcccaaggaggggcccccccccattttcgggtgggggcccctcctgcctggggcccctggggattttcggccccccaagggaaaaattcccccaaaaaggggtttcttcccccccctttc

SEQ ID NO: 63198 - protein, 89 aa, Zea mays
  misc_feature: Ceres CLONE 1530475
  misc_feature (42)..(42): Xaa is any aa, unknown, or other
  misc_feature (50)..(50): Xaa is any aa, unknown, or other
  misc_feature (51)..(51): Xaa is any aa, unknown, or other
MAATAMIGITNLRCRHDPLSSLPRATSSAARSCTLLPPRCRXHSSCCSLXXLVSPCRARVRPTAPLKGMAAGGHGLLGPAKNEATTPKQ

SEQ ID NO: 63199 - DNA, 747 bp, Zea mays
  misc_feature: Ceres CLONE 1530487
  misc_feature: Encodes the peptide sequence at SEQ ID NO. 63200
aagctggagctcaccgcggtggcggccgctctagaactagtggatcccccgggctgcaggaattcgtctcacccctagaataattagcagaagagggcaaattggacccagtcgttggtagacaagatcagattgagcgtgttactcagattttgggcaggcggacaaagaacaacccctgcctaattggagagcctggtgttggaaagactgctattgctgaggggcttgctcagcgtattgccaatggggatgttcctgaaacaattgaaggaaagaaggttattactcttgacatggggctccttgttgctggaactaaataccgaggagagtttgaagagagactaaagaaacttatggaggaaattaagcaaaatgaagacattattctctttattgatgaagcgcacacactgattggagcatgtgcagcacaaggtgcgattgatgctgctaaatatttttgagcccgctctttgcctagaggtgaaactccggtgctttggttgcccacaacactggatgattttaggaagcattaaaagcaagattctgcctttgaaagagaggtttcaccctttaaggttccggaagcctctgggggaagaaaccttccacattctttaaaggacttcctggagaagaattaaacttctcccccaacgtggaaaacccccgatgagggcgttaaattgcggggcccgcccggtttctttcttttccggttttctcaccaaatttgtt

SEQ ID NO: 63200 - protein, 57 aa, Zea mays
  misc_feature: Ceres CLONE 1530487
MGLLVAGTKYRGEFEERLKKLMEEIKQNEDIILFIDEAHTLIGACAAQGAIDAAKYF

SEQ ID NO: 63201 - DNA, 657 bp, Zea mays
  misc_feature: Ceres CLONE 1530497
  misc_feature: Encodes the peptide sequence at SEQ ID NO. 63202
cggccgctctagaactagtggatcccccgggctgcaggaattcgtctcacccctagaaaaaccgcgcccgccacgtaggaacagctcgctagctagcaggctagctggtgcggctgcctcttcgttcgtgagcgccatggaggagaggcggaggccccgcgggagcgccagcggctggaggcgcccgtcgtcgcgcgcggccggtgctgcgctgcgccgaaaggtgcgggagctgcgccgtctcgtgcccggcggggaggaggcgcccgcgggggccctgcttgtccgcacggccgactacatcgtggggctgcgggctagggtggatcttctcagggcactcgcggccgtctacggagtcggcgtgggcgccgtcgtcgccgacgccgccgacgctgatgcgtgcgcttcatgagttgttttatcaccactagtagtatagtatgccgtagatttgtgcgtgcatataaacacgcacttgaggattcatgcatgcggctttttagttaatttcaaaatagcatgcaggcatgcagcccagctcgtcgtcccatgcacgtaccacacttggtacgtgtgcgcccatcagtttaaactcctttggaagaaatgtttgggaaatcagaaatggccggaaagatcattgttgcctaaaaa

SEQ ID NO: 63202 - protein, 92 aa, Zea mays
  misc_feature: Ceres CLONE 1530497
MEERRRPRGSASGWRRPSSRAAGAALRRKVRELRRLVPGGEEAPAGALLVRTADYIVGLRARVDLLRALAAVYGVGVGAVVADAADADACAS

SEQ ID NO: 63203 - DNA, 723 bp, Zea mays
  misc_feature: Ceres CLONE 1530503
  misc_feature: Encodes the peptide sequence at SEQ ID NO. 63204
ctggagctccccgcggtggcggccgctctagaactagtggatcccccgggctgcaggaattcgtctcacccctagaaaaaaaatcctaggcgtggtgaaatcctaaacccgctccgcgggcggcgatggcgctcgtgtccaccgccaccgtcgcgtcgtcgtcctaccactgcgacccccacctcttcccaggggccaggaggagctggcgcgagccgaggtggagcccgcgggcggcgcgggcgcgaggctagcggtgctgcagcgtgcgggcggcggcgggctcgcggtgctggagcgagcgggcgcgggtgcggggtccgcggtgctagagcgggcggggggcgccgcggcggccgcggcgaggagggaggagctggtgccctcggggaatgcgaggaactcgtacgaggtggagtcactgatcgaccggctgagcaacctgccgccgcggggctccatcgcgcgctgccttgagacagcgcggcaccggctgacgctgcaggacttcgcggcggtgtaccgcgagttctcccgccgcggggactggcagcgctcgctccggctcttcagtacatgcagcgccagtcgtggtgccgccccgacgagcacatacacgccatcgtcatcggcgtgctcgggcgccagggccccgcgctgctcgacaagtgctcgaggtgttccacgacctcccccgcgagtcgcgcaccgcgctctcttatc

SEQ ID NO: 63204 - protein, 49 aa, Zea mays
  misc_feature: Ceres CLONE 1530503
MQRQSWCRPDEHIHAIVIGVLGRQGPALLDKCSRCSTTSPASRAPRSLI

SEQ ID NO: 63205 - DNA, 640 bp, Zea mays
  misc_feature: Ceres CLONE 1530506
  misc_feature: Encodes the peptide sequence at SEQ ID NO. 63206
ctcaccgcggtggcggccgctctagactagtggatcccccgggctgcaggaattcgtctcacccctagaaaaaaaaaagtgggatactggacgtcggtgcgaaagcagggcatgagatgtgcggaggacatatcagaggaatgtttggcttcttcttcaccggcgggcccgtccacaacttcggggacgccaagaagagcgacaccgagaagttcgggaggttctaccgtggcatgctggaggagggcgtgtacttcgctccctcgcagttcgaggcggggttcaccagcttggcgcacacctcccaggacatcgagaagaccgtcgaggccgctgagaaggttctgaagcggatatagggggtccgcttcaagcaagcatgcagagagcatttccccctatctacgttcttgtactcttagttctatatgccaccgaggttttgtattgtgcagcagcaggacagcttctgtaagttcctctttctgaattagtgggtcttgtttttgtcaaaaaaaaaaaaaaaacgagacgctcgaggtacccaattcgccctatagtgagtcgtattccgcgcgctcactggccgtcgtttaacaacgtcgtgactgggaaaaccctggcgttacccaacttaatc

SEQ ID NO: 63206 - protein, 80 aa, Zea mays
  misc_feature: Ceres CLONE 1530506
  misc_feature: SWISSPROT Homolog: EC 5.4.3.8 Glutamate-1-semialdehyde 2,1-aminomutase
MCGGHIRGMFGFFFTGGPVHNFGDAKKSDTEKFGRFYRGMLEEGVYFAPSQFEAGFTSLAHTSQDIEKTVEAAEKVLKRI

SEQ ID NO: 63207 - DNA, 723 bp, Zea mays
  misc_feature: Ceres CLONE 1530512
  misc_feature: Translation starting site: 493
  misc_feature: SWISSPROT Homolog: EC 1.14.13.88 Flavonoid 3',5'-hydroxylase
  misc_feature (1)..(1): n is a, c, t, g, unknown, or other
nccagctggagctcaccgcggtggcgggcgctctagaatagtgggacccccgggctgcaggaattcgtctcacccctagaaaaaaagatcccttctcccgatcacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaagggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccggcgaggccgtgatgcgcacccacgaccacatcttcgcgtcccggccgtggtcatgggctcccacattctccgctacacacctgggaagtggccttcttcgcgcttcggcaatactggcagccaaccagaagctgatgacacccacctgctccacaacaagaggtctactccttccgccatggccgcgaaggagaaatgtggcttctccggggacaacctcccccagggggccgccaagttcccctcaaagggcctggaaattaaccaagggcttgccgcctac

SEQ ID NO: 63208 - DNA, 720 bp, Zea mays
  misc_feature: Ceres CLONE 1530521
  misc_feature: Encodes the peptide sequence at SEQ ID NO. 63209
  misc_feature (455)..(455): n is a, c, t, g, unknown, or other
aaagctggagctccccgcggtggcggccgcctctagaactagtggaacccccgggctgcaggaattcgtctcacccctagaaaaaacacaagtctgaacgcttgaacctgaacctccaaagcagcaaccccagcagctttagctcctcctcatcgcagccgcagcgccgtcccctactcttcctgcgaccaactgctgtctctccggcgacggcagaaccgtctctgcaggtgcagggagggacccgggagatgagtctggggctgctcaacacagagcgcaaccaccttctctcccccgaaagccgcatgaagcccctcgggatgccgccgtgtcgtcgctgctgaggtcacccagggcgtcctgcggctcctgcagccagagcccaagccgaagcccaccaagatggcgcacggcggcctggagcgctcgctcagcttcagaactgggaggcngacgacagccggggcggcatcaacggagcgcgcccgggcgccctggcgctgcagcagcaggagagccccccgcgcgtggtctccgtgtccccgcaggcgcaggccatgatcgagtacatctccccctcgcccccgcgttggagctggaccagggcggccccccccctgcaaaaaaatgtacaggggccctgggaacccccccaaaaccctccccaaagggccgcattattccccaaagaacctttggtgggaaaaaacggcccac

SEQ ID NO: 63209 - protein, 31 aa, Zea mays
  misc_feature: Ceres CLONE 1530521
MSLGLLNTERNHLLSPESRMKPLGMPPCRRC

SEQ ID NO: 63210 - DNA, 669 bp, Zea mays
  misc_feature: Ceres CLONE 1530526
  misc_feature: Pfam Name: Glyco_transf_20 Pfam Description: Glycosyltransferase family 20
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (193)..(193): n is a, c, t, g, unknown, or other
  misc_feature (198)..(198): n is a, c, t, g, unknown, or other
  misc_feature (199)..(199): n is a, c, t, g, unknown, or other
  misc_feature (250)..(250): n is a, c, t, g, unknown, or other
  misc_feature (275)..(275): n is a, c, t, g, unknown, or other
  misc_feature (280)..(280): n is a, c, t, g, unknown, or other
  misc_feature (281)..(281): n is a, c, t, g, unknown, or other
  misc_feature (326)..(326): n is a, c, t, g, unknown, or other
  misc_feature (327)..(327): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (412)..(412): n is a, c, t, g, unknown, or other
  misc_feature (414)..(414): n is a, c, t, g, unknown, or other
  misc_feature (415)..(415): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (454)..(454): n is a, c, t, g, unknown, or other
nnnaaaaatnnnnagataaaagaactacacgcggtggcggccgctctagaatagtggatcccccgggctgcaggaattcgtctcacccctagaaaaactttaaggggatcaatttgaagcttctcgcctttgagaacatgttgaggacacatcccaggtggcaggggatatttttgttaatgcagatggctanccccnncccgtgaaagggtaaaaatctcggaggcctcccagctgaaattgaggaaanctcccccccgatcaatggaaacttnggccnntcaggtacaaacctttttttcaccaggagggagaagatccaaagnntttttttttcaccaaaaaacgannnnttgannnnnntttttttcccctcatcccacaggggtcagccaggggnnnnccnnnnncntnntnnnnnnnnnnncaaaaaaaaaaaaaaaaaattaccccnttgggggggggccctgcatttcccccctccttttcccaacttccccaccacccccccctctgtttcttaaaacccctttgtgcccccgccccaaaaacaaccaaccccccgacaaatacccttcacctccccttagattcccctccccattttacatcggcctacgccgaacgttagcccttccccagggcgaaaagccaaaaaagacccccccg

SEQ ID NO: 63211 - DNA, 659 bp, Zea mays
  misc_feature: Ceres CLONE 1530527
  misc_feature: Encodes the peptide sequence at SEQ ID NO. 63212
  misc_feature (490)..(490): n is a, c, t, g, unknown, or other
  misc_feature (575)..(575): n is a, c, t, g, unknown, or other
tggagctccccgcggtggcggccgctctagaactagtggatcccccgggctgcaggaattcgtctcacccctagaaaaaccgccgctgtgcctgtgctagctcctctctctgcttctgcttctgcttttgcctcactcagcctgctgcaagcttttgctttggtttaggtgcttcttttgcattcctttactgttcccccccactttcgctcgctttgccacgcacacgaaaagctcctgcctttaccttctcggaccttatctccgccccgtagtgggaatttggtgggagctgcgctgcagctgcttgccccctcgcgtttctttgctcaattgggggtgtcgcgcgtgctcgtgggcggaattcggtgttcttgcttgcgcggtccacgtccccgtccccgtccccatcccttggcgcgattgcggttgcggacgctcgctgcagatcttcgcgcgactccgggagcgccgccggagatggactgcnggccgcccgaacagctgccgccgtcgtcggcgccggcgtgcttcctcaaccctcactgggaccagtccatggccgcccgcacggncggcgaccacctcgacctggtctcctccccggcgtccaaatcggagggggggtgaagggctcgctcttcacgggatctcgcccg

SEQ ID NO: 63212 - protein, 49 aa, Zea mays
  misc_feature: Ceres CLONE 1530527
  misc_feature (4)..(4): Xaa is any aa, unknown, or other
  misc_feature (32)..(32): Xaa is any aa, unknown, or other
MDCXPPEQLPPSSAPACFLNPHWDQSMAARTXGDHLDLVSSPASKSEGG

SEQ ID NO: 63213 - DNA, 677 bp, Zea mays
  misc_feature: Ceres CLONE 1530528
  misc_feature: Translation starting site: 162
  misc_feature (582)..(582): n is a, c, t, g, unknown, or other
ctcaccgcggtggcggccgctctagaatagtggatcccccgggctgcaggaattcgtctcacccctagaaaaagaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctactctagaccccgctccccggaggggggggtgcgcggccgtgaaccgcaccgaggacgtggtggtcgccacgtccagcaactgctcgtactacctgcagggacagtccctgtccgcgcgggaccccctggccatcaacgaactgcctggaacttctgtcccccacgaatggacaaacttccgcgccagaaccgccgaacttgggttcccccggcgggaggggggttggcatcnccccggcttgttcccaagggcccccaggcccgcaaaaaataggaacaccctttataacggggtctttttggcgggcattaaaaaaacgggtagac

SEQ ID NO: 63214 - DNA, 711 bp, Zea mays
  misc_feature: Ceres CLONE 1530530
  misc_feature: Encodes the peptide sequence at SEQ ID NO. 63215
  misc_feature (1)..(1): n is a, c, t, g, unknown, or other
  misc_feature (33)..(33): n is a, c, t, g, unknown, or other
  misc_feature (39)..(39): n is a, c, t, g, unknown, or other
  misc_feature (348)..(348): n is a, c, t, g, unknown, or other
nggtttgagtcgtccaccaatcttccatatctngaactngtggatcccccgggctgcaggaattcgtctcacccctagaaaaaccaacctacaattgtcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaccnttctacctaaaagtgtcaatagttcaagaagttgatactatatacttatgcttgtctctgcacaccctataagttctaaatcaaataacaggtgctgcttgcagccttggatatttgcggatgcggagtgaagttaccatggcatccttgctaagaataagaaaattatggtggttttgaaaaaaaaaaaaaaaaaccaaaacccttcaaggaccccaattccccctaaagggagtccgatttcccccccccccctgggcgtcgttttacaacctctgaactgggaaaaacccggggtttccccaatttaaatccctttgaagaaaatcccccttttccccggttggggaaaaaaacaaaaaa

SEQ ID NO: 63215 - protein, 74 aa, Zea mays
  misc_feature: Ceres CLONE 1530530
  misc_feature (72)..(72): Xaa is any aa, unknown, or other
MSQAQPPRSQAQWKHVKFQDNQANAMKEPGTGGYGYGTKNDKNKDVDTIASDFIKLKHKAWALQKSTTMYHXST

SEQ ID NO: 63216 - DNA, 748 bp, Zea mays
  misc_feature: Ceres CLONE 1530538
  misc_feature: Encodes the peptide sequence at SEQ ID NO. 63217
ttcaccccttgtggtgtgcgggtgtgttatattttgggggtgtgtggtgaaaagggagggggggctccccgtggtggcggccgctctatagcgagttcctcccccgggcaggatgtatccctctcatccatagagagaaggtggtcatcagcgactaccatcgtcaggaggagaagctctgtttacacccgactggctctgatgcccctggggcagcgttcgggggacaagagcgactcccgctactcccgggtggaggttctcgacagagctgacgggggaggcgtacctgccgtcctaagtaactacctcgcctcaggcttcaacattatcctgcccccgacggttgatccagactcccgaccggagcccggcaccctggtaccagggacagtgccagaactagttctcggtacttcctagtggcactatcacaccacacgcgatgattggtgattggaccaaactggactctgaggacgacaggctcacagctggtaatcctagctcattctgaaagcgggagatcgcttgggccattctcacgtgtcacagcaaaggatgtcgtttgttcctgcaccccagtaagatttttttgcgggcccctaaagcctggaccttggggaatcaaatttatgcaaggccctcaccagaaaataaattttttcgggcttagggtggcctccaaagagaagtccctaactctagaagctaggggggaactgcttaatgatgagccacgctcccc

SEQ ID NO: 63217 - protein, 73 aa, Zea mays
  misc_feature: Ceres CLONE 1530538
  misc_feature: SWISSPROT Homolog: EC 2.1.1.125 Histone-arginine N-methyltransferase
MPLGQRSGDKSDSRYSRVEVLDRADGGGVPAVLSNYLASGFNIILPPTVDPDSRPEPGTLVPGTVPELVLGTS

SEQ ID NO: 63218 - DNA, 838 bp, Zea mays
  misc_feature: Ceres CLONE 1530540
  misc_feature: Encodes the peptide sequence at SEQ ID NO. 63219
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (25)..(25): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (65)..(65): n is a, c, t, g, unknown, or other
  misc_feature (66)..(66): n is a, c, t, g, unknown, or other
  misc_feature (509)..(509): n is a, c, t, g, unknown, or other
gggtggttggtnnnnnnannnanancagcgggggggataagggggcgggccccnnnnnnntatcnntgggcctccccgcgggtggcggccgctctagaactagtggatcccccgggctgcaggaatgtcgtctcacccctagaaaaataagcaggacctgaaggacgccatggcacccgcggagatcaccgatgccctctcgctccacagcataaaggaccacgactggcacatccaggcctcgtgtgccatcaccggcgatggcctctacgacggcctgggctggatcgcgcagaaagtcgccggcaaggcgaccgcgagctgacgtgcaggagagcagtggttgtgtgttcatgaacggatgggatctgtttaaaggaaggggtggctgcaaggaccccttttgttttccttccttgggggttttgctccaaagccctacctaatgtgtggttgtgtgggaaaaaatggcctttggataattttttgtgttcccccccccccgggcnatcaattattgaatatgtgaggggagaaatctgcgcgtaaaaaccacccccccatgggaggggagattgtaattttcttgtgtcttttttgccctcattttctctggttattttatccgaatcccataacaaaatagttgttgtctcccgcgttctgggggggggcacccttattttgtctgctcccctacagcgggacgtgttctacgttttctgcgctgccgtctgctagagaacgccccccttttattcatgaggtggtttggaaggggcggaagaactcgccggggggttagtctactagtgtgaaaaacacccctataaccaca

SEQ ID NO: 63219 - protein, 51 aa, Zea mays
  misc_feature: Ceres CLONE 1530540
MAPAEITDALSLHSIKDHDWHIQASCAITGDGLYDGLGWIAQKVAGKATAS

SEQ ID NO: 63220 - DNA, 716 bp, Zea mays
  misc_feature: Ceres CLONE 1530547
  misc_feature: Encodes the peptide sequence at SEQ ID NO. 63221
  misc_feature (716)..(716): n is a, c, t, g, unknown, or other
ggagctccccgcggtggcggccgctctagaactagtggatcccccgggctgcaggaattcgtctcacccctagaaaaaaccactcctacataccggtccctgtccctgtcgatccctcgcaaggatcccacgatggtgaagttctcgcgggagtacgaggccagcatcatccccgagtggaaggccgccttcgtcgactacaagggcctcaagaagctcgtcaagaggatcaagatcgcccgccgcgaccgcgacgcccgtagtaccagcaacgaccacgacgacgccaccaccaccagctatggcttctccgtcctcgaccccgtccgcgccctcgcctcccacttcaacaacgccacgcccccggcctcgccagagggcggcagcgacgacgacgccttgaggaccttggaatcggattcaggggagctcgtgagagccacggacaagcatgagcaagagtttgtggagagggcggacgaggagctggagaaggtgaacaagttctacgcggcgcaggaggcggacatgctggcgcgcggcgacgcgctcatcgagcagctccgcatcctggcggacgtcaagcggatcctcgccgaccacgcggcggcgtcgtcccggcgcggccgcgcgaggctcgcccggaccggcgggaactcgtcgccgccgtccgtggacggctcccacagcggccggcacctcctctctttctcctn

SEQ ID NO: 63221 - protein, 194 aa, Zea mays
  misc_feature: Ceres CLONE 1530547
  misc_feature (2)..(185): Pfam Name: SPX Pfam Description: SPX domain
MVKFSREYEASIIPEWKAAFVDYKGLKKLVKRIKIARRDRDARSTSNDHDDATTTSYGFSVLDPVRALASHFNNATPPASPEGGSDDDALRTLESDSGELVRATDKHEQEFVERADEELEKVNKFYAAQEADMLARGDALIEQLRILADVKRILADHAAASSRRGRARLARTGGNSSPPSVDGSHSGRHLLSFS

SEQ ID NO: 63222 - DNA, 675 bp, Zea mays
  misc_feature: Ceres CLONE 1530548
  misc_feature: Translation starting site: 150
tggagctccccgcggtggcggccgctctagaactagtggatcccccgggctgcaggaattcgtctcacccctagaaaaaagatcctcgcatcgtccgcaccttatcctctcgactttacagtacctgctctcagctcctccctatctcaatggcatccgcgaatgccatctccaccgcctccctcctccggcccctctctcagggcagggcgacgaggtcacagcggttcgtggtgcgtgcgaacgccaaagacattgcctttgaccagaaatccagggcagcgctgcaggccggcgtcgagaagctggcaaacgccgtcggtgtcaccctcgggccacgaggggaggaatgtggtgctcgatgagtacggcaacccccaaagtgtgaatgatggagtcactattgcccgtgctattgagctgtatgatccaatggaaatgcttgtgcagcattgattcctgaaggtgctagcaagaccatgattcgctggtgatgggactaacactgcatcccgtccttgctcggaaaacatcaagctaggccttcctgaatgttaaatctgggggcaatcccgggtctccttaaagaaagggattgacaaaacttgtggcggggcccaattccgggagccttgaaaaaaacctatacaccccaagggggggggggggaaatat

SEQ ID NO: 63223 - DNA, 606 bp, Zea mays
  misc_feature: Ceres CLONE 1530549
gctggagctcaccgcggtggcggccgctctataactagtggatcccccgggctgcaggaattcgtctcacccctagaaaaatccctaatcccagcgcagcacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcaggagtccatggccgcccgcgtcttgctccggcgccggggaccggggtcgctggggcggcctccgctcgggcttccctgtgggcgtgggggcctccgccctgctgtcctccttatgaggcccccgggccggggaggtttctatctaattttggcggggaatcccccccagggtgtcccccccccctccccttttgaaaaaaaaatgtgtggggactttttttttttttgaaaaaaggtgggggaatatttcccccccaaaaacaaaaaaaaaaaaaaccgcaaccccccccagggggccccccaatttcccccccctttgatgggggggggtctatttttccccccccccctcttcttgtgg

SEQ ID NO: 63224 - DNA, 671 bp, Zea mays
  misc_feature: Ceres CLONE 1530553
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaactctcgaaaccctagttctctgttacttctcccgccgccgccaatcccctcccgttctccgccaccttgatagcccggggtagaattacctgcctatatttatcgtccttgtggtctgcaagaatcatgacgttattacttaggcacttattcatcttactatctggaagtgatgtgatttgttttggtaaaaaaaaaaaaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatctcttataaatcaaaagaatagaccgagatagggtttgagtgttgttccaggtttgggacaggagtc

SEQ ID NO: 63225 - DNA, 653 bp, Zea mays
  misc_feature: Ceres CLONE 1530554
  misc_feature: Encodes the peptide sequence at SEQ ID NO. 63226
  misc_feature (139)..(139): n is a, c, t, g, unknown, or other
  misc_feature (140)..(140): n is a, c, t, g, unknown, or other
  misc_feature (437)..(437): n is a, c, t, g, unknown, or other
  misc_feature (505)..(505): n is a, c, t, g, unknown, or other
  misc_feature (550)..(550): n is a, c, t, g, unknown, or other
ctccccgcggtggcggccgctctagaactagtggatcccccgggctgcaggaattcgtctcacccctagaaaaaaaaactgactgattgtctgattgtgattgcggcagcaccgccgaccacgagcccgccgaaaggcnntcctccgcctgccgttccagggtgcactgccgccattgctcatctccccgtggtgcggaggtccacccgggcgccaattggtctcctctttcgttggcagactgagtggcatccaatcctgaatcaatgaggggctggggtttgctcgtgttatcgctacatgttctttcatgcctggttagtggcgttgcttctggtcgaacaagctcttatgtgcgcacagagttcccatctacagatatacctctagaaagtgaatggtttgctattccaaagggatacaatgctccacagcanggtcatatcactcaaggtgattatgatggaaagggcagtatagtatcttggggtactccagaaggccntggggccagtgaaagtatttatgggcaggagaagctatttgaccngaaagccgaaggaaccaacaccaactatacgttttacgatttacaattcctggatccatacaccattgccctggtccatggcccttaattttaacactaaaaa

SEQ ID NO: 63226 - protein, 123 aa, Zea mays
  misc_feature: Ceres CLONE 1530554
  misc_feature: SWISSPROT Homolog: EC 3.1.3.2 Acid phosphatase
  misc_feature (57)..(57): Xaa is any aa, unknown, or other
  misc_feature (80)..(80): Xaa is any aa, unknown, or other
  misc_feature (95)..(95): Xaa is any aa, unknown, or other
MRGWGLLVLSLHVLSCLVSGVASGRTSSYVRTEFPSTDIPLESEWFAIPKGYNAPQXGHITQGDYDGKGSIVSWGTPEGXGASESIYGQEKLFDXKAEGTNTNYTFYDLQFLDPYTIALVHGP

SEQ ID NO: 63227 - DNA, 660 bp, Zea mays
  misc_feature: Ceres CLONE 1530563
  misc_feature: Encodes the peptide sequence at SEQ ID NO. 63228
ggagctccccgcggtggcggccgctctagaactagtggatcccccgggctgcaggaattcgtctcacccctagaaaaactcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcacacgatcaagaatgctgttgtcacggtccctgcctactttcacgactcac

SEQ ID NO: 63228 - protein, 157 aa, Zea mays
  misc_feature: Ceres CLONE 1530563
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISSMVLIKMREIAEAYLGTRSRMLLSRSLPTFTTH

SEQ ID NO: 63229 - DNA, 730 bp, Zea mays
  misc_feature: Ceres CLONE 1530566
  misc_feature: Encodes the peptide sequence at SEQ ID NO. 63230
  misc_feature (730)..(730): n is a, c, t, g, unknown, or other
ctggagctccccgcggtggcggccgctctagaactagtggatcccccgggctgcaggaattcgtctcacccctagaaaaaaccccgtccaacgcaaacgagagggaaagccgaagcgagtgcgagtgcggccctcagctgctgcagttgctcctgctcgtttctgcctgctcgtttctgcggcggcggcggcggcggcggcctagcacctgagcggggcggcgagaggggacggagatggatatcgcgcgggcggctgctggcgtggcctgctgcaaggagcaccagaggatctacgccgagtggttcgccctggccgacccagatggcgacggccgcgtcacgggcgccgatgccaccagcttcttcgccatgtccgcgctttcacgcgccgatctcaagcacgcgcgggcgatcgcggattccaggcggcaggggtacctcggattcgccgagttcgtcacagcaatgcagctcgtgtctctggcccaagcagggaacgagatcacacaggacagtctgaaacgtgaaggtgttgatgagctactggctagatccaaggctgttgtgaagagagttcacccagatgacaatggcaccactcaggcccaagcaccttccatatatcactaggtttggttcaaaatcagcacagaaagtgcagatgcctctgactgctgttacctctgtaaatgatgggctgaaaagactctatgttgaaaaactggagn

SEQ ID NO: 63230 - protein, 131 aa, Zea mays
  misc_feature: Ceres CLONE 1530566
MDIARAAAGVACCKEHQRIYAEWFALADPDGDGRVTGADATSFFAMSALSRADLKHARAIADSRRQGYLGFAEFVTAMQLVSLAQAGNEITQDSLKREGVDELLARSKAVVKRVHPDDNGTTQAQAPSIYH

SEQ ID NO: 63231 - DNA, 611 bp, Zea mays
  misc_feature: Ceres CLONE 1530569
  misc_feature: Translation starting site: 362
  misc_feature: SWISSPROT Homolog: EC 1.4.1.2 Glutamate dehydrogenase
  misc_feature (211)..(211): n is a, c, t, g, unknown, or other
  misc_feature (213)..(213): n is a, c, t, g, unknown, or other
  misc_feature (217)..(217): n is a, c, t, g, unknown, or other
  misc_feature (219)..(219): n is a, c, t, g, unknown, or other
  misc_feature (221)..(221): n is a, c, t, g, unknown, or other
  misc_feature (226)..(226): n is a, c, t, g, unknown, or other
  misc_feature (233)..(233): n is a, c, t, g, unknown, or other
  misc_feature (455)..(455): n is a, c, t, g, unknown, or other
  misc_feature (459)..(459): n is a, c, t, g, unknown, or other
  misc_feature (486)..(486): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacccngntttnancnttctntgggcgntcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccntcanggtcatttctgggcctggtgagagccnatgatttgtgtccagcacaagggtgaggagaaacagtttgcagctgaagagatctcctctatggggtctatcaagatgcggtgagattgctgaagcttacccttggtagcacgatcaaagattgc

SEQ ID NO: 63232 - DNA, 730 bp, Zea mays
  misc_feature: Ceres CLONE 1530570
  misc_feature: Translation starting site: 190
  misc_feature: SWISSPROT Homolog: EC 2.3.1.119 Icosanoyl-CoA synthase
  misc_feature (459)..(459): n is a, c, t, g, unknown, or other
  misc_feature (480)..(480): n is a, c, t, g, unknown, or other
  misc_feature (497)..(497): n is a, c, t, g, unknown, or other
  misc_feature (502)..(502): n is a, c, t, g, unknown, or other
  misc_feature (552)..(552): n is a, c, t, g, unknown, or other
aaagctggagctcaccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaggtgntgggggggaagcccactacgnacctcgcaccgtgctcngcttncctcgcgtcctcgcctttcacatctccgtctacatcatgtccaggcccanggcccgtgtacctcatcgacttcgcatgctacaagccggccgagaggctcaaggtgtccagggcgaattcatcgacctggcgcgcaagtcccgcaagtccgacaaagacagctgggcgttccagtcgcgtctgctggcaaatccggatcgggcaacaatcttaatgccccgcctgctg

SEQ ID NO: 63233 - DNA, 817 bp, Zea mays
  misc_feature: Ceres CLONE 1530581
  misc_feature: Encodes the peptide sequence at SEQ ID NO. 63234
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (53)..(53): n is a, c, t, g, unknown, or other
ttttgtttnnnnnnnngnnngtggtttngtgatgaacagaaaaaaaaaaaccntccaatggtgctccacgcggtggcggccgctctatactagtggatcccccgggctgcaggaattcgtctcacccctagaaaactcagtgttctcgactcgaccgccgccgtcccagttcgcttcgcgtcacccagagctcgtcggcctccgtccccgcgagaagcgagagcatggacacccaggtgaagcttgctgttgtggtgaaggtgatgggcaggacgggctccaggggtcaggggacccaggtcagagtgaagttcttggatgaccagaaccgtctcatcatgaggaacgtcaagggccctgttcgttaagggtgacatcctcaccctggctcgagcctgagaggggaggccaggaaggctgcccctccaaaccctgggtggccttgggatggaaattccggtttaattttggttggcgacatgcccccaaacctttgccgtgtggaaccttcacaaacatcctggttttggaaattttaacccacacccgtggaatggcaggttttccttagtttaaaaaatgaaaaaaccgattaccccctctgaggtgtacccctattttccccccctattaggggaggtctgttatttaccacggcgtctttttctggcgcggtgcgtgttttatcaacccgtcgtgggaatcgtgggaaaaagccccgggtgcgttttaccgcacactttaaatagccgcgctgtgggagaaaaatgtacaccgttttttcggctcggggtttgggggcttatttactcctaaa

SEQ ID NO: 63234 - protein, 47 aa, Zea mays
  misc_feature: Ceres CLONE 1530581
  misc_feature (1)..(48): Pfam Name: Ribosomal_S28e Pfam Description: Ribosomal protein S28e
MDTQVKLAVVVKVMGRTGSRGQGTQVRVKFLDDQNRLIMRNVKGPVR

SEQ ID NO: 63235 - DNA, 635 bp, Zea mays
  misc_feature: Ceres CLONE 1530591
tccccgcggtggcggccgctctagaactagtggatcccccgggctgcaggaattcgtctcacccctagaaatagggagtgcatccactcggacttccacgccccgtgtgggatgatcacttcctctacatcatgtgtctccctgatgtatctcagaacttcgccgagagtgtgcccatgttgcctgctggcgcaagtaacgtagagctgctcgacttcttcgtgcctctacaaccaagtcatcgctgtctacttcttcttgtcctttcctgtcttcttccccctgcatcatccacgccctgggatgcttgaaaggctgttgaacgcatctccgtacgcaattcactgtccgactacttcacttacgcgaactcactgctggacgtttccaccgcatccgcctggtaggctactgacgttacccaacttaatcgacttggacgctctccgtatttaattcgctgtataattagccaaaatgcccgcactcattgcccttcgtattcatgctcatcctgggtggaacatgtgaattgcccgcgttaatcttcttgcaaaattcgcgctcaatcgcctgctggatcaactccttatatgcacgaatcgatcgaccttggcaaaatctgttataactga

SEQ ID NO: 63236 - DNA, 678 bp, Zea mays
  misc_feature: Ceres CLONE 1530592
  misc_feature: Translation starting site: 279
  misc_feature: SWISSPROT Homolog: EC 3.2.1.4 Cellulase
  misc_feature: SWISSPROT Homolog: EC 3.2.1.23 Beta-galactosidase
  misc_feature (678)..(678): n is a, c, t, g, unknown, or other
ggagctccccgcggtggcggccgctctagaactagtggatcccccgggctgcaggaattcgtctcacccctagaaaaaacggctccaggtaccccggccgggtgcaccaccgcgccgcgtccatcgtgccgtacaagcacagcagggagttcatcggctgcacgcaggggttcgaccactggttcggccggcggggctccaaccccaatttgctcgtcggcgcgatcgtcggcgggccggacaggcgcgacaggttcagggacagccgcgacaactacatgcagacggaggcctgcacgtacaatacggccccgatggtcggcgtattcgctaagctgcgccggatggcgtggctggagcgggaacaggggtccacgtcggtgcccgtcaccgtcacgtccacggcggccgaggtgtaaatagataggatgtagaggaagggggctgtacaattttccccattctttagttcatttttttcgagctttgaatttcattttacacagatcgaggttattgtatacgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttn

SEQ ID NO: 63237 - DNA, 664 bp, Zea mays
  misc_feature: Ceres CLONE 1530603
  misc_feature: Encodes the peptide sequence at SEQ ID NO. 63238
  misc_feature (460)..(460): n is a, c, t, g, unknown, or other
  misc_feature (465)..(465): n is a, c, t, g, unknown, or other
ctggagctccccgcggtggcggccgctctagaactaggtggatcccccgggctgcaggaattcgtctcacccctagaaaaagccagctcgaccgacgagacgacaacgccgccgtgccgcgcgcacgcccgacgccgacgacacgccctccgctcggccccggtgaggcagcgaacgcccgccacacgtacagataccgtgcgcgcccggcatgggggtgaccaccgccggggaggccgtctgtaagtccccggcgcgggcctcggtcatcgtgaggctcaacgccgcgttcctcgccttcttcctcttcgcctacgtggcgctcctcctccaccccaagtactcgtgcctcctcgaccgcggcgccacctccctcgtccgctgcaccttccgcgactcctggccgccgccgtcgccgtcgaaccagcagctctcacggaaggtaagctgggaggcgtgncggcnaacatggtgcggatgaggagcgcatcgtgaacgcggggcgcgcgggcggcatggtcgacgagctccgggcccgctgcggatggggctgggtgacatcgggcgcaacaagctgctggcgctgggcgtgaaggggcacccggtgcccgtggacttcgagcgcgtgtcagacgcgtccggtggtcggacctgtcccggaatg

SEQ ID NO: 63238 - protein, 89 aa, Zea mays
  misc_feature: Ceres CLONE 1530603
  misc_feature (83)..(83): Xaa is any aa, unknown, or other
  misc_feature (85)..(85): Xaa is any aa, unknown, or other
MGVTTAGEAVCKSPARASVIVRLNAAFLAFFLFAYVALLLHPKYSCLLDRGATSLVRCTFRDSWPPPSPSNQQLSRKVSWEAXRXTWCG

SEQ ID NO: 63239 - DNA, 682 bp, Zea mays
  misc_feature: Ceres CLONE 1530605
  misc_feature: Encodes the peptide sequence at SEQ ID NO. 63240
tccccgcggtggcggccgctctagaactagtggatcccccgggctgcaggaattcgtctcacccctagaatgcccatccaaatgagccatcagaatctccttactttggctcatccgtgcattacggtggtcgggagttctacagcagcgttttacggaagcaaccagccaatgaaccccatacggattacaagggggacaacccggatggctctgctaccagaggtgattggtggcaaggttcactttattactgaataatctgctgggacctctcccttttgtgaacaaggtataccatatatgggacacttcaatacttcatagtttccaattcgcgttttccattagttgtgtttaggttatgcttgcatcaccggtgccagtcactttgttggcgctcccattttgagttatgtcttgttgtcaacaacatcatacagttgtatttagtttgttaccaccaaaaaaaaaaaaaaacgagacgctcgaggtaccccaatccgccctatagggaggtcgtattacgcgcggctccttggcccgtcgttttacaacgtccgtgacttgggaaaaaccctggggctttcccccaacttttaatcccccttggggagcccaaatccccccttttttccccagggtggggggttaaaaagccaaaaaagggcccccccccccc

SEQ ID NO: 63240 - protein, 63 aa, Zea mays
  misc_feature: Ceres CLONE 1530605
MPIQMSHQNLLTLAHPCITVVGSSTAAFYGSNQPMNPIRITRGTTRMALLPEVIGGKVHFITE

SEQ ID NO: 63241 - DNA, 716 bp, Zea mays
  misc_feature: Ceres CLONE 1530614
  misc_feature: Encodes the peptide sequence at SEQ ID NO. 63242
  misc_feature (517)..(517): n is a, c, t, g, unknown, or other
aaagctggagctccccgcggtggcggccgctctagaactagtggaacccccgggctgcaggaaatcgtctcacccctagaaaaatccggcatttattccgttgggcctcgcttccgatgcgccggagctcgcacgcgatgggagcgcaagcgtttcggctgctgctgcttctgctgctcgcggcggcggcggcggaggcgcccttcgttgtggagaaaacagcctgatggtgacgtcgccgacttcgttgcggggacgacacgacagcgctatagggaacttcggaatcccacagtacggcgggagcatggcgggcgccgtcgtctaccctaaggacaacgccaaggcttgcgacgatttcgacggcaggcaccccttccgtgccaagcctggcgcgatgcccacgttcctcctcatcgaccgcggtgagtgcttatttgcgaagaaggtttggaatgcacaaaatgctggtgcctctgcagtacttgtagttgatgacaaggatgaaccattgatnaccatggatttaccctcgtgaagatgacgaggcttcaaagtatatacaaaacataacccatcccttctgcattaataagatgaaaaaatggggtgaccagttgaagaaagctgttaaaaatggggaaaaaggggtaaatgtatccttgattgtggagggaaggctgtcccccatcccaattaccccgttttaatttaaa

SEQ ID NO: 63242 - protein, 103 aa, Zea mays
  misc_feature: Ceres CLONE 1530614
  misc_feature (23)..(104): Pfam Name: PA Pfam Description: PA domain
  misc_feature (97)..(97): Xaa is any aa, unknown, or other
MVTSPTSLRGRHDSAIGNFGIPQYGGSMAGAVVYPKDNAKACDDFDGRHPFRAKPGAMPTFLLIDRGECLFAKKVWNAQNAGASAVLVVDDKDEPLXTMDLPS

SEQ ID NO: 63243 - DNA, 658 bp, Zea mays
  misc_feature: Ceres CLONE 1530619
  misc_feature (135)..(135): n is a, c, t, g, unknown, or other
  misc_feature (136)..(136): n is a, c, t, g, unknown, or other
  misc_feature (142)..(142): n is a, c, t, g, unknown, or other
  misc_feature (232)..(232): n is a, c, t, g, unknown, or other
  misc_feature (237)..(237): n is a, c, t, g, unknown, or other
  misc_feature (378)..(378): n is a, c, t, g, unknown, or other
ggagctcaccgcggtggcggccgctctagactagtggatcccccgggctgcaggaattcgtctcaccccctagaaaagtgtgttagagaactatggctcacactgccagcattggttgatacgtttagctcttgnngaattngcctcttgtattcatctgctgctgctgtagttttcatttttgttttgttgtgaagaccacctataccacactttgatccaggttccgggnactanttaatatattgtgacactgaattgatgcccaaaaaaaaaaaaaaacgagacgctcgaggtaccaattcgccctatagtgagtcgtattacgcgcgctcactggccgtcgttttacacgtcgtgactgggaaaaccctggcnttaccccactttatcgcctccccccacacccccttttcgcaactggcgtattacgaagaggccccccccgatcgccctttcccacagttgcgcaccctgaatggccaaatgaaatttgaaaccgttaatatttttgtaaaaatttccgttaaaattttttgtaaattcagcttctttttttttaccccataggcccaaattcggcaaaaccccctttacaaatccaaaaaaattttcccaaaattgggcttcgagtggtcgtttccctttttgaaaccaa

SEQ ID NO: 63244 - DNA, 669 bp, Zea mays
  misc_feature: Ceres CLONE 1530620
  misc_feature: Encodes the peptide sequence at SEQ ID NO. 63245
ctccccgcggtggcggccgctctagaactagtggatcccccgggctgcaggaattcgtctcacccctagaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcacaaagaacactagctagtcatccttgccgacgacgatccatgtctctgtatctgcgtctgttcatatgcctgatgcccacctgtgctgtatgtagttgcttgaatccagcgtgttttgctaccgtaccccccccattgatcatcttgtcccgcgaccgcattatcctagtaataaccaggtccaaagattgtccccaaaaaaaaaaaaaaaccgagaccctcgggggcccccaattcccccctataggggaagtcgtttttaccgcgcccctccctggcccctcttttttacaacccgccgggcctggggaaaaaccccttggcggtttcccccaactttaag

SEQ ID NO: 63245 - protein, 59 aa, Zea mays
  misc_feature: Ceres CLONE 1530620
  misc_feature (6)..(56): Pfam Name: UPF0057 Pfam Description: Uncharacterized protein family UPF0057
MSEGTANCVDILIAIILPPLGVFLKYGCGHEFWICLLLTFLGYIPGIIYAIYAITKNTS

SEQ ID NO: 63246 - DNA, 707 bp, Zea mays
  misc_feature: Ceres CLONE 1530622
  misc_feature: Encodes the peptide sequence at SEQ ID NO. 63247
  misc_feature (707)..(707): n is a, c, t, g, unknown, or other
tcccccgggctgcaggaattcgtctcacccctagaaaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccgggatcatctacgccatctacgccatcaccaaagacaactagctggttatccttgcggacgaccaacccatgtctcttgtatcttgcttctgtttcttacgccccccccccccccttggggctgaatgtagcttgcttaacttccaattcgcggttttgctaccccttccccccccccttggcccttaccgtgttttcgggtgcccccggttatccttcatacttttacccagttcccctaaatcttgtttcttggtgtgaatgtggggggagagtgagctgaaaccctgtgcccccttgggggggtcctccaattcccctcccaaacgtcgaatccttatttccaccgcccctcctacttggtcactcgctcttttaacaatccttttttgacctgggaaaaaatactttgagcgttcccccccatatatacttcgtcgtn

SEQ ID NO: 63247 - protein, 58 aa, Zea mays
  misc_feature: Ceres CLONE 1530622
  misc_feature (6)..(56): Pfam Name: UPF0057 Pfam Description: Uncharacterized protein family UPF0057
MSEGTANCVDILIAIILPPLGVFLKYGCGHEFWICLLLTFLGYIPGIIYAIYAITKDN

SEQ ID NO: 63248 - DNA, 2006 bp, Zea mays
  misc_feature: Ceres CLONE 1530628
  misc_feature: Encodes the peptide sequence at SEQ ID NO. 63249
agtgccggtactggtaccgggccgaaatttgacccccctctctctgctgagcacacggccacacgccccaactctcgcgatggcggcctctgccgccgcggggcgctcgtgggacccagccgtctcgctgcggctgggccaccctgcgctggtgctcctcgagcggtgccgcggggcgcggccgttccgggccatccttgcccacctgctccgccttggcctcgccatggagacgttccctatgagccggctcctccattacgccactgtcgtgtcctccccgcgcctcacgcgcgaggctgagctcctcttccagcatttcacgccccgccccaatctctacatctataatctcatgctctccgcggcggcggcgcgcgactcctcctcgtcgccccaggcggcggctctctaccggtccatgctcgcgtcgtccgtcctccccgaccagcagacgttcctcgcgctgctgagatcggtggaacacctgtccgcggggaggcaggtgcacgcccatgtcgttgtgagtggtttgcactcgcgcgtgtacctgcggaactctctgatcaagatgtacatcgacgccggggatgtggagaccgccgagctgatgttccgttctgcactggtgttggataccgtgtcttgcaacatcatgctatctgggtatgtgaatgaagggtgcacccttaaggcgctgtggtttttccgtgatatggcaagccgggggattgttgttgatcagtatacggctgttgctctgctcacttgctgtgggcgcctgaagaacgagcttattgggaggtctgtccatggtgtcatcgtgcggagaatggatgcaggagatcatgggttgattctggtaaatgctcttttggacatgtatgcaaaatgtgggagaatgaacgcagcaaagacaatctttggtgaagctggtgagaaggatgccatttcatggaacaccatggtttcaggttttgtaaatgctggcatgttggaccttgctagcagatttttttctgaggcaccttccagggatctaatatcctggaacgcgcttctcgctggatatgctagatacaaaggtttcaatgaagtgatgaagctattccatgatatgcttgccagttgtgtaaatctggacaaggtgactgctgttaccttgatttctgcggccgcaggtaagggatcactgaatcatgcaaagagtgtccacggttgggtagtgaaagaatttggccatcaggatgcttttttggcatcggctcttgtagacatgtattgcaaatgtggaaatgttaaaatagcttactatgtgttcgagaaagccttggacaaagatgttaccttgtggacagctatgatctctggccttgcattcaatggccatggaactgaagcattggaactattttggaagatgcaaactgaggtcgtagcacctaatggtgtcacactgcttgctgttctcagtgcatgcagtcattctggtctgctggatgaaggatgtaagatttttgatgctatgaagcaaagatacagtattgaaccagggatagaacattttgggtgtatggttgatctccttgcacggtcaggtaggctgattgatgctttagctttggctaggaggatgcagatgaggccaagtcggtctatatggggttccattttaaatgcaagtttggctggtcaaaatattgaagttgcagaaattgcttcaaaagaactccttcgtcttgacccagcagaagaaggtggatacgtcttgctttccaacttgcatgcggctggaggtcactggaaccacagtgacaaagtgaggcagaacatggaaagaaaaggattgagaaaattagcaggtgctagtagttttggatcttgatgttgttgcttcacaagatcagatgccaggcaagactaccatttttttttgaaatgcaagcttgttccttctaatgaacggattaaatcttgtacatttcatgcaaaaaaaaaaaaaaaaa

SEQ ID NO: 63249 - protein, 601 aa, Zea mays
  misc_feature: Ceres CLONE 1530628
  misc_feature (188)..(222): Pfam Name: PPR Pfam Description: PPR repeat
  misc_feature (423)..(457): Pfam Name: PPR Pfam Description: PPR repeat
  misc_feature (322)..(356): Pfam Name: PPR Pfam Description: PPR repeat
MAASAAAGRSWDPAVSLRLGHPALVLLERCRGARPFRAILAHLLRLGLAMETFPMSRLLHYATVVSSPRLTREAELLFQHFTPRPNLYIYNLMLSAAAARDSSSSPQAAALYRSMLASSVLPDQQTFLALLRSVEHLSAGRQVHAHVVVSGLHSRVYLRNSLIKMYIDAGDVETAELMFRSALVLDTVSCNIMLSGYVNEGCTLKALWFFRDMASRGIVVDQYTAVALLTCCGRLKNELIGRSVHGVIVRRMDAGDHGLILVNALLDMYAKCGRMNAAKTIFGEAGEKDAISWNTMVSGFVNAGMLDLASRFFSEAPSRDLISWNALLAGYARYKGFNEVMKLFHDMLASCVNLDKVTAVTLISAAAGKGSLNHAKSVHGWVVKEFGHQDAFLASALVDMYCKCGNVKIAYYVFEKALDKDVTLWTAMISGLAFNGHGTEALELFWKMQTEVVAPNGVTLLAVLSACSHSGLLDEGCKIFDAMKQRYSIEPGIEHFGCMVDLLARSGRLIDALALARRMQMRPSRSIWGSILNASLAGQNIEVAEIASKELLRLDPAEEGGYVLLSNLHAAGGHWNHSDKVRQNMERKGLRKLAGASSFGS

SEQ ID NO: 63250 - DNA, 718 bp, Zea mays
  misc_feature: Ceres CLONE 1530631
  misc_feature: Encodes the peptide sequence at SEQ ID NO. 63251
  misc_feature (55)..(55): n is a, c, t, g, unknown, or other
ggagctcacgtcggtgggcaccgctctttgaactcgtggatcccccttgcttaangaattcgtctcacccctagaaaaaacgaatcactgctctgctttcaccccccgcatcgaacctcacccccgatctgatcgaatcgaaggctgcggcggcgatgggcggtgaccatggcggtgggcacgccggcggcgacttccgccagaaggtatggagcatgacgggcggcccctactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaaagaaggaatactgaaggacccccccaactagcatggagtggggggcaccttgcttttggcccttctttttgtggaaaacctgtgccctagcccttaatgcctggggttaagtgttaaggagccattctctggaaatgccttccccgtaagaatccttttggattccttcttttcccttcctggttaacagtgggaaaatggccctgatggaacctcaaattaatggccccggggggattccaaaaggcctgggggaatgaatttttacctccgagggggtttttggactccagggcaaaattgtgaaaaaccatgggtaatggtccc

SEQ ID NO: 63251 - protein, 88 aa, Zea mays
  misc_feature: Ceres CLONE 1530631
MGGDHGGGHAGGDFRQKVWSMTGGPYCRPVHWRRNTAIAMFGVFLICIPIAMKSAELEQRPHHPVRPIPSQLWCKNFGKEGILKDPPN

SEQ ID NO: 63252 - DNA, 633 bp, Zea mays
  misc_feature: Ceres CLONE 1530634
  misc_feature: Translation starting site: 223
  misc_feature (285)..(285): n is a, c, t, g, unknown, or other
  misc_feature (286)..(286): n is a, c, t, g, unknown, or other
  misc_feature (340)..(340): n is a, c, t, g, unknown, or other
ctggagctccccgcggtggcggccgctctagaactagtggatcccccgggctgcaggaattcgtctcacccctagaaaaaagccgcttccgccctctcccttccgtttccttcccaactcccaattcccaaccctggatccaaatcccaagctatcccggaaccgatacggaggggcgcaagcaattattagctggctagcccggcctgtagctccgagatcatgaagcgcgagtaccaaaacgccggcgggagcgacggctacatgggctcctccaagacaatnnatatgggcgggcagcggcggcgggggcaggggagcaggaggagggaggtggacnagctgctggcggcgctcgggtacaaggtgcgttcgtcggatatggcggacgtcgcgcagaagctagagcagctcgagatggccatgggggatgggcggcgcctgcccccacgctgatgacggggtcgtctcgcacctcgccacggacaccgtgcactacaatccctccgacctgtcgtcctgggtcgagagcatgctgtccgagctcaaggggcccccgccgccgctcccgcccgcgacgccgggacaaaggctcgcgtccacctcgtcacccgtcacaagtggcaccggcgc

SEQ ID NO: 63253 - DNA, 794 bp, Zea mays
  misc_feature: Ceres CLONE 1530637-R
  misc_feature (1)..(1): n is a, c, t, g, unknown, or other
nccgattgggtacctcaagcgtctcgtttttttttttttttttcgcagggggcaaatcactgggtgactcattctttgattccttcacagtaacaaaagatgcaaggaacaatagtactgtatgtgttagccagagacactactactgcgtgcttgtcttgcctccaagggttacaatacaacagaacattacaggctccaaatgccatggaaaatgctcctcagcctgctcccgccaagcctcttcacgatccgtttggcgtctgggacatcggcctccgcaagcttctcgagattcctgacgtgctccgaggacatgatcttcctccggccggagctgctgtccgtgaggtgcgccaccgtcgacagcaggaaccgcctcgccggcgcgggcttctccttctcctcgtcggggcccagcagctgcagcacccgcgccacgtcgcggtcctcctggacgaaccgcttccggttgcggggcacggtcaccagggcgcacagcgactcgcccgccatctcccgcgcctcgggggacttactggacgcgccgaggacgctcaccagctccggcatgaacccggcgtcgcccatcgccttcttcacctcctccgacacctggcacaggcggtgcgcggccttcagcgcgcagtgctgcagcagcgtgttgtcgccgttgcggaggaaggagaagacgcggtcgaggaacccggcggccgaggagacccccgttggacttggggcgcgacaggcacagcgcgtctatggcgcggaaggacacctcccgcaccttcgaa

SEQ ID NO: 63254 - DNA, 643 bp, Zea mays
  misc_feature: Ceres CLONE 1530637
  misc_feature: Encodes the peptide sequence at SEQ ID NO. 63255
agctccccgcggtggcggccgctctagaactagtggatcccccgggctgcaggaattcgtctcacccctagaaaaagtatcgtaggctttggtagtctggtgtggtcacttgtgtcgtcgtgccgctattccattcccctcgacctgcgctcgccgctccgccccaaagctcgccgatccccaggacaagggggcctcgtcgtcgcctcctcccgagagcccagcgcatgcatcaacagtgcacggtggggtgtgggtccgccgcccactgttggacccacccgcctccacctccattaactaccttgaagacggcaaagcggtcggtcgccttccagttcagcaccaccgtgcagttacagttatcacactacacgcaccgccacttccacctctcttctcttccttgctcgacgcgagcgcggcaagaatcggtgcatgtgagccttgttcggagaagagctaaccgatgcagctgaggctgtgagagctgtggttacagaggatgggggaagcagctggtgaggaagaatcctcggccgcgccggcggaggtgagccggcaagcggagctggatgagcagcggtgcctggcggaggcgctgcaggccatcgattcgttggtctctgcctccttgtcggcg

SEQ ID NO: 63255 - protein, 46 aa, Zea mays
  misc_feature: Ceres CLONE 1530637
MGEAAGEEESSAAPAEVSRQAELDEQRCLAEALQAIDSLVSASLSA

SEQ ID NO: 63256 - DNA, 961 bp, Zea mays
  misc_feature: Ceres CLONE 1530637-R2
  misc_feature (961)..(961): n is a, c, t, g, unknown, or other
ggaatacctgggtgactcattctttgattccttccagtaacaaaagatgcaaggaacaatagtactgtatgtgttagccagagacactactactgcgtgcttgtcttgcctccaagggttacaatacaacagaacattacaggctccaaatgccatggaaaatgctcctcagcctgctcccgccaagcctcttcacgatccgtttggcgtctgggacatcggcctccgcaagcttctcgagattcctgacgtgctccgaggacatgatcttcctccggccggagctgctgtccgtgaggtgcgccaccgtcgacagcaggaaccgcctcgccggcgcgggcttctccttctcctcgtcggggcccaccaacttcaacacccgcgctaagtgggggggcccccctgttgatacgcttccggtttgttgggatcggtcaccagggagcaccacgtactcgacctgaaatttgcccccgctctcggtggggacttaattgtaatgcttcaagagaactgtgaaccggtcatccggcgtggaaagacctgtgttatgatcaaatttgtctatctatcaaactccttccaataaagagagtaaatgaggtgagtaactgcctgctcttgttatcctctctcactaacctcctaacaccagtcgacgaatcgtctcgcccataaggcgggacgaaacggtgtataaataaccacccatcaccccaagaaacaccctctccactgacaattataaatcctcacaaatcattcatttagagaggcaggagttacaattaaaaagagacatgaatattatatgaacttagtaatcgactacaatctgtcatagaggacgccgttcgcgcatcgccaagaatggcctgccacgagctctgcgatcctaccaacttggcgggtaccgcagttatcccatgactgacgtatcatagtgggagacgggtcgccn

SEQ ID NO: 63257 - DNA, 671 bp, Zea mays
  misc_feature: Ceres CLONE 1530647
  misc_feature: SWISSPROT Homolog: EC 3.2.1.23 Beta-galactosidase
ctccccgcggtggcggccgctctagaactagtggatcccccgggctgcaggaattcgtctcacccctagaaaactagaaaaaactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacatattgtaataataagcatcgtacaatctgcatgctgttttgtaataattaattaatatcccagcccattggatggacttgttcaaaaaaaaaaaaaaaaacgagacgctcgaggtacccaattcgccctatagtgagtcgtatcacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccaacagttgcgcagcctgaatggcgaatggaaattgtaagcgttaatattttgttaaaattcgcgttaaatttttgtaaaatcagctcattttttttacccaaaggccgaaatcggcaaaatccctaataaata

SEQ ID NO: 63258 - DNA, 649 bp, Zea mays
  misc_feature: Ceres CLONE 1530656
  misc_feature: Encodes the peptide sequence at SEQ ID NO. 63259
  misc_feature (405)..(405): n is a, c, t, g, unknown, or other
  misc_feature (473)..(473): n is a, c, t, g, unknown, or other
  misc_feature (496)..(496): n is a, c, t, g, unknown, or other
  misc_feature (503)..(503): n is a, c, t, g, unknown, or other
  misc_feature (521)..(521): n is a, c, t, g, unknown, or other
  misc_feature (569)..(569): n is a, c, t, g, unknown, or other
  misc_feature (570)..(570): n is a, c, t, g, unknown, or other
agctccccgcggtggcggccgctctagaactagtggatcccccgggctgcaggaattcgtctcacccctagaaaaaaacttggccccaaatcgtggagtggaaaccctactcgtccccttccgcagccggtactcaaccccaaccctatcctgtccgccgccgtcgcccggcgcctcctcccccacctagaaacccagaggctctaatcctagttctttctgtgcagtcgccgcccaattcccccacccaattcccactctccgctcgacagatccatacatgtgagtagtagatcctctcttttttttcctcctctcagcggtttgaatttcgtgtgctgggtgcgagatccggcttctagggtttgcggcgttgacggtttgcgttccgcttcttctccgcangatgggagaggccaaggagaacgacgtttatgagggagagctcctggactacgagggagacgacgacnagacggtcgatggctccgctgcntagcccnaccggagagtcgcaaagnagggctacgtcgggatcccacagtccggtttcagagacttcctgctcnnagcagagctgctcgggctatcaggaattgtgttttgagcatcttccggagggtaactttcttcttgggagcagacatgg

SEQ ID NO: 63259 - protein, 30 aa, Zea mays
  misc_feature: Ceres CLONE 1530656
  misc_feature (23)..(23): Xaa is any aa, unknown, or other
MGEAKENDVYEGELLDYEGDDDXTVDGSAA

SEQ ID NO: 63260 - DNA, 717 bp, Zea mays
  misc_feature: Ceres CLONE 1530658
ccccgcggtggcggccgctctagaactagtggatcccccgggctgcaggaatgcgtctcacccctagaaaacaaatccagttttttgttgcgagaatgaaccgtgacgttagtgtgttttggctggcggttaggtgcaaaaatactcgaaacctggaattggcccgctcgctatttccgggttgtaagtttatgatgaatctgattttagttgcatggtgtacccatcttatcttaaaaataatgaaagatctggtttggggttgactaaaaaaaaaaaaaaaaacaagcccctccaggtacccaattcgcccctaaagggagtccttttaccgcgccctcccgggccctccttttttacacctcccgaccgggaaaaacgccgggggtttcccaactttattcgcctttgaagcccccccccgggtttccccagttggcgataatagcaaaaaaggccccccaccatatcccctttcccaccattttcccacgcctgaatgggacaagggaaattggaaagccgttaatatttttttgtaaaaattccccggggtaatttttttgtgaaaccccgcttatttttttttacccaaattcgcccaaaattcggaaaaattcccctttataaatcccaaataactttacccctgaaaagaggttgtagtttcttctcccctgttgtgggacacacgagcctccccctttttaaagacac

SEQ ID NO: 63261 - DNA, 708 bp, Zea mays
  misc_feature: Ceres CLONE 1530660
  misc_feature: Encodes the peptide sequence at SEQ ID NO. 63262
  misc_feature (244)..(244): n is a, c, t, g, unknown, or other
  misc_feature (245)..(245): n is a, c, t, g, unknown, or other
  misc_feature (656)..(656): n is a, c, t, g, unknown, or other
  misc_feature (708)..(708): n is a, c, t, g, unknown, or other
ctccccgcggtggcggccgctctagactagtggatcccccgggctgcaggaattcgtctcacccctagaaaaagtccccaacccgaaccgtgagatggctgagtacggcgagcgctaccagggcaacggcgaccaggccacggccgagggtggctatgcgcagaccgagtacgccgccggcgccggtggctcgccgccctccgacagcaatccctccgtgttctccgacccacgccgacgggcnncgctccctccccaggccccccagccatggagaacccccaaattcccccttggacacgggggggtttccctctcccaaaattttctccaagaaaaaaagggggcccccccaaaaaaaactgtggtttataaaaggggggccacagaggaaaccgggggggggaccccgggggggcccaaaaaaaaacccccctgtgttttctcccgccccccaaaaacaggggcaggaggtggggggccccccaaaaaacagggggggggaaaacagagggggtttttttctttaaaaaaaaagatggtgtgtagccacaaaaaaaaagcggcggggggttttgttctttttgttttttccccccccccccccccggggggggggggttttttttttttcgccgggggggggcgccctgctnttggttttttgtatggtggggggggaacccccccctcgcgggtgtttttttn

SEQ ID NO: 63262 - protein, 34 aa, Zea mays
  misc_feature: Ceres CLONE 1530660
MENPQIPPWTRGGFPLPKFSPRKKGGPPKKNCGL

SEQ ID NO: 63263 - DNA, 615 bp, Zea mays
  misc_feature: Ceres CLONE 1530662
  misc_feature: Translation starting site: 364
  misc_feature: SWISSPROT Homolog: EC 3.6.3.6 Proton-exporting ATPase
  misc_feature (386)..(386): n is a, c, t, g, unknown, or other
ctggagctccccgcggtggcggccgctctagaactagtggatcccccgggctgcaggaattcgtctcacccctagaaaaaatctcctcccgttccactcgacgcccaccaccactctctagtctcaccgccccccgtcccgctcattggacgagacgacggacccttcctttctcgcacgggaagagtagcgaggaggcgcggcgcccgtgcggcgtatgcccgtgcctgccgtcgggctccgcctctaggactagggtccgctccagcgccagccgtccgccatgggtgggctcgaggagatcaagaacgaagccgtcgatctggagaacatccccatcgagggagtgttcgagcagctgaaatgcacccgcgaggggctgagcntcagcgagggccagcagcgtctcgagatctttggccccacaggctcgaggagaagaagggagagcaggtccctcagtcccctggggtcatgtggaacccgctgtcatgggtcatggagatggctgcattcatggctatgcactcgccaacgggtggtggcagcccccgggactggcaggacttcgtcgggttcatcgtgctcttggggtatcaactccaccattccctt

SEQ ID NO: 63264 - DNA, 713 bp, Zea mays
  misc_feature: Ceres CLONE 1530665
  misc_feature: Encodes the peptide sequence at SEQ ID NO. 63265
ctggagctccccgcggtggcggccgctctagaactagtggatcccccgggctgcaggaattcgtctcacccctagaaaaatcagccgagtggttgtgccgtggaagctttcgtttaccgttcccatcccccgtcgtctctcctctccttcccactctcccacccgtcctccattgctcccttcctctctctcgcggagtcgctgcgatctaaccaccgagcacgagcgtcctactcgccgcggaccttgctcatggccgcggggtcgatccgggtcaccatggaggtgggcgccgacggcgtcgcgctcatcaccatcgccaacccgcccgtcaacgcgctccaccccatcatcatcgcggggctcaaggacaagtacgcggaggccttgcgccgtgacgacgttaaggcaatcgtgctcactggtgctggaggcaaagtctgtggaggatttgatatcaacgttttcacaaaaggtcatcagactggggatgtatcacttatgccggacgtatccgtcgagcttgtgtcaaacatgatgggaagagggaaaaaaaccttctgttgcagccatacaaggtcttgcaatggggtggtgggcctaaagttgaactatggggtggtcatgctcgggaattctcccccggagcctcaactggaattgccagaactaaccctggggatcctcccgggattgggaggaccccaggtttt

SEQ ID NO: 63265 - protein, 153 aa, Zea mays
  misc_feature: Ceres CLONE 1530665
  misc_feature: SWISSPROT Homolog: EC 4.1.3.36 Naphthoate synthase
MAAGSIRVTMEVGADGVALITIANPPVNALHPIIIAGLKDKYAEALRRDDVKAIVLTGAGGKVCGGFDINVFTKGHQTGDVSLMPDVSVELVSNMMGRGKKTFCCSHTRSCNGVVGLKLNYGVVMLGNSPPEPQLELPELTLGILPGLGGPQV

SEQ ID NO: 63266 - DNA, 831 bp, Zea mays
  misc_feature: Ceres CLONE 1530669
  misc_feature (12)..(12): n is a, c, t, g, unknown, or other
  misc_feature (13)..(13): n is a, c, t, g, unknown, or other
  misc_feature (33)..(33): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tttttttttttnntcctttttcttgctcccccnatgggttttnnnnnnnntttttggagctccccgcggtggcggccgctctagactagtggatcccccgggctgcaggaattcgtctcacccctagaaaaaaaaagaataacagtcagggatggtttgtttgccatgtgatcttgtacactcctacttaaattatggctgctgcacggtgctgctagcttgtactaataaagtgttgatctgcatgcttgcgtcttaatttgcgacacccttccaaaaaaaaaaaaaaaaacgagacgttcaaggtaccaatttcgccctatggtgaggccgtattaccgcgcgctccctgggcggttgtttttaaaacgttcgtggactggaaaaaaacccgggcgttttacccaattttaatccgcctttggaaccacatccccccctttttcggcggggttgggggttaattgccaaaaaaggccccgcacccgaacccccccctttgcccaaacatttttgcccctagcccctgtaatgggccgaaactgggtaaatttttttaaatccccgtcttaatattttctttggttaaaaaatttccgcccgttaccaactttttctggttaaaaaccacaacctcaattttttttttaacccaaaaaatgggctcgaaaatcccggcccaaaaatctccccttatttagtttccttgaagatacgacccccccaatatatgcgcgtttttattcgtttcccttcctttttcgatacccaagaaattcctcttcttttctacaaacaccgcttacttttccctccgttccaatatggccg

SEQ ID NO: 63267 - DNA, 710 bp, Zea mays
  misc_feature: Ceres CLONE 1530672
  misc_feature: Encodes the peptide sequence at SEQ ID NO. 63268
  misc_feature (508)..(508): n is a, c, t, g, unknown, or other
  misc_feature (588)..(588): n is a, c, t, g, unknown, or other
  misc_feature (710)..(710): n is a, c, t, g, unknown, or other
acgctggagctcaccgcggtggcggccgctctagaactagtggatcccccgggctgcaggaattcgtctcacccctagaaaaatatacctgaagtagcagcttcccttctccgtggaagacaacagaagaaaagggggtaggtaatcttcggcgccggcggccgccggtccccgcgatggacgcggagaccggagatacccggtctcccctgctgccgcatccccctcccagccagacgcaggtttcctcagcgaatcagcactataacaaacccttcagctggaaggccccagccattattttggccttcgaattcttggagagcattgcttactctggtatagcactcaacctggtcgtgtaccttggaaccgtcctccatggaaccaccgcctccaatgcagcgaacgtcgatgcgtggaacggcgccacgtttcttacgccggtccttggagcctttcttgctgatacatactgggggaagtacaagaccgcagctatctccantatattctacgttgttggcctgctcataattaccacctctgccgtcataccgtccctacggcctgcctcgtgtgaaggcngttcatgccccacctgcacagggtttcagtattttgtgctctttggttcattgtacctcatctccattggtacggggggcgtcaagtcacctttacttccatgggagcagatcagtacaatn

SEQ ID NO: 63268 - protein, 177 aa, Zea mays
  misc_feature: Ceres CLONE 1530672
  misc_feature (111)..(111): Xaa is any aa, unknown, or other
  misc_feature (138)..(138): Xaa is any aa, unknown, or other
MDAETGDTRSPLLPHPPPSQTQVSSANQHYNKPFSWKAPAIILAFEFLESIAYSGIALNLVVYLGTVLHGTTASNAANVDAWNGATFLTPVLGAFLADTYWGKYKTAAISXIFYVVGLLIITTSAVIPSLRPASCEGXSCPTCTGFQYFVLFGSLYLISIGTGGVKSPLLPWEQIST

SEQ ID NO: 63269 - DNA, 666 bp, Zea mays
  misc_feature: Ceres CLONE 1530673
  misc_feature: Encodes the peptide sequence at SEQ ID NO. 63270
  misc_feature (543)..(543): n is a, c, t, g, unknown, or other
  misc_feature (548)..(548): n is a, c, t, g, unknown, or other
  misc_feature (629)..(629): n is a, c, t, g, unknown, or other
  misc_feature (644)..(644): n is a, c, t, g, unknown, or other
  misc_feature (657)..(657): n is a, c, t, g, unknown, or other
aaaactggagctcacggggtgggcggcggtccagaaaagtggatccccgggctgcaggaattcgtctcacccctagaaaaaaaagcctgggccctcattactgattggcccacctattaccttcctcctttgcgatttagaatcacccatatatctacctgctctcggtcctctgtgaactctctcgtcttctaggtttcccaggcctcaagataggcctctggaccaaagcttgaaagcagctgctgttcttgcctctttttttaattcttcatttcgtggttccctggatttttgggttcttaggtttcttgtatcttcccccaaccttgcaaaatcttgtggtgaagtttcttgcgttcgctgtttcgggaccatggacgaaaggattccgccgccgtccctcttgcaatactcgcagtcccctgctcattcttccccccatcccctcaattctatgaggtattcttcctctgaaaagaaaggtgagtgttgttcttgattttttttatttcttttgtcactattgttctccctgttgtnctggntgagttttgttttgtttttgatcctgccctttcggaatccttctgaagagcacgagatttgatgctgcgggtgaaattccngcttattctaaactnccggatgccatgnttccccctt

SEQ ID NO: 63270 - protein, 41 aa, Zea mays
  misc_feature: Ceres CLONE 1530673
MDERIPPPSLLQYSQSPAHSSPHPLNSMRYSSSEKKGECCS

SEQ ID NO: 63271 - DNA, 720 bp, Zea mays
  misc_feature: Ceres CLONE 1530674
  misc_feature: Encodes the peptide sequence at SEQ ID NO. 63272
  misc_feature (597)..(597): n is a, c, t, g, unknown, or other
gctggagctcaccgcgggtggcggccgctctagagatagtggaacccccgggctggcggaattcgtctcacccctagaaaaaagctgcctggctcgtgagtgtcggcgtgtcgggccacaacccgaacgctgaaccaaggctcgggaccgcgacactccgtgtgtccttctcctcagatctcgccggcggcggcatgctcccctcctccggcagcggctggggccgcggccgcggccgccacctattgctcagcagggccctagctctcgctgcactgctcgcgctcgcctccgcctccgagtccgaccacaagtacaaaactgaagagccagttaagctttgggtgaataaagttggcccttacaataatcctcaagaaacctacaactattacagccttccattttgtcaaccgtctgagaaccccacacataaatggggtggtcttggagaggtccttggtggaaatgagctgattgatagtcagcttgaaataaagttcttaaaaaacgtggagaaaggcttcatttgtacacttgagcttgatgctaaaaaggtccagcagtttgctgatgccattgaaagctcatattggnttcgaatttttatagatgatctgcctctttggggtttttgttggggagtcctgaacagaccagtgaaaaccagcattacctttacacacaaaagaacatccctggtaaatacaatgataacac

SEQ ID NO: 63272 - protein, 175 aa, Zea mays
  misc_feature: Ceres CLONE 1530674
  misc_feature (135)..(135): Xaa is any aa, unknown, or other
MLPSSGSGWGRGRGRHLLLSRALALAALLALASASESDHKYKTEEPVKLWVNKVGPYNNPQETYNYYSLPFCQPSENPTHKWGGLGEVLGGNELIDSQLEIKFLKNVEKGFICTLELDAKKVQQFADAIESSYWXRIFIDDLPLWGFCWGVLNRPVKTSITFTHKRTSLVNTMIT

SEQ ID NO: 63273 - DNA, 659 bp, Zea mays
  misc_feature: Ceres CLONE 1530691
  misc_feature: SWISSPROT Homolog: EC 3.2.1.23 Beta-galactosidase
ctccccgcggtggcggccgctctagaactagtggatcccccgggctgcaggaattcgtctcacccctagaaaaataagaaacacagtcgctgctcgccgtcaccactcgccaggcgccggttcttctccaatccacgactcagcggctctccagtcctccgtccgttaccgaatttaaagtgcaacgtgccgattctttatatgtacttctgaatgcttggacctggtgtgactacatagcctggtattcatttcataaatgatggaaagaagattgggacggcgttgtaggtcatgccctccaataatttctacccgatgtcgctccacattattctgatatggagcatgattagcagctttgtgattaagcattgccatgcttcggaaactcttatgacaaagataaaagagctgaacctcctcttcaatctcctccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttccccacagttgcgcagcctgaatg

SEQ ID NO: 63274 - DNA, 735 bp, Zea mays
  misc_feature: Ceres CLONE 1530692
  misc_feature (27)..(27): n is a, c, t, g, unknown, or other
  misc_feature (34)..(34): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (386)..(386): n is a, c, t, g, unknown, or other
  misc_feature (389)..(389): n is a, c, t, g, unknown, or other
  misc_feature (405)..(405): n is a, c, t, g, unknown, or other
  misc_feature (406)..(406): n is a, c, t, g, unknown, or other
  misc_feature (449)..(449): n is a, c, t, g, unknown, or other
  misc_feature (494)..(494): n is a, c, t, g, unknown, or other
  misc_feature (534)..(534): n is a, c, t, g, unknown, or other
  misc_feature (563)..(563): n is a, c, t, g, unknown, or other
  misc_feature (735)..(735): n is a, c, t, g, unknown, or other
ccccccccccctgcgttttttaaattntttggcnccccnnnntacannnnnnaaaaaaaaaaatccccgcgggggcggccgctctatactagtggatcccccgggctgcaggaatgtcgtctcacccctaaaaaaaaagaaaacagtcgctgctcgccgtcaccactcgccaggcgccggttcttctccaatccacgactcagcggctctccagtcctccgtccgttaccgaatttaaagtgcaacgtgccgattctttatatgtacttctgaaatgcttggacctggtgtgactacatagcctggtatttctttcctcaatgatggaaagaaaattggtacggcgttgtggggcagggcctccattatttttttcctatggtggnttntaattattctgatttnngccctttttttcccccctcccccggggggggagggggggtttngtaaatttttttggtcgtgtgttaagcattgagattcactccctnaatcacttgttgtgggcgccaccagagaccagacgcccgncgggagccattccgcccccaatttgggtnctaggacccccccccctccgcgcgccgcctatttcgccccacccgccccacccccacccctcccaccccccccccccgccctccccctaggcgtgaagccgccgtcgtgcgcgcccgcgccagcaacgcctacccgacgattaaacttcaagataaataccgccccgcgccn

SEQ ID NO: 63275 - DNA, 644 bp, Zea mays
  misc_feature: Ceres CLONE 1530699
  misc_feature: SWISSPROT Homolog: EC 3.2.1.23 Beta-galactosidase
  misc_feature (574)..(574): n is a, c, t, g, unknown, or other
ccgctctagaactagtggatcccccgggctgcaggaattcgtctcacccctagaaaaacccctagaaaaaccctagaaaaattgtcttctggagatggagttattcagttcacagcgaacgaataatacgatgttcttagtttcttttttttttcccgcttctttgtctgcgaggatttattggttaaattgtgtactagtcaattgttatggtacagcgaaaaagagagaagaggatgatggcattcgcagcgaggtgttgagattccgttgtagccatgcatttgcagccgattgtttggtactggtcaaagttctgtagtagtcataatactctgctcaaaatatagaaagaagaatggcttcgtcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagntgcgcagcctgaatggcgaatggaaattgtaagcgttaatattttgtaaaaattcgcgttaaatttttgt

SEQ ID NO: 63276 - DNA, 806 bp, Zea mays
  misc_feature: Ceres CLONE 1530701
  misc_feature (36)..(36): n is a, c, t, g, unknown, or other
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ttttttttttgggtgtgtgttttagttccccccccnnagctttattnnngttagttagggcgccccgggggggggggccctctacactagtggatccccccgggtggaggaagtcgtctcacccctagaaaaaatcacggagatcataccagctgctcaagttgtcaaaagtctggtcgctgaagcgaaggaagtcatcacacaaaagctttctggttaccaagagaatccttcctgaactgcaaactagaagtatctgtgtgtgagtagtccccaatcagattaatcggaagcaccaaggtttatgtttgattcttgcgctactccttcgtcccgtataggtacagaagaagaaaaaacgaaacgctcgaggtaaccaatcccccccacagcgactcggaatacgctctttttttccccccccttggaggagggggggggctggagaaccccttgtgtagcaaccccccctgggctgtagagcaggtctacttttgttctcgccgggtggcttacggcaaggagcctctccctcgttgcggcccatcctggacagtttagtgctactctatttgtgttcacgtctccatactagtaccctccaccactagggcggtgagagcatcacctttgcctagtggccgtcccgacctcccggccgtttttgtcgagataactttcctccgtcacattcgatagtactaaccctccctctctcagaaggggacacgagagccccccggcggaatcatttttgctcgtttttcataatgctgctccatgcataacccccccgtggggtgtgg

SEQ ID NO: 63277 - DNA, 660 bp, Zea mays
  misc_feature: Ceres CLONE 1530702
  misc_feature: SWISSPROT Homolog: EC 3.2.1.23 Beta-galactosidase
ctccccgcggtggcggccgctctagaactagtggatcccccgggctgcaggaattcgtctcacccctagaaaaagcacctccatgggcagatcctgcatccatcttccatctggccatgtctgtgctcgtccctgcccagcggccaaccacgctaacccggcctgctcccgtgctccaactcgccaaccattgctccggtgttatgctgtcgcgaaccagtgggctaccgtggccgggaaccgtactacttaaaccaccgcggtgaggacacgagtcatctgaagagcaagttggtacctggaatctcaagtcccaggtcaagaacaggtaccacaggataaggcgcatggaggatgctgcgatgtgttcgtgagagatctaggtcgtcgtctctcagtcaactttgggttgttggaccgttttctccttttgatgtaattatttatttattttgtatagaactcctattatatagtaaagatgtgatattcgagcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcg

SEQ ID NO: 63278 - DNA, 676 bp, Zea mays
  misc_feature: Ceres CLONE 1530711
  misc_feature: Encodes the peptide sequence at SEQ ID NO. 63279
  misc_feature (569)..(569): n is a, c, t, g, unknown, or other
ctggagctccccgcggtggcggccgctctagaactagtggatcccccgggctgcaggaattcgtctcacccctagaaaaagtccatcaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaaataagaacgttgtgactgggtgccatcgtcgccacaaaaaaaaaaaaaaaaacgagacgnctcgaggtacccaattcgcccctatagtgagtcgtattacgcgcgctcactgggccgtcgttttacaacgtcgtgactgggaaaacccctggcgttacccaacttaa

SEQ ID NO: 63279 - protein, 63 aa, Zea mays; identical to SEQ ID NO: 8705
  misc_feature: Ceres CLONE 1530711

SEQ ID NO: 63280 - DNA, 682 bp, Zea mays
  misc_feature: Ceres CLONE 1530713
  misc_feature: Encodes the peptide sequence at SEQ ID NO. 63281
ctggagctcaccgcggtggcggccgctctagaactagtggatcccccgggctgcaggaattcgtctcacccctagaaaaatccccccctctccacactgccaactcgctccgaagagggaggaggacgacgccggttgccactgccactgccgcgccgcgccgctcccgtctcccctccctccgcgggaactcgacgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgccttgccgcccaggcgggtggacgcggtcgcgatggtctccaacgcggagacggagacggagaaggagcaggaggaggcggcggccgccagcgaggagctgcccgtcatgccctgggccacctccgtcgcaagcggttacacccttttgagggatccacaccacaacaagggtcttgctttcacagaggaggaaagggatggacactacttgcgtggactgctccctccggcagtactatctcaggaactccaaattaagaagttcatgaacaccctgcggcagtaccagacccctttgcagcggtatatagctatgatgaacctt

SEQ ID NO: 63281 - protein, 160 aa, Zea mays
  misc_feature: Ceres CLONE 1530713
  misc_feature: SWISSPROT Homolog: EC 1.1.1.40 Malate dehydrogenase (oxaloacetate-decarboxylating) (NADP(+))
MLSTRTAAVAASASPASPWKLGGRSEGGASCDGCRTYRNTLRRRAAPAKVRALPPRRVDAVAMVSNAETETEKEQEEAAAASEELPVMPWATSVASGYTLLRDPHHNKGLAFTEEERDGHYLRGLLPPAVLSQELQIKKFMNTLRQYQTPLQRYIAMMNL

SEQ ID NO: 63282 - DNA, 664 bp, Zea mays
  misc_feature: Ceres CLONE 1530717
  misc_feature: Encodes the peptide sequence at SEQ ID NO. 63283
ctggagctccccgcggtggcggccgctctagaactagtggatcccccgggctgcaggaattcgtctcacccctagaaaaagaatctccattttcctcccgcaccaaaccagccaaaccactggcgcacgccgaggagagagaaagggggtgtgcggggcggcgaccggcctccgacgacgcggggcgtcgcggcgtcgtggcggtgaagcggatgaggctgtgggaggaggaagacgaggaggggatggaagtggacggggaggcggaagatgagccggggtggccgtgtggggcgccggaggcggggcccggctagacgaggccggcagcgatcctcgtggcggacgcggcggaggtcgacttccccgtcatctacgtcaacgccgccttcgaggccgccacggggtaccgcgcgcacgaggtgctcgggcggaactgccgattcctacaattccgggatccacatgcccaaaggcgacacccccttgttgatcccatggtcgtttcagagattcggcgatgcctcagcgaggggatcgaattccaaggcgagctgctgaatttccggaaggacggtgctccacttcacaacagattaaggctcgttcctatgcacggagatgatggctatgtgacgcatgttatcggaatccacctattctc

SEQ ID NO: 63283 - protein, 55 aa, Zea mays
  misc_feature: Ceres CLONE 1530717
  misc_feature: SWISSPROT Homolog: EC 2.7.11.1 Non-specific serine/threonine protein kinase
MVVSEIRRCLSEGIEFQGELLNFRKDGAPLHNRLRLVPMHGDDGYVTHVIGIHLF

SEQ ID NO: 63284 - DNA, 654 bp, Zea mays
  misc_feature: Ceres CLONE 1530718
  misc_feature: Encodes the peptide sequence at SEQ ID NO. 63285
ctcaccgcggtggcggccgctctagaactagtggatcccccgggctgcaggaattcgtctcacccctagaaaaacatggattcattctataactgctgctgctgctactactagctaggggcagccgtcggtcagtggagtgttgtgggtattgattgccgtccgtcgacggcttcaatcgctgcccgttccggtgcgactgcccgactgctatatagcgcagcagcagcagcagcagcctactactactactactgcttttaccggccggtggatcggatcaccaaaccggaacgacagcgatggaggccgggacgtgggcggcggcggccgtggcggccgtggcgctgtacgtggcctggttctggcggatgtcgcgcgggctcagcgggccgcgggtgtggccgctgctcggcagcctgccggggctcgtgcagcacgccgaggacatgcacgagtggatcgccgccaacctgcgccgcgcggggggcacgtaccagacctgcatcttcgccgtgcccggggtggcgcgccgtggcggcctggtcaccgtcacgtgcgacccccggaacctggagcacgtcctcaaggcgcgcttcgacaactaccccaagggccccttctggcacgccgtcttcagggacctgctcgggg

SEQ ID NO: 63285 - protein, 117 aa, Zea mays
  misc_feature: Ceres CLONE 1530718
MEAGTWAAAAVAAVALYVAWFWRMSRGLSGPRVWPLLGSLPGLVQHAEDMHEWIAANLRRAGGTYQTCIFAVPGVARRGGLVTVTCDPRNLEHVLKARFDNYPKGPFWHAVFRDLLG

SEQ ID NO: 63286 - DNA, 669 bp, Zea mays
  misc_feature: Ceres CLONE 1530721
  misc_feature: Encodes the peptide sequence at SEQ ID NO. 63287
  misc_feature (507)..(507): n is a, c, t, g, unknown, or other
  misc_feature (601)..(601): n is a, c, t, g, unknown, or other
ctggagctgcccgcggtggcggccgctctagaactagtggatcccccgggctgcaggaattcgtctcacccctagaaaaagtccacccattcctcgttcttccttaattcctcatttcctccacgtacgcgtgcatactctgcgagtccaggaggtattttcccccttcttcacgatactctcgacgagagcgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacgcgtcggtgcagagtgacgccaagctatggcctttcagggtgatcccgggctccggcgancagcccatgatcggggtgcagttcaggggcgagggagaacagttctcggcccgagagatcagctccatgatcctgaacagatgaaggagacggncggagcttacctcggcaacacccatcagaacgctgtcgtcaccgtcccgggctacttcaacgactccc

SEQ ID NO: 63287 - protein, 130 aa, Zea mays
  misc_feature: Ceres CLONE 1530721
  misc_feature (103)..(103): Xaa is any aa, unknown, or other
MAGKGDGPAIGIDLGTTYSCVGVWQHDRVEIIANDQGNRTTPSYVAFTDSERLVGDAAKNQVAMNPINTVFDAKRLIGRRFSDASVQSDAKLWPFRVIPGSGXQPMIGVQFRGEGEQFSAREISSMILNR

SEQ ID NO: 63288 - DNA, 862 bp, Zea mays
  misc_feature: Ceres CLONE 1530723
  misc_feature: Encodes the peptide sequence at SEQ ID NO. 63289
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (26)..(26): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (678)..(678): n is a, c, t, g, unknown, or other
tccttttggtggggganannaaatnnttctntnntggatgttnnnnnnnnnnnnnnnnctccccgcggtggcggccgctctagactagtggatcccccgggctgcaggaattcgtctcacccctagaaaaaaaaaagcgaaaggagagaaggaatccgatccatccaagccaagccaaggcagagaagaagaagaagaggaggaagaagaagccccggcagcatgtcggacgggactgcctactgcgtggacatcctgatcgccatcatcctgcctccgctgggggtgttcctcaagtacgggtgcggccacaagttctggatttgcctcctcctcactttcctcggctaaagtcgcgcggaatctctaacgcattctacgccatccaccaagaaaaaactagcttagtcatgcctttgtgaaggaagaatccagggcgggggggggggggcccctgttttctatggccttgaaggccccccctcggggttgggaggtaacttcgcctatgaaccccccgccccggtttcttgctcggccgtgacccctcccgccgtggctcctcactctcgtcccccggccggccccccagcaagacccttgtggataatacaacgcggttttctaccaatttctagattctcttgccgcgcttggtgcatctacctcttcctcccnttcccgtcccatgcgctcccccttatctcccgcctccactttctggtggccgccagcttttgggtggtgcggtcctcggtggccccccattcttgttcctcgactgccgcgccacgtcccggggggaaaggccgccgcccgcccgtctgacggatgactgatcacccccacctggaacgcccta

SEQ ID NO: 63289 - protein, 42 aa, Zea mays
  misc_feature: Ceres CLONE 1530723
  misc_feature (6)..(42): Pfam Name: UPF0057 Pfam Description: Uncharacterized protein family UPF0057
MSDGTAYCVDILIAIILPPLGVFLKYGCGHKFWICLLLTFLG

SEQ ID NO: 63290 - DNA, 634 bp, Zea mays
  misc_feature: Ceres CLONE 1530724
  misc_feature: Encodes the peptide sequence at SEQ ID NO. 63291
  misc_feature (306)..(306): n is a, c, t, g, unknown, or other
ccccgcggtggcggccgctctagaactagtggatcccccgggctgcaggaattcgtctcacccctagaaaaaaccgtccacctcagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttncagtacgacaccgtgcacggccaatggaagcacagcgacatcacccctcaggactcccagacgctttctcttcgcgagaagcccgtcaccgtctttggcatcaggaacccccgaggagatcccgtgggggtgaggctggtgcttatttatgtcggggaatcccaccggtgtctttccctgacaaagaaaaaggcttcttccacatttgaaaagggggggcccaaaaaggttttttatttctccccccacaaaaagagccccccctttttgtttttggggtacaaaagaaggcaaaaacccccccccgagttaaaatttttttccacga

SEQ ID NO: 63291 - protein, 156 aa, Zea mays
  misc_feature: Ceres CLONE 1530724
  misc_feature (4)..(145): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (47)..(47): Xaa is any aa, unknown, or other
MGKIKIGINGFGRIGRLVARVALQSEDVELVAVNDPFITTDYMTYMXQYDTVHGQWKHSDITPQDSQTLSLREKPVTVFGIRNPRGDPVGVRLVLIYVGESHRCLSLTKKKASSTFEKGGPKKVFYFSPHKKSPPFLFLGYKRRQKPPPELKFFST

SEQ ID NO: 63292 - DNA, 666 bp, Zea mays
  misc_feature: Ceres CLONE 1530727
  misc_feature: Encodes the peptide sequence at SEQ ID NO. 63293
ctggagctccccgcggtggcggccgctctagaactagtggatcccccgggctgcaggaattcgtctcacccctagaaaaaacgcagctgcgtggtgcgcacaaagcgaactattctttcgccttttactaaagaataccgtgtgtgcgccatacaaagcagcatacgcttatttttggagggtgttttctctttttgagaaggccccacacgaaaaaggaaaaaaaaaaaaaaaaaaaaaaaaaaaaaaaaaaaaaaaaaaaaaaaaaaaaaaacaaaaaaaataaaaaattcacggctctcgatgcaccaattaccccctttaaatggtcgtatttttacggcacaatgactgaaaatgggctgccgtagacccccaaaacccccttagtgaatatctttattccccctgcaggagtccttttttttaccccctgggagaggaaaaaccccagcggcccccaattttattcggtaaagggaaatcgccattgtgaaaagtggaaataaaaaaaaagaaccttttcctaaaatcccccccaattttttggccccctcttcggggtcggggaaacttcaacgccaataaatttattaaacttccttggtaaaattttgttaaaccccgttggttttttttaaccccccaggccaaaaacgggaaatc

SEQ ID NO: 63293 - protein, 42 aa, Zea mays
  misc_feature: Ceres CLONE 1530727
GAPRGGGRSRTSGSPGLQEFVSPLEKTQLRGAHKANYSFAFY

SEQ ID NO: 63294 - DNA, 723 bp, Zea mays
  misc_feature: Ceres CLONE 1530728
  misc_feature: Encodes the peptide sequence at SEQ ID NO. 63295
ctggagctcaccgcggtggcggccgctctagactagtggatcccccgggctgcaggaattcgtctcacccctagaaaaagacctgcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtgggaacaactgggcttctgatcttgggcccgtcacctcgctgggaatcctcgggggggggggccctcctcgtttaaaaaaaccagggcccttttcgggttaaggaaattccaagggagggccctttttgggaattcccaaggaaaaaacaggggggtctgtttaaaaacccgcccccccgggggaggcccaacccttcccctggaaaaaaaaaaaaaggggccccctttttaaaaaaaatttgggggccctaaattttaaaaaaaaa

SEQ ID NO: 63295 - protein, 130 aa, Zea mays
  misc_feature: Ceres CLONE 1530728
  misc_feature (32)..(124): Pfam Name: PsbR Pfam Description: Photosystem II 10 kDa polypeptide PsbR
MAASMISSSALAVAPQGLPPLGRRASSFAVVCSKKKIKTDKPYGIGGGLTVDVDANGRKGKGKGVYQFVDKYGANVDGYSPIYNEDDWSPTGDVYVGGNNWASDLGPVTSLGILGGGGPPRLKKPGPFSG

SEQ ID NO: 63296 - DNA, 748 bp, Zea mays
  misc_feature: Ceres CLONE 1530729
  misc_feature: Encodes the peptide sequence at SEQ ID NO. 63297
  misc_feature (38)..(38): n is a, c, t, g, unknown, or other
ttttcccccccgtttttatccctctattccccgaaaangttacttaaatattgttgaaaatggagctccccgcggtggcggccgctctattactagtggatcccccgggctgcaggaattcgtctcacccctagaaaaactattgccggcctccggccgttgcggctattccatgagacaactgccacggcgttggcttatggcatttataagactgacctcccagagcatgaccagctaaacgtcgcgtttgttgatgttggtcatgctagcatgcaggtcagcattgtcggttacaagaagggacagctcaagatgctttcacatgcatatgaccgttctcttggcggcagggacttcgatgaggtcctcttcaagcactttgtggcaaagttcaaagaagagtacaagcttgacgtctaccagaatgcccgcgcatgccttaggttgcgtgtggcgcgtgagaagattaagaaggtgctgagtgccatcccagaggctccactgaacattgagtgcttgatggatgagaaggatgtgagacggtttattagaaggggacgagttttgaacacatcagtgcaccttgtgcttggacctgtcaaaggacccttggaaaaagccttgactggaacctggctttgaccaactgaaaatgtgcaccattgtttgagggttgccggaacctgggttctcgttgttcccgcccataatccgggaataatctccggaaatttttttgggaaag

SEQ ID NO: 63297 - protein, 123 aa, Zea mays
  misc_feature: Ceres CLONE 1530729
MQVSIVGYKKGQLKMLSHAYDRSLGGRDFDEVLFKHFVAKFKEEYKLDVYQNARACLRLRVAREKIKKVLSAIPEAPLNIECLMDEKDVRRFIRRGRVLNTSVHLVLGPVKGPLEKALTGTWL

SEQ ID NO: 63298 - DNA, 685 bp, Zea mays
  misc_feature: Ceres CLONE 1530736
  misc_feature: Encodes the peptide sequence at SEQ ID NO. 63299
ctggagctcaccgcggtggcggccgctctagaactagtggatcccccgggctgcaggaattcgtctcacccctagaaaaaagctggctggccaggctcctcctcctcggcctcgatccgcttctcctcctctgcccgcctacctggagcggggagcgggaagagcggcggcgggagcccggcattctgatccgcttctccgcgcgcaacaccggcctgccgcgaatgattcttgggaagccctgtacctgactactggatccactaccaagctcttcaagttccaggatccattcctctttgtcgggcaagagctcttggcctctgtggattatcagcctgattcacaactctctgcaagaattcgagcgcagatgggccaagaaagcgcggctgacgcgattcctggtttgatggtttctgttggtgtttcgggctaacagactctctttttttttgtttacttcctcaaagttccacttcaacatatggatccgggcttcccgagttggaatctgatcactcgcgtcagtgcttcttagcttccttcatttgccgtcatggaggagcagaactcatggcttattaggaccaagttctcccatactgtctacactagagtggatccacgaagagtagcagctgttgctccggtgggcaaagatgtggtgctgccttttgctccc

SEQ ID NO: 63299 - protein, 42 aa, Zea mays
  misc_feature: Ceres CLONE 1530736
MEEQNSWLIRTKFSHTVYTRVDPRRVAAVAPVGKDVVLPFAP

SEQ ID NO: 63300 - DNA, 679 bp, Zea mays
  misc_feature: Ceres CLONE 1530739
  misc_feature: Translation starting site: 480
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaagattagtttggcaccagtacctcactacctcgtgacagtggtcacatatttccaagacccctggaggctacacgcaccctcgtcagagatggatgtaaatatctctagagaaagaagaggtctggttctgattgctgtttacaggttagaggtgcagcgtatttacaaagagatataagagttatcacttatcatcagactgcttggtttgctaaataaaggtgaatttagttactagattatgagaaagcaaccacatcaaacatgaactgcggcttttgtgtcatcaaaaagctggcattgaggaaaatgagcctaagaatgcgagacccccgaggcccccatttccccctatagggagccgtattccccgcgctccctggccgtctttttacaactccatgacgggaaaaacccgggcgttccccaacttaatcgccttgaggcacatccccctttctccagctggtataataccgaaaaggcccgccccgttcgcccttcccaacatttgcgcagcctgaagggcaaatggaaattgcaagcgtttatatttcgtgaaagtccaaggaaaatttttgtaaatcaacctcttttttta

SEQ ID NO: 63301 - DNA, 538 bp, Zea mays
  misc_feature: Ceres CLONE 1530743
  misc_feature: Encodes the peptide sequence at SEQ ID NO. 63302
  misc_feature (294)..(294): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (472)..(472): n is a, c, t, g, unknown, or other
  misc_feature (473)..(473): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
ggcggtggcggccgctctagaactagtggatcccccgggctgcaggaattcgtctcacccctagaaaaatccctaatcccagcgcagcacaaacaaacaccgcgcccgccgcacagctttgccctacagatcttttactcccgagattctcagacgccctgatggctcccgcgtcgcctccgctctgctcttcgtgggggccgtctcgtggcctccggggggccagggatcattgggcccccgtttgctccggcccgggaaaggtccctgggcggccccccgccccggcccccncgttggggccggggtgcccccccttgtttccccctttttggggcccgtgggggaaagttcttcccttttttgggggatttttgccgggggccccccccccctttttttaaaaagggggccgcctttttttttaaaaaagggggggggcccccccaaaaannnnannnnnnaaaaaaannaaaaaattnnnnnggaaaaaagggggggggggggcccccccccctggggtggggtggcccccgcc

SEQ ID NO: 63302 - protein, 80 aa, Zea mays
  misc_feature: Ceres CLONE 1530743
  misc_feature (45)..(45): Xaa is any aa, unknown, or other
MAPASPPLCSSWGPSRGLRGARDHWAPVCSGPGKVPGRPPAPAPXLGPGCPPLFPPFWGPWGKVLPFFGGFLPGAPPPFF

SEQ ID NO: 63303 - DNA, 637 bp, Zea mays
  misc_feature: Ceres CLONE 1530745
  misc_feature: Translation starting site: 200
  misc_feature: Pfam Name: UPF0197 Pfam Description: Uncharacterised protein family (UPF0197)
  misc_feature (43)..(43): n is a, c, t, g, unknown, or other
  misc_feature (110)..(110): n is a, c, t, g, unknown, or other
  misc_feature (111)..(111): n is a, c, t, g, unknown, or other
  misc_feature (153)..(153): n is a, c, t, g, unknown, or other
  misc_feature (156)..(156): n is a, c, t, g, unknown, or other
  misc_feature (157)..(157): n is a, c, t, g, unknown, or other
  misc_feature (179)..(179): n is a, c, t, g, unknown, or other
  misc_feature (180)..(180): n is a, c, t, g, unknown, or other
  misc_feature (410)..(410): n is a, c, t, g, unknown, or other
  misc_feature (411)..(411): n is a, c, t, g, unknown, or other
ctcacccgcggtggcggccgctctagaactagtggatcccccngggctgcaggaattcgtctcacccctagaaaaaggctctgggtcgtcacaaagttggtttgtgcatnncgcggcggcgacaagggggggcgaacgaaaggcaggggcggnagnncgggcggggcgaactacagcgnngcagcagaaatctcacggaatggcggcgaaggcaatctcgagccccgtgccggtggagtggtacccgacgctggccgtcgtcatggtatccgtaggcctcatgttcgccgcctccttcttcatttatgaagcaacttcatcccggaggagccgtagccctgtcaaaggagatcgcaacagcagttgttgcttcctgttttcttgggctttgggtctctgttcgtgcttcnntgcagtggtgtttatgtctgatgactggctatggggcgtgtgtgcttgtgttctgcatccccgaggtgaaaacttgtttatgacgatccttaaaagctgttgccctaacgaatattaaagcattgaacttttccctaaacaatgttggggaaccccggaattaaagccaactttccctttccaaaaaaaaaaaaaaaaccaagacgcccgggggaccccatttccc

SEQ ID NO: 63304 - DNA, 616 bp, Zea mays
  misc_feature: Ceres CLONE 1530748
  misc_feature: Encodes the peptide sequence at SEQ ID NO. 63305
ggagctccccgcggtggcggccgctctagaactagtggatcccccgggctgcaggaattcgtctcacccctagaaaaagtgctcgtgctcgtcctctcccagcaccgtaaccaccgacagagcacgcaccatgacgaggaccaccaccagcagcacgctgctgacagcggcgctgctctgcctcgcgctgccgctgctccccggggccacggccaataaggcggcgcggcggcggcagggcgacaacctggcgcgcctgcgcgggtcgccgtggccggccgagtcgtcggtgtcgctggcggtcgcggcgacggatgacagagcgtcccggcacgcggcgtcgccgcccgcggggcgcagcaaggaggacgaccgcgtggacaagctgcccgggcagccgtcgggcgtggacttcgagcagtacgccgggtacgtgacggtggacgccgcggccgggcgcgcgctcttctactacctgaccgaggccgtctgcggcggggcggctgccaagcactcctctctggctcaacgaagcccgggtgctcgtcgctggggtacggcgcatggaagagctgggcccttttccggtggagagcgacggcaagaccctgtaccc

SEQ ID NO: 63305 - protein, 162 aa, Zea mays
  misc_feature: Ceres CLONE 1530748
  misc_feature: SWISSPROT Homolog: EC 3.4.16.6 Carboxypeptidase D
MTRTTTSSTLLTAALLCLALPLLPGATANKAARRRQGDNLARLRGSPWPAESSVSLAVAATDDRASRHAASPPAGRSKEDDRVDKLPGQPSGVDFEQYAGYVTVDAAAGRALFYYLTEAVCGGAAAKHSSLAQRSPGARRWGTAHGRAGPFSGGERRQDPVP

SEQ ID NO: 63306 - DNA, 584 bp, Zea mays
  misc_feature: Ceres CLONE 1530749
  misc_feature: Encodes the peptide sequence at SEQ ID NO. 63307
  misc_feature (317)..(317): n is a, c, t, g, unknown, or other
  misc_feature (325)..(325): n is a, c, t, g, unknown, or other
  misc_feature (480)..(480): n is a, c, t, g, unknown, or other
  misc_feature (481)..(481): n is a, c, t, g, unknown, or other
  misc_feature (484)..(484): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
gcggtggcggccgctctagaactagtggatcccccgggctgcaggaattcgtctcacccctagaaaaaacagcaaaggcggcactgctcaaaccacctctttggccacacacacgcatactgccaccgctactgcttcatcagcagctagcagcaagcggccggtggtgcagcgctgcgcctgcgccgggtaatcgaacacatggctcagatgatctcaaccatgcccatgctagacgccgccccggcctcgtcagccattatgcccaagctgccgcccgccgcctgcctggacgcgccgccggcctcgggcatcanccgttcgntgtctagggaaaaaagtttttcccccggaaacccccctttgggggggggggggaaaaaccaccgtttttcttccaaaaccccccagttggtgtggcccccccctctccaagaaagggggggtttttttttttgggggggagaaaacacagaaggnnggntttttttttgtttgnnnnngggggggggggcgggggtgggggggannnnnntttttcctccccccccccctttnnnnatcaacggggcccggggggggcg

SEQ ID NO: 63307 - protein, 127 aa, Zea mays
  misc_feature: Ceres CLONE 1530749
  misc_feature (39)..(39): Xaa is any aa, unknown, or other
  misc_feature (42)..(42): Xaa is any aa, unknown, or other
  misc_feature (94)..(94): Xaa is any aa, unknown, or other
  misc_feature (95)..(95): Xaa is any aa, unknown, or other
  misc_feature (100)..(100): Xaa is any aa, unknown, or other
  misc_feature (101)..(101): Xaa is any aa, unknown, or other
  misc_feature (110)..(110): Xaa is any aa, unknown, or other
  misc_feature (111)..(111): Xaa is any aa, unknown, or other
  misc_feature (112)..(112): Xaa is any aa, unknown, or other
  misc_feature (119)..(119): Xaa is any aa, unknown, or other
  misc_feature (120)..(120): Xaa is any aa, unknown, or other
MAQMISTMPMLDAAPASSAIMPKLPPAACLDAPPASGIXRSXSREKSFSPGNPPLGGGGKNHRFSSKTPQLVWPPPLQERGGFFFWGGENTEGXXFFCLXXGGGAGVGGXXXFPPPPPXXINGARGG

SEQ ID NO: 63308 - DNA, 638 bp, Zea mays
  misc_feature: Ceres CLONE 1530750
caccgcggtggcggccgctctagaactagtggatcccccgggctgcaggaattcgtctcacccctagaaaaaaccgcagagagaggacagaggagcgagccatcatccccccccgagccgtgccaaccaagagccatccacccaccaccaccaccccggccgcttccttgtccctgcccctccgttggtctcctttgcccatctcatcctctctctctctctccctctctctctctctggcggtcggcgtggctccgggggcgcgaagcgcgggctcggcggggcgactcgccggcggcgacctgcaggtttgggtatgagaggggtcacccacgcggcgcccaccacaagcgccccccgcccccgcggaacgctcatggacggccctctcatcttcgtcttctaactctcgctgcccaccctggcgggcccgaacacttcttaaaccccgcctctaattgtaacccccccccggcaccccattttttggaacccctcccaaaaaatttaatttgggggctaaaccgcccaccctcaccggggattctggactattggcccccccccccaaaggattccccccccgggaagtttttttccccccatttgggggggggaaaaaacctttttcccccccg

SEQ ID NO: 63309 - DNA, 683 bp, Zea mays
  misc_feature: Ceres CLONE 1530751
  misc_feature: Encodes the peptide sequence at SEQ ID NO. 63310
acactggagctccccgcggtggcggccgctctagaactagtggatcccccgggctgcaggaattcgtctcacccctagaaaaaatttttccccatttttacggacaccagcaagccacgccacactcccaatcgccgcagcagctggtcccctgctcggctcgtctgatccagcggctgaatccacaggccatggggttcgacaaggaggcgagctcctcctcctcgcggctcgacgcggcgccgctgctcccgcagcacggcggcggcggcgcgggcgggcacctgtcgtcgcagcccaagacgttcgccaacgtcttcatcgccgtcgtcggctcgggcgtgctgggcctcccctacaccttctcccgcacgggctgggcggcggggacgctgctgctcctcgccgtcgccgcgctcaccttccactgcatgatgctcctcgtcgcagcgcgccgccggatcgcggacgcgcaccccaagatcgcctccttcggggacctgggccacgccatctacggcgcgcccgggcgccacgcggtcgacgccatgctcgtgctcagccaggccagcttctgcgtcggctacctgatcttcatctccaacaccatggcgcacctctaccccatcgccatcggggcccagtccccggcgtcgccgctcctcacggccaaggcgctcttc

SEQ ID NO: 63310 - protein, 164 aa, Zea mays
  misc_feature: Ceres CLONE 1530751
MGFDKEASSSSSRLDAAPLLPQHGGGGAGGHLSSQPKTFANVFIAVVGSGVLGLPYTFSRTGWAAGTLLLLAVAALTFHCMMLLVAARRRIADAHPKIASFGDLGHAIYGAPGRHAVDAMLVLSQASFCVGYLIFISNTMAHLYPIAIGAQSPASPLLTAKALF

SEQ ID NO: 63311 - DNA, 602 bp, Zea mays
  misc_feature: Ceres CLONE 1530756
  misc_feature: Translation starting site: 247
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (58)..(58): n is a, c, t, g, unknown, or other
  misc_feature (59)..(59): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
tttccccccnnnnccccnnncnccnnncnnnntcccccctttncnncnnnccgccccnnccgnnntnnnnnnnnnnncaaannnnnccaagctggggctccccgcggtggcggccgctctagaactagtggatcccccgggctgcaggaattcgtctcacccctagaaaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgttcgagatcattgccaacgaccagggtacccgcaccacgcccctcgtaacgtcggctttcaccgacttccgaacggcctcattcggaaaatgcgggcccaaaaacaagggtcccccaatgaaaccccaattaaaccccggctttttaatgccaaaagggttttcaatctgggagggaggggttcaaggaaaaaccgtctcgtccccaaagaggaaaatcaaagtttttggggcccctttaaagggggaatttttggggggccccgggggaa

SEQ ID NO: 63312 - DNA, 672 bp, Zea mays
  misc_feature: Ceres CLONE 1530759
  misc_feature: Encodes the peptide sequence at SEQ ID NO. 63313
  misc_feature (672)..(672): n is a, c, t, g, unknown, or other
cacagtggcggccgctctagaactagtggatcccccgggctgcaggaattcgtctcacccctagaaaaaaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgggaaaataacccattataaagaactcccaattctttgtctcgctgctcccccccaacaaaaaaaaaaccgggggcgcctcggggcccccatttcccccctaaggggaggcgtatttccccccgccccccgggcccgtttttttaaaacgcccgggacggggaaaan

SEQ ID NO: 63313 - protein, 63 aa, Zea mays; identical to SEQ ID NO: 28299
  misc_feature: Ceres CLONE 1530759

SEQ ID NO: 63314 - DNA, 621 bp, Zea mays
  misc_feature: Ceres CLONE 1530763
  misc_feature: Pfam Name: MuDR Pfam Description: MuDR family transposase
  misc_feature (499)..(499): n is a, c, t, g, unknown, or other
  misc_feature (500)..(500): n is a, c, t, g, unknown, or other
  misc_feature (594)..(594): n is a, c, t, g, unknown, or other
  misc_feature (595)..(595): n is a, c, t, g, unknown, or other
ctccccgcggtggcggccgctctagaactagtggatcccccgggctgcaggaattcgtctcacccctagaaaaactatcaagaatgactcatctcgtgtgactgctgaatgtactggtgaaggttgcccatggcgaatacatgcttctaagtcccctgcaaagaaagaatttatggtcaagaaaatatctgaaagccacacctgtgaatctgaaacagtcaaaagcaatcggttggcttctcaacgatgggttgctagtgtcataaaagaaaagttgcgtgatagtccaaactacaggccaagagatattgcaaatgatcttcaacgagagtatggactatgcctgaactattcacaggcttggcgtggaagatcaattgctcagaaggaactttatagtacacacgaagaggcctgcagtcagttgccttggttttgtgaaaggattgtagagacaaaccctggaagtgtggcaactgtagtggcctttgaaagatcnnaagttcgtttttttggttgcattccatgcattcgctccctggggtttttaaaaagggggggggggcgccccctcttttttttttttgggggggnnttttttgccgccaaaaaaaaattggg

SEQ ID NO: 63315 - DNA, 721 bp, Zea mays
  misc_feature: Ceres CLONE 1530773
ctcaccgcggtggcggccgctctagtactagtggatcccccgggctgcaggaattcgtctcacccctagaaaaaacgcattctccctcttccgccagagtccagacggtgtgcttccacctgccgccgccggcgagctgcttgcctgcagcatgactccgcatcctggctgcctcgtcctacctccggcggctccttctccctgaaccccgtcgcgcgccaggacgcacgcctccttccgctgtcacacaagcacgcgggcgtactctgccgcatcgggacgcctccagacacctcgctcgtcagggcactccacctccgcctgcgaacgtccagcccagctccggcgagttcctccgcaattcccggatctgctggagcgccagcaaggaggcctctccaacccccccgagtccggaacagaaaggggggctgatctcccatggcccagtttcataaccgttgaatgattcaaaaatctacgaaactggattgatccttggcatattgcgacccttcaaatattttgaaaggcccctgctgggtttttaaaaaccaaaggggttcgggtcttgtatttgggaaggaaagcggaagcaaggcctaattaattgggcaagtttgccttccaaaacgaatttgctcctcccgggggggaagtcactcggaaaaaagaaaccccccacttatttttatatgggcccacaaacaaaacaattaaa

SEQ ID NO: 63316 - DNA, 600 bp, Zea mays
  misc_feature: Ceres CLONE 1530777
  misc_feature: Encodes the peptide sequence at SEQ ID NO. 63317
  misc_feature (409)..(409): n is a, c, t, g, unknown, or other
cgcggtggcggccgctctagaactagtggatcccccgggctgcaggaattcgtctcacccctagaaaaccctcgcaccctaaaacagcggcgcacaagatgtccgacgaccccaccaacggcggcggcggtgatcgcgtggaggacgtcgtccgcaccgagggtgaaacacaacctcgtgatgatggcttgtcgaaatccaaggatagggacaaagatagagaaaaggacaaggacagagatcgtcgcagagaccgtgacagagatcgagggagagacagggaccgtgatagggacagggacagggatcgggacagagacaaggatcgccaaagtaggcatcaccgtgaaagacgggaacagcgagaccgtcctgatgatcacagagtccgtgattctgaaaggagaangagacgccacaaagatgggcatcgtaggcatcgttcttcggctcgttcagggggtagagattcgaaaattagggtccgttcaaaagccagcgaattaatgggattcaaagggcccccccccccaagcaatggggtcaacattttccggttttttcaaccccaaccaacctttttttgggaaaaagggccat

SEQ ID NO: 63317 - protein, 167 aa, Zea mays
  misc_feature: Ceres CLONE 1530777
  misc_feature (104)..(104): Xaa is any aa, unknown, or other
MSDDPTNGGGGDRVEDVVRTEGETQPRDDGLSKSKDRDKDREKDKDRDRRRDRDRDRGRDRDRDRDRDRDRDRDKDRQSRHHRERREQRDRPDDHRVRDSERRXRRHKDGHRRHRSSARSGGRDSKIRVRSKASELMGFKGPPPPSNGVNIFRFFQPQPTFFWEKGP

SEQ ID NO: 63318 - DNA, 562 bp, Zea mays
  misc_feature: Ceres CLONE 1530780
  misc_feature: Encodes the peptide sequence at SEQ ID NO. 63319
  misc_feature (274)..(274): n is a, c, t, g, unknown, or other
  misc_feature (322)..(322): n is a, c, t, g, unknown, or other
  misc_feature (327)..(327): n is a, c, t, g, unknown, or other
  misc_feature (430)..(430): n is a, c, t, g, unknown, or other
  misc_feature (431)..(431): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
tacccgcggtggcggccgctctagaactagtggatcccccgggctgcaggaattcgtctcacccctagaaaaaagagccggtcgaggcacgccactccgcagtgtcagtcactgccccccccatcacgccgcccgccctttctcggccgttgccgcgagctcgctccgacccaccgccaatggcgacggcgatgggcgcgatggccgccacctgcatggcctcgatgccggccgccgctacgttccccggtgatctcggcgtcggacgacgccngagcggctgtaccaggggtggcgcgcccggtgggaagacggcctgccnttgcnaaccccccccctggcccgggaggggccttttcctttttcccccaaggggttttgaaactccgaaactctcaaaaatttccttttttacccgggaggcgccccnnaaaagaggggtgtttttttttggggggggaacccccctcctccggggggggggggggggggggggggggccnnntccccggggttttttcctccctctcccaaaaagaggggggggcccaccccccttcct

SEQ ID NO: 63319 - protein, 127 aa, Zea mays
  misc_feature: Ceres CLONE 1530780
  misc_feature (32)..(32): Xaa is any aa, unknown, or other
  misc_feature (48)..(48): Xaa is any aa, unknown, or other
  misc_feature (50)..(50): Xaa is any aa, unknown, or other
  misc_feature (84)..(84): Xaa is any aa, unknown, or other
  misc_feature (109)..(109): Xaa is any aa, unknown, or other
MATAMGAMAATCMASMPAAATFPGDLGVGRRXSGCTRGGAPGGKTACXCXPPPWPGRGLFLFPPRGFETPKLSKISFFTREAPXKRGVFFFGGGTPLLRGGGGGGGGPXPRGFFLPLPKRGGGPPPF

SEQ ID NO: 63320 - DNA, 665 bp, Zea mays
  misc_feature: Ceres CLONE 1530782
  misc_feature: Encodes the peptide sequence at SEQ ID NO. 63321
ggagctccccgcggtggcggccgctctagaactagtggatcccccgggctgcaggaattcgtctcacccctagaaaaaaactctccctaccctctcctgtcctgtcgttctcgtgcatgctcacggtcccccacgcccacgagcgcctccgcggcgacgaagagaatcatcaggcagagcgggggtggggcggggcgcagatggatctagagaggtcaccgccagcgtcgtcggcggaggcgcccggggacggcggcgggggcggggccgcggcctgctcaatctgcctggatgcggtgctcgcccgcggcgctggtcgctccgtcgccaagctacaatgcggacacgagttccacctagattgtattgggtctgcattcaatgcaaaaggagcgatgcaatgccctaactgtcggaagattgagaaaggtcgctggctttatgcaagcggacatcgcgcctctgttgatattgatatgggtggctgggtgaccagtgacaactatgatatcacctccgagcttccttttggatttcaatggtgcccctttagtggattcacccggctagcatccatgtttgaggagcgtgaagctgagcttacttatcacacaactggagatcgctcaagtgctgcaagcagttcacttgtttgcccatatttt

SEQ ID NO: 63321 - protein, 183 aa, Zea mays
  misc_feature: Ceres CLONE 1530782
  misc_feature (54)..(99): Pfam Name: zf-C3HC4 Pfam Description: Zinc finger, C3HC4 type (RING finger)
MLTVPHAHERLRGDEENHQAERGWGGAQMDLERSPPASSAEAPGDGGGGGAAACSICLDAVLARGAGRSVAKLQCGHEFHLDCIGSAFNAKGAMQCPNCRKIEKGRWLYASGHRASVDIDMGGWVTSDNYDITSELPFGFQWCPFSGFTRLASMFEEREAELTYHTTGDRSSAASSSLVCPYF

SEQ ID NO: 63322 - DNA, 698 bp, Zea mays
  misc_feature: Ceres CLONE 1530784
  misc_feature: Encodes the peptide sequence at SEQ ID NO. 63323
  misc_feature (390)..(390): n is a, c, t, g, unknown, or other
  misc_feature (487)..(487): n is a, c, t, g, unknown, or other
  misc_feature (504)..(504): n is a, c, t, g, unknown, or other
  misc_feature (534)..(534): n is a, c, t, g, unknown, or other
  misc_feature (609)..(609): n is a, c, t, g, unknown, or other
ctcaccgcggtggcggccgctctagaactagtggatcccccgggctgcaggaattcgtctcacccctagaaaaaacacaccacagcctacagcgcttctgctccagcgcccgcctcgcctcgcctcttctcctcgttctgccgcccgcgcgcgccagcctggtgctcgttccccttcttggctcgtcgagcccagaggttggtggcgtcagggatttgtattggagcggaggagaagggggctttgccccgaggagatcggggacgcgggagggcgcggcgctcgagccgagctcggttcagcgggatcacttggcgtggccggtcctccggggcccatgccgtgagcaaagccaggctttgttgcccgggggagagatcttgcgcttgncagcggcgcccgcccaccgccatggccggcagcgacgaggtcaaccgcaacgagtgcaagggtgcggtgccgatccacacatgggtgctcatctccnactttcagttggcgtancacatgctccgggcgggccgacggcacttncgaccgcggacctcgcgagttcctcggaccgcggggtgccgcccgacgcacgggcccaggagggggtgttcttgntcgaaccacgtcatcgaaacgtccactggcccggaaggccccatttaccgggcccgcccttaacaagggggggccgggcccgcccccgt

SEQ ID NO: 63323 - protein, 86 aa, Zea mays
  misc_feature: Ceres CLONE 1530784
  misc_feature (26)..(26): Xaa is any aa, unknown, or other
  misc_feature (31)..(31): Xaa is any aa, unknown, or other
  misc_feature (41)..(41): Xaa is any aa, unknown, or other
  misc_feature (66)..(66): Xaa is any aa, unknown, or other
MAGSDEVNRNECKGAVPIHTWVLISXFQLAXHMLRAGRRHXRPRTSRVPRTAGCRPTHGPRRGCSXSNHVIETSTGPEGPIYRARP

SEQ ID NO: 63324 - DNA, 646 bp, Zea mays
  misc_feature: Ceres CLONE 1530791
  misc_feature: Translation starting site: 451
ggctccccgcggtggcggccgctctagaactagtggatcccccgggctgcaggaattcgtctcacccctggaaaaaaaactccgtttcgaattctagggttttgctgctctccgaccccgagctccgaaggccgcagcatcagcgcccggcccccctcacgtgtgaccgagatcgcgctgccgaatcagggaacccttgattaccccagctccaggctcgtcatcgtccgccatggtggaactggtaaaactacatttgtgcaccacgcatctcactggagagtttgagaagaaatatgaaccaaccattggtgtgtaaattgatcccatggatttgcaccactaactgtgggaagatcaggttctactgcttggataccggcacggcaatagagagtttggtggcactcagggatcggatactatatccatggccagtgtgcgatcatcatgtatgatgtaacctcactgcttacttgcaagactgttcctacgtcccatatggacctgtgcaagggctgtcataacatccccattgtcctctgcggtaataaggctgatgtgaacaacaggcaggtcaaagacgatcaccgaactttgcccaagaagaagaatctgctgtactatgaaactcctgccgagagca

SEQ ID NO: 63325 - DNA, 657 bp, Zea mays
  misc_feature: Ceres CLONE 1530793
  misc_feature: Encodes the peptide sequence at SEQ ID NO. 63326
tagtttgatgcctccagccgtccaccaatctacataatagtggatcccccgggctgcaggaattcgtctcacccctagaaaaatcgtctgtacgccgccgggtatctctttctccaggtagtgcagatcctgaaccgcgaggtgcacccctgcctactggaacggggatgggaagcacatgggcgctctctttggcacccgtgctcgcacgtgcactcccgtggcgtcctcttcccggagacccggggcttcttacgccagcgctacttgcctctattatcgctatctgacacggcgcttgagccccagcgccggcccgggcagcgcctccgctgcgctgcctgcgaccgtcacggcgggccccgggacgctcagaaggagtctccgagcggcatcggcgcagcactccaggatccgtctccaggacctcctgtggaaaacggttccttcagaagcccctcacaagaagaacagaccgctctgcataattttctctatccaatgacagacttccttcccgatgatacggagatgactatatttgatcatctggaggagcttcgcaagacgattttaatctctactttgcctgctggagctgcgatatcatgctgttctactatgtgctaagatctgattcttactccagaagcacaa

SEQ ID NO: 63326 - protein, 42 aa, Zea mays
  misc_feature: Ceres CLONE 1530793
MTDFLPDDTEMTIFDHLEELRKTILISTLPAGAAISCCSTMC

SEQ ID NO: 63327 - DNA, 638 bp, Zea mays
  misc_feature: Ceres CLONE 1530795
  misc_feature: Encodes the peptide sequence at SEQ ID NO. 63328
  misc_feature (510)..(510): n is a, c, t, g, unknown, or other
tccccgcggtggcggccgctctagaactagtggatcccccgggctgcaggaattcgtctcacccctagaaaaaagcattctccacgctccaatacagcggcgtcgggtctatccgggtctatccgcgaacacgtgagaactctccagaaactgctttctcctccacttcatctctctcgctttccctctataaaaagaccccttctaggaattgagggagacagcaagcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaaggagactccagaagcgcacgtngtcaaggccgacgtacgggggctgaagaaaggagaggtcaaagtggaggtcgaggacggcacgtccttcaatcagcggcgagcgcacagggagccggaggaaaaaccgacccctggcaccgcgtggag

SEQ ID NO: 63328 - protein, 105 aa, Zea mays
  misc_feature: Ceres CLONE 1530795
MSLIRRSNVFDPFSLDLWDPFEGFPFGSGNSSSLFPSFPRTSSETAAFAGARIDWKETPEAHVVKADVRGLKKGEVKVEVEDGTSFNQRRAHREPEEKPTPGTAW

SEQ ID NO: 63329 - DNA, 688 bp, Zea mays
  misc_feature: Ceres CLONE 1530802
  misc_feature: Translation starting site: 355
  misc_feature (386)..(386): n is a, c, t, g, unknown, or other
  misc_feature (389)..(389): n is a, c, t, g, unknown, or other
  misc_feature (397)..(397): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
  misc_feature (434)..(434): n is a, c, t, g, unknown, or other
  misc_feature (464)..(464): n is a, c, t, g, unknown, or other
agctccccgcggtggcggccgctctagaactagtggatcccccgggctgcaggaattcgtctcacccctagaaaaagacgagcccattccaccatagcatgcatagacccactccactgtacgccacgcacgattacgtgggcccgacatttgctccgtcccctctggtgcacaaagaccaggcgcacctgatcgtgcttcacctcgaaggaatcgaccccatcaccatcctcctcgttatctcgcagctaccgccgccgccgcaaaccctaacctgagttccgatccggttaatcgacgacgaggaagacgacggtgcgttgcagatctgaggggatctgacgacggcggctgatggccacatcgtggtcgaggggcggccgctnaanagggcaanggcncnngtccaggccagggacttcgcgagggtcccngcggcccgagactgcggggcggccgggacnttccggggagcggtgagagggtttctcgcaaaacatgcgaagctgctccccttgccgtccctcttctcttcggggggccgcggccgccccggcggaacctggtgattttgaagggtgtcccttaagggtccggggaggcccggggaggaaaaaaaacggcggcggggtaaaacctcaacctctcctgaaggaggaatgggcccccaatccccaatttgtggttt

SEQ ID NO: 63330 - DNA, 648 bp, Zea mays
  misc_feature: Ceres CLONE 1530804
  misc_feature: Pfam Name: Response_reg Pfam Description: Response regulator receiver domain
ctccccgcggtggcggccgctctagaactagtggatcccccgggctgcaggaattcgtctcacccctagaaaaacactccccacttcgccttcgccctcccccgcctgcgagcgcgaggcgcggaggggctagcgcgctagcggcgccatggccctgaccgacgccaccgcgttcccctacggcctgcgggtcctcgtcgtcgacgacgacccacctggctcagatcctcgagagatgctccgcaagtgtcatacgaagtaccacatgcggtttagccagtgttgctatccaaattctccgggagaggagaaacaagtttgacatggtaatcagtgatgtcacttttcctcccctgcctcgtggggggggtgggggaactctttggctttaaaatgaatctacctgtttaaagatagccaaacaccgggggccggggggggggaataaaactttccccctgggggcctgttaccttccccccccaacccgttttggataaggggacccccaaaacttttggccaccgtggggttggggaaaaaattggcttgggggggaaacgtattgtgggggctttttcccttttgttgttctccccaattgttttaaaagggggtggggggggttccccccagaggggcctcttg

SEQ ID NO: 63331 - DNA, 701 bp, Zea mays
  misc_feature: Ceres CLONE 1530805
  misc_feature: Translation starting site: 154
  misc_feature (45)..(45): n is a, c, t, g, unknown, or other
  misc_feature (396)..(396): n is a, c, t, g, unknown, or other
  misc_feature (404)..(404): n is a, c, t, g, unknown, or other
aagctggagctcaccgcggtggcggccgctctagactagtggatntcttgggctgcaggaattcgtctcacccctagaaaaaggaggcctcgctctggttggaaggtttggagaaactccccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccaagaaggatgataccaaggtgtgtggaggcatgccaagagtgatggtcatgaggactatggcctccttgttagtgagaatgcatttttctcccccctagtggggggggggggggagccanttaccttnaaacaccccacactggtcctgcagtttgaaatgacacttccaacgggccttgattgccaaagtccctacatttagtacatccgcccctcaggatgcctggtggggatgcccacgcattttgattcatgaaacctccctacccctattgtgcgttgggcccaaattaagggtggaccaacccaacaagggttctttctcctcccttagaccaaaaaaatccctgaaaatcggtataggattttttgagctctctttctccaatttcccccccattctgtccccatttgtcaaaggtcg

SEQ ID NO: 63332 - DNA, 711 bp, Zea mays
  misc_feature: Ceres CLONE 1530806
  misc_feature: Encodes the peptide sequence at SEQ ID NO. 63333
  misc_feature (347)..(347): n is a, c, t, g, unknown, or other
  misc_feature (677)..(677): n is a, c, t, g, unknown, or other
  misc_feature (711)..(711): n is a, c, t, g, unknown, or other
tccccgcggtggcggccgctctagaactagtggatcccccgggctgcaggaattcgtctcacccctagaaaaagggttacgttcctcgcacggcggaggcaaacaaaccctagccgccaggcgcaggcggtcagggagcgagtaccgagcgccccagttcacacgtgagatgtcagaatacaagaacgtcgttggggggaggctaaagctgaagggtaaggcactggatgtgaaggaaggtggagtcaagaagaaaaaaaagaagcatcagcttgaagagtcgtctcagattgagcacgatgagctccacaaagggggaaactctggcttaccagctgatcacaacnatgagcttattgaagctggcaaggtgggagatgaagaaaggatctacatccagactaccaccacctcacaccggcaggacgaccctttatagatcagaagcggaacatcgacctgcaaaagctggcctaagtttgctaacaagtacccccgggacggtatccaggactttcaaccattttcctggggaaaaccttacccgagcacttatagaaattcccaaaaagttggcccttgtttaaaaaaataaaaccaaaaatgggtttttttcccccaaaaactttttgttccctcggggggggttttgcgaaaccttttaaaagttgtcttanatgtgttgtgttcgtggccaattgggggcgcccn

SEQ ID NO: 63333 - protein, 89 aa, Zea mays
  misc_feature: Ceres CLONE 1530806
  misc_feature (60)..(60): Xaa is any aa, unknown, or other
MSEYKNVVGGRLKLKGKALDVKEGGVKKKKKKHQLEESSQIEHDELHKGGNSGLPADHNXELIEAGKVGDEERIYIQTTTTSHRQDDPL

SEQ ID NO: 63334 - DNA, 646 bp, Zea mays
  misc_feature: Ceres CLONE 1530809
  misc_feature: Encodes the peptide sequence at SEQ ID NO. 63335
  misc_feature (377)..(377): n is a, c, t, g, unknown, or other
  misc_feature (378)..(378): n is a, c, t, g, unknown, or other
  misc_feature (384)..(384): n is a, c, t, g, unknown, or other
  misc_feature (385)..(385): n is a, c, t, g, unknown, or other
  misc_feature (389)..(389): n is a, c, t, g, unknown, or other
  misc_feature (394)..(394): n is a, c, t, g, unknown, or other
ggcggccgctctagaactagtggatcccccgggctgcaggaattcgtctcacccctagaaaaagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccggaccggccgtcccgggcgggtacctcttcaaccgcgctggcgcctacgcctttttcggccgcggcccaggcgggacctgccacccccccccccggcccccgggaaacaccgggtttttccccccccccccccggagggcagtaggggtggttnnattttnnaaanttttnccatgttttttggcccccaccttgaacatgccctttcggtggggggcggcccgccccttcctaccgggcttgaaagttctctaacaacaacatccccctccgtgcctcaaaggggcccatgccctttgctagagacaccggcgccccaccctctccttatcacgcgccccgcaggggccccggttctccctctccacttcttccatacccggaggacccccccttcgcgctggctctcggcagaggggctcg

SEQ ID NO: 63335 - protein, 78 aa, Zea mays
  misc_feature: Ceres CLONE 1530809
MASRRVVSSLLRSASRLRAASPAAPRPRAPPDRPSRAGTSSTALAPTPFSAAAQAGPATPPPGPRETPGFSPPPPGGQ

SEQ ID NO: 63336 - DNA, 682 bp, Zea mays
  misc_feature: Ceres CLONE 1530811
  misc_feature: SWISSPROT Homolog: EC 2.7.9.1 Pyruvate, phosphate dikinase
aaagctggagctccccgcggtggcggccgctctatatctagtggatcccccgggctgcaggaattcgtctcacccctagaaaaagttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagcggggctcaaaatgcaccagggacagggaaagcgacctccttcgccccgccgatcggtcgcagcgccgaagcccccgcacgccaaagccggccgggtcatccgttccgactccggcccgggacggggccagcttgctccccgcttaagggccttcttttgaccccccccaaatcaaacaaccaaaaaaaagggggttcccccttcgcgaagggaaaaagcggggggcaacaaacccttaaagaaacctcttgggcggaaaggggccaaaacttgggggaaaaagggaaaaaattggggtttttttgggccccccaggggtttccaggggttacaaaggggggtgtcccccaa

SEQ ID NO: 63337 - DNA, 834 bp, Zea mays
  misc_feature: Ceres CLONE 1530814-R
  misc_feature: SWISSPROT Homolog: EC 3.1.3.16 Phosphoprotein phosphatase
aattgggtacctcgagcgtctcgtttttttttttttttttagagcggggttgagcgccataaccctctacggaaaacgcatctaccatatatacatgtacaattcttgacgcccaacggagacaaaaaaaactgtgggccggtcaagtctcgtgcggacgaccagctagcaggagttctttggacatgccatggtcagctcagctctactgtgatggacccagcacgcccgatgctacgagtagctcctgagcttttctttcgaggtttcaagtcaaccacgatgacggtgacgttgtcctcggtacccttcttcagcgcgaccctcgcgagataatccgctgcggcttgggcagcggggtcggtggtggatccatcaccctcgtcgcacaacgaccacgatgcgccagcggcaccgttgttcttgtgccacacttggatttgccggcgcgcagctttgcacgcctcctcgttcgtcaccacatcccacagcccatcgcttgcgaggatgagacagtcgtcatctttcgccctgggaaccaccgtgacctctggttttggaacgacgaacggcttcagataccggtcccctgcagcgagtgtttccaacttcgagttagcaaaaaaaaaggtgacggagaattggacaaatgctacccaattccaacccacagagaagtcagctgaactgctggttcaactaaattttctagtgaaattgggggaaacaatattgtccgggagttttaacatgatggcgtatgtgtatctgatctgagatggcgatgatgtgagcatttcagacaatacttgatggttagcatggtccagctgc

SEQ ID NO: 63338 - DNA, 686 bp, Zea mays
  misc_feature: Ceres CLONE 1530824
  misc_feature (300)..(300): n is a, c, t, g, unknown, or other
  misc_feature (391)..(391): n is a, c, t, g, unknown, or other
  misc_feature (414)..(414): n is a, c, t, g, unknown, or other
tccccgcggtggcggccgctctagaactagtggatctcttgggctgcaggaattcgtctcacccctagggaggccggcctcggcgtcgtcgcctcgcaccgcacccaccggtccaccacccacctattcttcttgtccctctcccccctcgcaaatcggaggccaagtacactgcccacccaaccaagtcaggagcagaacaagtagtacgggctgtgttttctgcgacggcgagccaagagcagaacaagtagtacggggcgtgttctctgctacagccagcggaccggatcggcggcnccctgtcgcacgacgagctcgccgacaaggagccgtcgtcctccgaggaatttcacctcccgccgaggggagggggggggggggacctcanccctccacccattcctatcccancttcaccgggcatcaaatctttgggcgactcgggcgccgatgaaaccgcaaatgtagatctcctgggccccccctccaaaggggaaaagggaaccattctcctccggctaggttctaccggtaagtttacggggaaacaaaaaaaggcccccttttgaattttgcggtgccaaacccccgcgggaaaacccccccattccccctccccaatttggttttttcccaggcccttaaagaccttggcgcaaaaagtcctctccaagacgggtggt

SEQ ID NO: 63339 - DNA, 705 bp, Zea mays
  misc_feature: Ceres CLONE 1530827
  misc_feature (36)..(36): n is a, c, t, g, unknown, or other
  misc_feature (39)..(39): n is a, c, t, g, unknown, or other
  misc_feature (47)..(47): n is a, c, t, g, unknown, or other
  misc_feature (59)..(59): n is a, c, t, g, unknown, or other
  misc_feature (68)..(68): n is a, c, t, g, unknown, or other
  misc_feature (87)..(87): n is a, c, t, g, unknown, or other
  misc_feature (106)..(106): n is a, c, t, g, unknown, or other
  misc_feature (391)..(391): n is a, c, t, g, unknown, or other
  misc_feature (393)..(393): n is a, c, t, g, unknown, or other
  misc_feature (397)..(397): n is a, c, t, g, unknown, or other
  misc_feature (407)..(407): n is a, c, t, g, unknown, or other
tccaccgcggtggcggccggctctagaactagtggnatntcttgggnctgcagggattnctgtctcantctttagaaaaagaaactnagcttgagcagggacgaangggagcgacgttttataaccacgaataaattttaatattagcaatcgaccgtgttcagctgatgatgaataattacatctgtagttggcctgatatgggattgtagccggacgccgccttcatatagcggccgtcaggaaccccagcaagcaacccagccgcccattgccggcattgctcgcagcgctagcttcttgcgctcatcactcgtctccgaccaagatcagcaaggacggcatggctctcgaagcatcgtacgactacctgcgcgggggggggggccantncacncccacacaancaacacccccccccggcgtcttcctcctcctcggcatccgggtaggccgcggcgggcaagaactcctcccgcgaactcccccaaaatggaagccgcaaagggttggcccccaaccccttccggggaaacccccccattctcggggacccgccccctcctcgggttcccacccgtacgttcttccttcccggaacctgcacaccccaggttcggccccccaacgcggcctaaacgcccgggtagatggccggcccccctggcccccaccacccgggggcgcccccgccccaccgccccc

SEQ ID NO: 63340 - DNA, 696 bp, Zea mays
  misc_feature: Ceres CLONE 1530829
  misc_feature (36)..(36): n is a, c, t, g, unknown, or other
  misc_feature (44)..(44): n is a, c, t, g, unknown, or other
  misc_feature (321)..(321): n is a, c, t, g, unknown, or other
tccccgcggtggcggccgctctagaactagtgaatntcctgggnctgcaggaatttcgtctcaccctaggaaaaccacgtctcccctcacctggctctccacctgccacctcacgcgcgcccctgctctgtctcttttggctccgctgaggccgagcacacacaacaaattctctctctcctctctctctctctctctcacacacacactctgctccctgtgcggaggacgggccggccgcatggggtgggggtggacggcgctggcggcggcctctatggcgtacgtggcggtgaaactgatggaggtgctgtggtggcngcccccgcccgcctggacaccacttctcttcgccccgccataaggggggggggggtggcgggcttcttctccaactacaatcccccccccccgccgcgctcaaggtgggcccccctccccccaggcgcagggcgcgccccctacccgcctcccccaaacttcctccccccgcgacccccgcctttctccctccccgggaaaaaaaattcccgcggcccaccctcctcgaattgtgtccggccccaaccgcgagagccccccccccgcccccccccgaccccttttggggggaaccccccggctctccccgccagactttctctgacccccagaatgtgcccccgcaaatccccgccgcggctcccgcggttcggc

SEQ ID NO: 63341 - DNA, 553 bp, Zea mays
  misc_feature: Ceres CLONE 1530830
tccccgcggtggcggccgctctagaactagtggatcccccgggctgcaggaattcgtctcacccctagaaaaactgctcctcccagtcccagactcccatcctcgcctccgccatggccgccgtcggcatcccctcccctccggcgccacacgtcttcgcgcccgccgcatctccttcctcctccacgtactccacactggagcccccgcccgtctcggcgtcctccaccccgactcgtaaatcccccgccccccggcgggggtccttgccccttaccgcgggtgccccttgccccccttgcccgaaggggggggggcccccccggccctttccgaaaggggagaccctcccttaccccgggggggggggggaaactctgggggggggggggggcccccccccccccctcctggtggggccaaaaaaaaaattttttcccgggggggggggccccccccgtaaaaaaccctcttccaacccgggggggggggccccccccaaaaatccttgtgtatttatatttcttcccggggggggggaaaaacagaaggg

SEQ ID NO: 63342 - DNA, 606 bp, Zea mays
  misc_feature: Ceres CLONE 1530835
  misc_feature: Encodes the peptide sequence at SEQ ID NO. 63343
  misc_feature (37)..(37): n is a, c, t, g, unknown, or other
  misc_feature (61)..(61): n is a, c, t, g, unknown, or other
  misc_feature (423)..(423): n is a, c, t, g, unknown, or other
ctccccgcggtggcggccgctctagaactagtggatntctggggctgcaggaattcgtctncaccctagaaaaaaaaacactcgcatctcctaccgcggttttgatcgagaggacggccagccagccagccttaaaccctacccgcccaaacccacacgactcacgaccatggccgccgccgccgccgctaaggcagcggccgcggccgtctccgcgggggccgcctttgtgctctcctccgagcgggcccacgccgacgggggcggctccaccttccgcttccccggggttctactcctccgccccctccccggccccggccccggcccctgcccccgccgcggcggccgctcaggagtccaatggccgggggggggggcaaaagttcactcacacctccactagggcgcggcttcgatccncgcgctggaggggggggggagcgattaaaagctcaggcaggggtcgaccccaaaaggtggttccagttttgaaaacccgggggggacccccccgcggggaaaacctggccaaaaaaccccggttccaaaaggcccgggccgaaaatccaggctgggccaaaaagcggggggggattttgaaga

SEQ ID NO: 63343 - protein, 78 aa, Zea mays
  misc_feature: Ceres CLONE 1530835
MAAAAAAKAAAAAVSAGAAFVLSSERAHADGGGSTFRFPGVLLLRPLPGPGPGPCPRRGGRSGVQWPGGGAKVHSHLH

SEQ ID NO: 63344 - DNA, 716 bp, Zea mays
  misc_feature: Ceres CLONE 1530841
  misc_feature: Encodes the peptide sequence at SEQ ID NO. 63345
tccccgcggtggcggccgctctagaactagtggatcccccgggctgcaggaattcgtctcacccctagaaaaactccaaccgccgagccagaagcacccggagcagcgcacagcaacagagcacacgccgcacaccgccgcctccgcagcagcagcaatggcgcgcgccggcgctctctgcctggtgctgctctgcctcgtggccgcgcactcagccgcggcgcagaagtccacgacagccccggccgccgcgccggccgccgccaccaccccgccggcgaccccgaccaagaagacgcccgcgcccgccgccgcgccgcccaccaccccggccaccctggccccggccgccgcgccgcccaccacgccggccacgccccgcgcccgtcgctgcggggcccaccacccccgggcaaccctggcaccctgccgcgggccccacccaagtccggcccccaaagggttcccctccctgccccggccgccctatgggcaagggccacccccgccggggggcgaagttgcggtccaggcgcgctggcttgcgggccccggcccccggtcttcctcggcctgcaaaacccccctgaggttctccgtgctccgttgcccggtccaacaaagaagaaacaaacccccgcctcggctggccccaagcagctcgtaccatcaaagtgtaataggtccccccctacttttgctccccttgctccaaa

SEQ ID NO: 63345 - protein, 186 aa, Zea mays
  misc_feature: Ceres CLONE 1530841
MARAGALCLVLLCLVAAHSAAAQKSTTAPAAAPAAATTPPATPTKKTPAPAAAPPTTPATLAPAAAPPTTPATPRARRCGAHHPRATLAPCRGPHPSPAPKGFPSLPRPPYGQGPPPPGGEVAVQARWLAGPGPRSSSACKTPLRFSVLRCPVQQRRNKPPPRLAPSSSYHQSVIGPPLLLLPLLQ

SEQ ID NO: 63346 - DNA, 849 bp, Zea mays
  misc_feature: Ceres CLONE 1530854
  misc_feature: Encodes the peptide sequence at SEQ ID NO. 63347
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (22)..(22): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (742)..(742): n is a, c, t, g, unknown, or other
nnnnnnnnaaaannnnnttttntttaatatagaaaaccccttctnnnnnnnnnaaatctggaactccccgcggtggcggccgctctagaactagtggatcccccgggctgcaggaattcgtctcacccctagaaaaaatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgaacgtcctttccggttaatccccattaaggagtccatccgtgtccccccgcagatgagcccgtctcctacttcgactgaccatgataccccttactccgaaaacccatcctccttccttcccttgggtcgcccagcgttccgccgaaggcttgttccttggggccggtaccaaaggcccccccacatggaacccccagccccagggcggcttatgcccctcctcctgtgaattatgttcatcgagggtctccctcccggggtgaaaagatacccccagaactgaggaacgggggccagccatggtgcctctcccggtacatgttgtgaaatgcgggctcgtgctgggcggttcntctctcgagagctctccgtgaacaaaactgcacggactctcgcccccaccacctactctcgcgcccctcagaaatccctgctgggacgttcacgcatgatcctctcg

SEQ ID NO: 63347 - protein, 64 aa, Zea mays
  misc_feature: Ceres CLONE 1530854
MATAAASSLLKSSFAGSRLPAATRTTPASLVVATGPRGAGAGPICASMSMSSSNPPYDLNVLSG

SEQ ID NO: 63348 - DNA, 720 bp, Zea mays
  misc_feature: Ceres CLONE 1530859
  misc_feature: Encodes the peptide sequence at SEQ ID NO. 63349
  misc_feature (509)..(509): n is a, c, t, g, unknown, or other
  misc_feature (510)..(510): n is a, c, t, g, unknown, or other
  misc_feature (546)..(546): n is a, c, t, g, unknown, or other
  misc_feature (567)..(567): n is a, c, t, g, unknown, or other
  misc_feature (580)..(580): n is a, c, t, g, unknown, or other
  misc_feature (581)..(581): n is a, c, t, g, unknown, or other
  misc_feature (646)..(646): n is a, c, t, g, unknown, or other
  misc_feature (690)..(690): n is a, c, t, g, unknown, or other
aaagctggagctcaccgcggtggcggccgctctagaactagtggatcccccgggctgcaggaattcgtctcacccctagaaaaaatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaggacaagcctcagcccccacctgagggccgccttcctgatgccactaagggttctgaccacctganngcagtttttggcaagcagatgggcttgagcgatcangacattgttgccctctctggntgccacaccttgnngaggtgccacaaagagcggtctggtttcgagggggcctggactacaaaccctttgggtcttgacnactcttacttcaggaaactctgagtgggtgataagagggccttnctcagctaccagtgacaagccctgctgagg

SEQ ID NO: 63349 - protein, 194 aa, Zea mays
  misc_feature: Ceres CLONE 1530859
  misc_feature (19)..(195): Pfam Name: peroxidase Pfam Description: Peroxidase
  misc_feature: SWISSPROT Homolog: EC 1.11.1.11 L-ascorbate peroxidase
  misc_feature (142)..(142): Xaa is any aa, unknown, or other
  misc_feature (154)..(154): Xaa is any aa, unknown, or other
  misc_feature (166)..(166): Xaa is any aa, unknown, or other
  misc_feature (188)..(188): Xaa is any aa, unknown, or other
MAKNYPTVSAEYSEAVDKARRKLRALIAEKSCAPLMLRLAWHSAGTFDVSSRTGGPFGTMKHQSELAHGANAGLDIAVRLLEPIKEEFPILSYADFYQLAGVVAVEVTGGPEIPFHPGREDKPQPPPEGRLPDATKGSDHLXAVFGKQMGLSDXDIVALSGCHTLXRCHKERSGFEGAWTTNPLGLDXSYFRKL

SEQ ID NO: 63350 - DNA, 682 bp, Zea mays
  misc_feature: Ceres CLONE 1530864
  misc_feature: Encodes the peptide sequence at SEQ ID NO. 63351
ctccccgcggtggcggccgctctagaactagtggatcccccgggctgcaggaattcgtctcacccctagaaaaagatacattctggacatcttgcaaccgctgccggatgcagtatgagtacctaagaatttatcttaatcataacctgctgtgcccaaattgccataatgcattcttggcagtggagactgggttcccatgcaacggaagcagttcatcattctcctggtcaaccaagcagcagccacagcagaaccacaattcaaccaagcattcatatggctcaacaagcaggacttctagcatccctgggacagggcatggggggtaccagcaagataatgcttatgattcctacaacaatcaaggcttccagtggaatcagtactccaagacaacacctgcagctggtaccaatgcttatggtacacatgccttggagaaacagagaaagaagcatgatgagagctactagaaaaacagctacaactattctgaaagcggcaacttatatgtccatgagaaagctgcttcaaggcgtggtcgcttctcaaagcggagaaagcataattacgatacttacactactgtgggattttgggtggcataacaaagaaacagttgccgcaagcacagaaccaactgctgttttcactgatgtgggacgggtcaacggtactc

SEQ ID NO: 63351 - protein, 157 aa, Zea mays
  misc_feature: Ceres CLONE 1530864
PRGGGRSRTSGSPGLQEFVSPLEKDTFWTSCNRCRMQYEYLRIYLNHNLLCPNCHNAFLAVETGFPCNGSSSSFSWSTKQQPQQNHNSTKHSYGSTSRTSSIPGTGHGGYQQDNAYDSYNNQGFQWNQYSKTTPAAGTNAYGTHALEKQRKKHDESY

SEQ ID NO: 63352 - DNA, 688 bp, Zea mays
  misc_feature: Ceres CLONE 1530873
  misc_feature: Encodes the peptide sequence at SEQ ID NO. 63353
  misc_feature (544)..(544): n is a, c, t, g, unknown, or other
  misc_feature (564)..(564): n is a, c, t, g, unknown, or other
ctggagctccccgcggtggcggccgctctagaactagtggatcccccgggctgcaggaattcgtctcacccctagaaaaagcgacggttccccccaaccccatcaagtctggccaggtctctcccatatcgggttctcccttcctcttcctgtttccgcgcgcgagatcgccgccccgggtgggccctagatcccgatggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatctttcacactggcgtgaagagtttctaattcaggcgagcccatcagatcctgancatttcccccttttgtctgntggggtacaaagttgatgtagatggtgggaacagccgtgtggtgtcggagaaaaaggcaaaggcatggtgcgcctctaaggggacatcccgtactttgagacgtctgctaggatggaccgactg

SEQ ID NO: 63353 - protein, 127 aa, Zea mays
  misc_feature: Ceres CLONE 1530873
  misc_feature (10)..(127): Pfam Name: Ras Pfam Description: Ras family
  misc_feature: SWISSPROT Homolog: EC 2.7.11.1 Non-specific serine/threonine protein kinase
  misc_feature (116)..(116): Xaa is any aa, unknown, or other
  misc_feature (123)..(123): Xaa is any aa, unknown, or other
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLSHWREEFLIQASPSDPXHFPLLSXGVQS

SEQ ID NO: 63354 - DNA, 608 bp, Zea mays
  misc_feature: Ceres CLONE 1530874
  misc_feature: Encodes the peptide sequence at SEQ ID NO. 63355
  misc_feature (203)..(203): n is a, c, t, g, unknown, or other
ctggagctccccgcggtggcggccgctctagaactagtggatcccccgggctgcaggaattcgtctcacccctagaaaaaataacggagacgaagagagcagaagcgaagagcagcggcgcaaaggaaagggagccatgctcgcctcgccggcgctcgccggcgcccactccttcgcggcgtccgtgtatggaacatcctcgntccctcgcctcccgtccccgcgccggcacgtcgcgcggcgctgtccgtcgtcgccaaggtcaaggtggcactcccccagacgacgcatcgccggccacgtcgccttccccaagaggtaaatggccccacctttaaagcccaagtttaaattttttccccttaaaacaaattttggtcgctcaagtctctccgcaaccaaaaaaatgtaaccggggtttcccttttaaccatggcaaaattcttttccccggggatttttaatccccccggtgggcccccctttttaaataccccccaaaaaacccgggggggggtgtttcccccccccttctttttttgaaaaaaagagaagaaaacccagagggttttttccccccccaggggggggtttctcccccccccccg

SEQ ID NO: 63355 - protein, 36 aa, Zea mays
  misc_feature: Ceres CLONE 1530874
MAKFFSPGIFNPPGGPPFLNTPQKTRGGVFPPPFFF

SEQ ID NO: 63356 - DNA, 658 bp, Zea mays
  misc_feature: Ceres CLONE 1530877
  misc_feature: Encodes the peptide sequence at SEQ ID NO. 63357
tggagctccccgcggtggcggccgctctagaactagtggatcccccgggctgcaggaattcgtctcacccctagaaaaagctattcccacacctcgtgcggcggtggcccaaccaaaggtcagccggggcgcttgaggcggtgagtcctcgtcctcgtccgatatcgcagcggaacaaggtcatgggcttccaggtggctgccgtggcaccgccgccgtgcgcgcgctcctcctccgccttatcgtcgccctcgacctcctcgcggccgttgcccgccttcctcggaggcggcggcggatgcgccgggctcgcgagatcccgggcacccgtaaactggggaaccggcgtgatggtgcggcgcccgcgcccggctcggacgccagcgaggtgcgcgctgagcgcgagtctgcatgggatgggtggcggggacgcggagttcatgaagaggatcgaggagctcgctgcggcggctggggtgcagccggccggcccggcaggttgcggctggcccacgagcgtggagctgaacgcgagcaacgtcgggctgccgctgtcgctgcggatgctgaagcggaaaaagcagcaacagcaggcgcagctgcatgctgtagcgcgtccttcacgctgggacgatgggctgctgggctccccccggga

SEQ ID NO: 63357 - protein, 158 aa, Zea mays
  misc_feature: Ceres CLONE 1530877
MGFQVAAVAPPPCARSSSALSSPSTSSRPLPAFLGGGGGCAGLARSRAPVNWGTGVMVRRPRPARTPARCALSASLHGMGGGDAEFMKRIEELAAAAGVQPAGPAGCGWPTSVELNASNVGLPLSLRMLKRKKQQQQAQLHAVARPSRWDDGLLGSPR

SEQ ID NO: 63358 - DNA, 656 bp, Zea mays
  misc_feature: Ceres CLONE 1530883
  misc_feature: Translation starting site: 173
tacccgcggtggcggccgctctagaactagtggatcccccgggctgcaggaattcgtctcacccctagaaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcatccagctggtctcactcagcatcagtaccttatattccaacagggagatcttcctccgggagctcatttccaactcttccgatgcgttggacatgatcaggctcgagagcctcactgacaagagcaagctcgatgcgcagccagagctgttcatccacattgtaccagacgatgcttcgaacacgctctccatcatcgacagcggcatcggcatgaccaagtgcgatcttgtcaacatcctcggtacatcgccaggtccgggaccaaggagttcatggaaccccttgctgctggcgctgatgtgactatgattggggcagtcggtgtcggtttccactctgcctacctcgtcccccaaaagggctcccggaccacccaacttaacgatgaccagccgtacctgtgggtatcccaaggggggcgggtcgttcaatgttacct

SEQ ID NO: 63359 - DNA, 697 bp, Zea mays
  misc_feature: Ceres CLONE 1530884
  misc_feature: Encodes the peptide sequence at SEQ ID NO. 63360
ggcagctgcccggggtggcgggcgctctagaactagtggatcccccgggctgcaggaattcgtctcacccctagaaaaagccggcaggagcacgagggggggtcacgagcgacgaatccaaagcgcgaccgcaaccacgccgcaggcagcggtccggccgcccggccgaggccggcagctcatcacgagtgccagatccagtcgtggccaacgccaacacagcgccccctccccacgacgctgaagtcccagatctaaccacacagacacaacccaccacgtcgccaccaccaactaacccattaatccatcaacgccggtcctccacggtcacgcggaagtcaccgccgctctgccgcgctctcccgtagtcccgtaccgcatcgcgttcttcgctggcctcgctgtcatctcatcgccattggcgtttcgcctgcagctgctcgtccgccagaacaagcaggtgtaacatgcttcatcattcaaatagccggaaccaaggaacaggggatcaagaatcaaaactctactccaagcgaccctgctttcaggtgttgtcttttggcctcctggattcaggtgaaaccattcctattgttaagaaaaaacgaaatcctttgaattaatccttaagaaccacctttccccctaatggtttaaaaccttttttccccggggagagaaaaaaaaaaagcgg

SEQ ID NO: 63360 - protein, 51 aa, Zea mays
  misc_feature: Ceres CLONE 1530884
MLHHSNSRNQGTGDQESKLYSKRPCFQVLSFGLLDSGETIPIVKKKRNPLN

SEQ ID NO: 63361 - DNA, 714 bp, Zea mays
  misc_feature: Ceres CLONE 1530895
  misc_feature: Encodes the peptide sequence at SEQ ID NO. 63362
ctggagctccaccgcggtgggcggccgctcctagaacttagtgggaccccccgggcggaaggaattccttctcaccccctaaaaaaaattggaggaatcagttttaggcccttggtggaaatcaattccttaaggagggaactccaacgggcattcccttttgtgccgtatcctacaaaagaaggcccaaaaaaggctgcacaaaagctggctaaaaagctagtccatccaagggcgggcgcctgaaactgaatgtggggcaagcctcaggccccaaagcctgaggaggatgagtctgggaggctggggcaggtttcccacggagggctgctccctagagctgtcatatctcaccagcacatcggtgaccagactcagccccccgggatggagggccaacagcaacaggctgcaccagcatcgtactacttcaacattccagcaccaccagcagcggagcggactgtgtatccatcaatggatccacagaggatgggtgctatagtaaaaccacatgacagtgaaggccaaccacggccgcaacaagactggcaaggtcaggcatcaagcaacccagcacaagggggcggctatcctgcaccaccgccatactaccatggtcagtatccaccatactatccacccccaccaccatatggtggctacatgcctacaccgcgcatgccctacccaccacaatatccaccttaccag

SEQ ID NO: 63362 - protein, 154 aa, Zea mays
  misc_feature: Ceres CLONE 1530895
MWGKPQAPKPEEDESGRLGQVSHGGLLPRAVISHQHIGDQTQPPGMEGQQQQAAPASYYFNIPAPPAAERTVYPSMDPQRMGAIVKPHDSEGQPRPQQDWQGQASSNPAQGGGYPAPPPYYHGQYPPYYPPPPPYGGYMPTPRMPYPPQYPPYQ

SEQ ID NO: 63363 - DNA, 707 bp, Zea mays
  misc_feature: Ceres CLONE 1530898
  misc_feature: Encodes the peptide sequence at SEQ ID NO. 63364
  misc_feature (605)..(605): n is a, c, t, g, unknown, or other
agctccccgcggtggcggccgctctagaactagtggatcccccgggctgcaggaattcgtctcacccctagaaaaacaccagacgccagtccaccaccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaaggcgggttaccgacatatcgattgtgccagagtttacggcaacgaaaaggagattggtttggcgctgaagaagctatttgaagagggtgtagtgaagcgagaagatctgtttatcacctctaagctatggaatgatcatcatgctcctgaagatgtgcctgaggcactaaatgacagcctgaatgatttgcagcttgagtacctggatctttatcttatccattggccatttagagtcaagaagggaacaaataccagccctgaaaattttgttacacctgacttccctgctacttgggggcaatggaaaaagtatatgatgctggcaagctcgcgctatggntgtgagtaacttctccctcaagaaaatgggtgacttgctggctgtagctcgtgtacctcagctggtgatcaagtggaatgtcatcctggtggcagcaaacta

SEQ ID NO: 63364 - protein, 153 aa, Zea mays
  misc_feature: Ceres CLONE 1530898
  misc_feature (7)..(154): Pfam Name: Aldo_ket_red Pfam Description: Aldo/keto reductase family
  misc_feature: SWISSPROT Homolog: EC 1.1.1.2 Alcohol dehydrogenase (NADP(+))
MARHFVLNTGAKIPSVGLGTWQSDPGVVGNAVYAAVKAGYRHIDCARVYGNEKEIGLALKKLFEEGVVKREDLFITSKLWNDHHAPEDVPEALNDSLNDLQLEYLDLYLIHWPFRVKKGTNTSPENFVTPDFPATWGQWKKYMMLASSRYGCE

SEQ ID NO: 63365 - DNA, 685 bp, Zea mays
  misc_feature: Ceres CLONE 1530899
  misc_feature: Translation starting site: 130
  misc_feature: SWISSPROT Homolog: EC 2.7.4.3 Adenylate kinase
  misc_feature (309)..(309): n is a, c, t, g, unknown, or other
  misc_feature (334)..(334): n is a, c, t, g, unknown, or other
  misc_feature (493)..(493): n is a, c, t, g, unknown, or other
  misc_feature (547)..(547): n is a, c, t, g, unknown, or other
ctccccgcggtggcggccgctctagactagtggatcccccgggctgcaggaattcgtctcacccctagaaaaactaaaaccatcgccctgcccccgcctccgcctccgcctccgcctccgctgcatcccatggcggccgtgcagcgcctcctccgggcagtcgcccccggtggctcggcagcggcggcggtcaggaggcgcatgacgtcgcttgcgccggagcaggcgccgtctgcggccgccgggttcccattcgcggcggagcatagggcaaggcggccggtggcggcggagaggaacgtgcagtgngtgttcctgggctgccccggcgtgngcaagggcacctacgcgagccgcctgtcgcgcctcctcggcgtgccgcacatcgcgacgggggatcttgttcgcgacgagctcgcctccaccgggccacttgctacgcagcttgctgaaattgttatcacgggaaattagtttctgatgaaatatcatncatcttttgtccaaaaggcttaagataggagaagaccagggagaatcaggattnatttctgatggttttccccgtacagtaaaacaagcggaaattcttgatggcgttacagatatggatatggtggttaatctgaaactagaaaagatgtttttgtagaaagtgccttggccaaagatttgttgccattgt

SEQ ID NO: 63366 - DNA, 655 bp, Zea mays
  misc_feature: Ceres CLONE 1530902
  misc_feature: Encodes the peptide sequence at SEQ ID NO. 63367
  misc_feature (324)..(324): n is a, c, t, g, unknown, or other
ctggagctccccgcggtggcggccgctcctagaactagtggaatcccccgggctgcaggaattcgtctcacccctagaaaaatctgatacagacgtcgagaccgagtcaagtgtttctagtatagaggagcaagaagcaggatacggagcccacatccctcaaccggatccagcagtctgcaaggtgtccaaagaaaacaacacggcaggagtgaagatctctgataggatgacttcagtgtctgaatcaacacttgtgctggcttcaggtgcatcaatgttaccgcatcctgcgaaggacggacaggtggtgaagatgcatanttttatagcttgtgatggctggttttggtgtagcagatgggagttggtcagtggtcattttgaagggatcaatgccggactttatgccaaagaaactaattgatgcttgcaaaaagaatctgggaagaaaacccaaggacctccggggaatgaaaacccaaggaaatttcttggccaagggctccaaataaaaacaagggccccccggggttttcccacgtgttttaagttgggccacctttttggggggaaggggccttctccgcttaaaaaaattgggaaagaattccgggggacccccccccgatttaaaaaaacggggagggggcct

SEQ ID NO: 63367 - protein, 141 aa, Zea mays
  misc_feature: Ceres CLONE 1530902
  misc_feature (108)..(108): Xaa is any aa, unknown, or other
WSSPRWRPLLELVESPGLQEFVSPLEKSDTDVETESSVSSIEEQEAGYGAHIPQPDPAVCKVSKENNTAGVKISDRMTSVSESTLVLASGASMLPHPAKDGQVVKMHXFIACDGWFWCSRWELVSGHFEGINAGLYAKETN

SEQ ID NO: 63368 - DNA, 684 bp, Zea mays
  misc_feature: Ceres CLONE 1530903
  misc_feature: Encodes the peptide sequence at SEQ ID NO. 63369
  misc_feature (442)..(442): n is a, c, t, g, unknown, or other
  misc_feature (465)..(465): n is a, c, t, g, unknown, or other
  misc_feature (466)..(466): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
ggagctccccgcggtggcggccgctctagaactagtggatcccccgggctgcaggaattcgtctcacccctagaaaaatcccatctgctatccttggttgccgcttcctccaaagccactccaaacccccgcttccagaaccttctcgaaactctccgcctcctcctctactcgctccgatggcgaaggaaccgatgcgcgtgctcgtcactggcgccgcagggcaaattggatatgctcttgttcccatgattgctaggggagttatgcttggtgcagaccagcctgttattctgcacatgcttgatattccgccagcagctgaagcccttaatggtgttaagatggagttggttgatgctgcatttcctcttctgaagggagtcgttgcgacaactgatgttgtggaagcgtgcactggcgtgaatgtggccgtcatggntggtggatcccccagaaggaggnnatggaannngaagatgtatgtctaaaaatgtttccatctacaaaccccagcatctgctcttgaagcccatgcggccccaactgcaagtttctgggggttgccacccagcaaccccatggtcttattttgaaaaatttgcgccctacattccggaagaaaatttttttgcctacccggtggaacccaaaggggttttggccaaatttggaaaaaatttt

SEQ ID NO: 63369 - protein, 103 aa, Zea mays
  misc_feature: Ceres CLONE 1530903
  misc_feature (6)..(100): Pfam Name: Ldh_1_N Pfam Description: lactate/malate dehydrogenase, NAD binding domain
  misc_feature: SWISSPROT Homolog: EC 1.1.1.37 Malate dehydrogenase
  misc_feature (88)..(88): Xaa is any aa, unknown, or other
  misc_feature (96)..(96): Xaa is any aa, unknown, or other
  misc_feature (98)..(98): Xaa is any aa, unknown, or other
  misc_feature (99)..(99): Xaa is any aa, unknown, or other
MAKEPMRVLVTGAAGQIGYALVPMIARGVMLGADQPVILHMLDIPPAAEALNGVKMELVDAAFPLLKGVVATTDVVEACTGVNVAVMXGGSPRRRXWXXKMYV

SEQ ID NO: 63370 - DNA, 1591 bp, Zea mays
  misc_feature: Ceres CLONE 1530905
  misc_feature: Encodes the peptide sequence at SEQ ID NO. 63371
aatcagagaagagataaccacacgtccacacaccacagaccacacgcacggtacagcctctccgcagctgcaggtgcctgctgttctccgacgagaccccaagaactcgccaacctatgccagccacccttccctcttccacaatgctggcctccgccgccaccgtgaagccctccaccgccgcggccgcggccacctgcaaggcggccttcaagccgctccacctccctcccctccccgccgccgccggcctcaggccgctctccctctccgtctccgcgcgcccgctgtaccgtcaggagcatgtcctcgcatccgtggcggtggcggcggctggccgcaacgaccgcgccgcgtcccccgcgccgccgtccgccaccgctgacggctcccggccgctggaggtcgccgcgccggcggagacgggtcggcgcgccaagatcggggtctacttcgccacgtggtgggcgctgaacgtgatcttcaacatctacaacaagaaggtcctcaacgcgttcccgtacccgtggctcacgtcgacgctctccctggccgccggctccgccatcatgctcgcgtcctgggccaccaggatcgccgaggcgccccagacggacctcgatttctggaaggcgctcactcccgttgcgatcgcgcacacgatcgggcacgtggcggcgacggtgagcatggccaaggtggccgtgtcgttcacgcacatcatcaagagcggggagccggcattcagcgtgctcgtctccaggttcttcctcggcgagcacttcccggcgccggtctacttctccctcctccccatcatcggcggatgcgcgctcgccgccgtcaccgagctcaacttcaacatggttggattcatgggggcaatgatctcgaacctggcattcgtcgtccggaccatcttctccaagaaggggatgaagggcaagtccgtgagcgggatgaactactacgcctgcctctccatcatgtcgctggtgatcctcctgcccttcgccatcgccatggaggggcccaaggtgtgggcggcgggctggcagacagcagtcgccgagatcggtcccaacttcgtctggtgggtggcggcgcagagcgtgttctaccacctgtacaaccaggtgtcctacatgtccctggacgagatctcgccgctcaccttctccatcggcaacaccatgaagcgcatctccgtcatcgtcgcgtccatcatcatcttccagacgcccgtccagcccatcaacgcgctcggggccgccatcgccatcctcggaaccttcatctactcccaggccaagcagtagccgcccttggcgcgcgcgtctggctctcaggcctcagttcagttcaccgccgaatcagctcggcgctcgaagatataacagattatataacttttgaggatatctacctagcttgtataatagtattattactagatcctctcttctttttttttcgtattttctttcctaggactagcttattactagatcatttcgtcgtcgtgttttcactatgactatgatgatgtagagagagagagagatgaatccatctaaaaaaaaaaaaaaaa

SEQ ID NO: 63371 - protein, 400 aa, Zea mays
  misc_feature: Ceres CLONE 1530905
  misc_feature (252)..(397): Pfam Name: TPT Pfam Description: Triose-phosphate Transporter family
  misc_feature (118)..(243): Pfam Name: DUF6 Pfam Description: Integral membrane protein DUF6
MPATLPSSTMLASAATVKPSTAAAAATCKAAFKPLHLPPLPAAAGLRPLSLSVSARPLYRQEHVLASVAVAAAGRNDRAASPAPPSATADGSRPLEVAAPAETGRRAKIGVYFATWWALNVIFNIYNKKVLNAFPYPWLTSTLSLAAGSAIMLASWATRIAEAPQTDLDFWKALTPVAIAHTIGHVAATVSMAKVAVSFTHIIKSGEPAFSVLVSRFFLGEHFPAPVYFSLLPIIGGCALAAVTELNFNMVGFMGAMISNLAFVVRTIFSKKGMKGKSVSGMNYYACLSIMSLVILLPFAIAMEGPKVWAAGWQTAVAEIGPNFVWWVAAQSVFYHLYNQVSYMSLDEISPLTFSIGNTMKRISVIVASIIIFQTPVQPINALGAAIAILGTFIYSQAKQ

SEQ ID NO: 63372 - DNA, 716 bp, Zea mays
  misc_feature: Ceres CLONE 1530906
  misc_feature: Encodes the peptide sequence at SEQ ID NO. 63373
aaagctggagctccccgcggtggcggccgctctagaactagtggatcccccgggctgcaggaattcgtctcacccctagaaaaaaaaaaaccaagccgcaacacggcgcagacggcggcggctgcaagcctgcaacgaactaaccaacgagcgagcgggcggaggaggagatgccgggaaaggggcagcggcggagggagaagaacttccgggcggcgcacggcggggaaccgcgcctgcccccgccgccgaagcagagggagctcgaggccatcccgactaaactccgccgcctcatcgccttccagaacaagcacaacgccaatgctgacgcgtcctcaggaggtgctcccaagaagcaagacgatgggttaaggaagaacaagctagcaacagacaaggcaaaggacaagaaaaccaagaagcaggcattggtggttcctgctgatagcaaggcatcagatattaaaggtaatgataaacgttcagctgccaatgaagatgtgaatgcagagggaagtaaggggaagagaaagaggggaaaggttaaggaccttcgtttcgaggaactggacaagaacatctcagcctcgaagaagcaaaggaggaagcagcacctggatgagaagaaaaagaagcgcaaggacaataagacagcaactctaccagactttcctgggcgcgagaaattaaatttggtgaagttgttgtggctc

SEQ ID NO: 63373 - protein, 182 aa, Zea mays
  misc_feature: Ceres CLONE 1530906
MPGKGQRRREKNFRAAHGGEPRLPPPPKQRELEAIPTKLRRLIAFQNKHNANADASSGGAPKKQDDGLRKNKLATDKAKDKKTKKQALVVPADSKASDIKGNDKRSAANEDVNAEGSKGKRKRGKVKDLRFEELDKNISASKKQRRKQHLDEKKKKRKDNKTATLPDFPGREKLNLVKLLWL

SEQ ID NO: 63374 - DNA, 681 bp, Zea mays
  misc_feature: Ceres CLONE 1530908
  misc_feature: Encodes the peptide sequence at SEQ ID NO. 63375
ctggagctcaccgcggtggcggccgctctagaactagtggatcccccgggctgcaggaattcgtctcacccctagaaaaatcaaggctcacctccttccccctgttcccgtctccccggtctctctcggcaagtcggcatccgtcctcgatccacactcgcctaagccatcagcgatgagccggggcagcagcaacggcggcgtgaggcggagcgccgtcaggctggaggagctgcagctggacctgtccccgccgccggtggggatggatgtggacggcggcggggcctgggccgggggcgtccacggcgacagcgactcgtcgtcgtcgtcgtcgtcgccgagctcgtgcgtgtcgtcggacgggcggagctcgagcggcggcagcggctgcagccccgggagcaataagtcgccgatggtgatctgcgcctgcacacggtgcctcatgtactgcatggtggcccagaaggactacccgacctgcgtcaactgcaagcaggcgtgcctggtggacctgctccacgcgagcccggccttgacgcgggcgcaaggcagccgccgctgactacaactacaagaagaagcatgtgccaccgccttaacgtaggtgaatggagcccccgtaaaagccggtggtgggggcccgggcccgtgcccctgcccggccaaggggccaag

SEQ ID NO: 63375 - protein, 130 aa, Zea mays
  misc_feature: Ceres CLONE 1530908
MSRGSSNGGVRRSAVRLEELQLDLSPPPVGMDVDGGGAWAGGVHGDSDSSSSSSSPSSCVSSDGRSSSGGSGCSPGSNKSPMVICACTRCLMYCMVAQKDYPTCVNCKQACLVDLLHASPALTRAQGSRR

SEQ ID NO: 63376 - DNA, 697 bp, Zea mays
  misc_feature: Ceres CLONE 1530916
  misc_feature: Encodes the peptide sequence at SEQ ID NO. 63377
  misc_feature (469)..(469): n is a, c, t, g, unknown, or other
  misc_feature (539)..(539): n is a, c, t, g, unknown, or other
  misc_feature (540)..(540): n is a, c, t, g, unknown, or other
ctccccgcggtggcggccgctctagaactagtggatcccccgggctgcaggaattcgtctcacccctagaaaaagaatggccatggccttcttttcgttttcggccctataaaactgatgatctgctgatgagacatcccactcgccggccgtccttgaagagcgagcagcaatggcgcaggagatcgagcacacccacctccccatccgcggcctcaacctccacgtcgcacaagtaggcacaggtgaactgggcacggtggtgttcctgcacggcttcccggagatatggtactcgtggcgccaccagatgcgggccgtggccgcggcggggtaccgcgccatcgcgccggactgccgcgggtacggcctgtcggagcagccgccggagcacgaggaggtctctcctgacgacctcatcggcgacgtgctgggcatcctcgacgccctcagcgtcccgaaggcgttnctggtggggcaaggactcggcgccatggcggcgtacgagttcgcgctgcagcacccggggcgcacctgcnngcgtggtgtgcctgggcatccccttcaacccggccccattacccttcgacccattatgcccgaggggatctaaatcctgccctgggcccaacccgggagggcgaagcccaatttcgcccgttccaccttaagggcctggggcgccccccttcacggt

SEQ ID NO: 63377 - protein, 146 aa, Zea mays
  misc_feature: Ceres CLONE 1530916
  misc_feature: SWISSPROT Homolog: EC 3.3.2.10 Soluble epoxide hydrolase
  misc_feature (99)..(99): Xaa is any aa, unknown, or other
  misc_feature (123)..(123): Xaa is any aa, unknown, or other
MAQEIEHTHLPIRGLNLHVAQVGTGELGTVVFLHGFPEIWYSWRHQMRAVAAAGYRAIAPDCRGYGLSEQPPEHEEVSPDDLIGDVLGILDALSVPKAXLVGQGLGAMAAYEFALQHPGRTCXRGVPGHPLQPGPITLRPIMPEGI

SEQ ID NO: 63378 - DNA, 851 bp, Zea mays
  misc_feature: Ceres CLONE 1530919
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (260)..(260): n is a, c, t, g, unknown, or other
  misc_feature (302)..(302): n is a, c, t, g, unknown, or other
  misc_feature (309)..(309): n is a, c, t, g, unknown, or other
  misc_feature (312)..(312): n is a, c, t, g, unknown, or other
  misc_feature (361)..(361): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (413)..(413): n is a, c, t, g, unknown, or other
  misc_feature (425)..(425): n is a, c, t, g, unknown, or other
  misc_feature (426)..(426): n is a, c, t, g, unknown, or other
  misc_feature (428)..(428): n is a, c, t, g, unknown, or other
  misc_feature (429)..(429): n is a, c, t, g, unknown, or other
  misc_feature (435)..(435): n is a, c, t, g, unknown, or other
  misc_feature (458)..(458): n is a, c, t, g, unknown, or other
  misc_feature (492)..(492): n is a, c, t, g, unknown, or other
  misc_feature (508)..(508): n is a, c, t, g, unknown, or other
  misc_feature (509)..(509): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (540)..(540): n is a, c, t, g, unknown, or other
  misc_feature (549)..(549): n is a, c, t, g, unknown, or other
  misc_feature (550)..(550): n is a, c, t, g, unknown, or other
  misc_feature (575)..(575): n is a, c, t, g, unknown, or other
  misc_feature (581)..(581): n is a, c, t, g, unknown, or other
  misc_feature (584)..(584): n is a, c, t, g, unknown, or other
  misc_feature (588)..(588): n is a, c, t, g, unknown, or other
  misc_feature (616)..(616): n is a, c, t, g, unknown, or other
  misc_feature (667)..(667): n is a, c, t, g, unknown, or other
  misc_feature (677)..(677): n is a, c, t, g, unknown, or other
  misc_feature (684)..(684): n is a, c, t, g, unknown, or other
  misc_feature (698)..(698): n is a, c, t, g, unknown, or other
  misc_feature (708)..(708): n is a, c, t, g, unknown, or other
  misc_feature (709)..(709): n is a, c, t, g, unknown, or other
  misc_feature (732)..(732): n is a, c, t, g, unknown, or other
  misc_feature (739)..(739): n is a, c, t, g, unknown, or other
  misc_feature (751)..(751): n is a, c, t, g, unknown, or other
  misc_feature (765)..(765): n is a, c, t, g, unknown, or other
  misc_feature (773)..(773): n is a, c, t, g, unknown, or other
  misc_feature (781)..(781): n is a, c, t, g, unknown, or other
  misc_feature (800)..(800): n is a, c, t, g, unknown, or other
  misc_feature (811)..(811): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (830)..(830): n is a, c, t, g, unknown, or other
  misc_feature (848)..(848): n is a, c, t, g, unknown, or other
nnnnnnnnnaaaagggggggggaggaataaacttccctcnnnnnnttnnnnnnnnngcaagctggcactccccgcggtggcggccgctctataactagtggatcccccgggctgcaggaattcgtctcacccctagaaaaatctcgccgagttattagaaggcggggaaaaaaatcaactcgaacgggcgggtggcaaccaaccaccaagcggcgagggcgatggcggcgtcctcgccgcggaagcggctccctgctgcncgcctcatcttcgccctcctcctgatgtcctccgtgctgccncgggacnccngggcggtggaactggggcttgagctgccctttagtccggggggagtggnttgtggtttggtggggttgggggggttggcccgttcttggannngggtccgnaagcgcccgtcnnanntacctncccctttttttgggtgccaggcntgtggagggggtggggtgtgtggggggcgccccnccccacccacacaaanngnnntccaaaaacccccccactcaaaaaacnaatggaccnnccccacgccgcacatccaaaagganaagtgnaanaccnacacgcgctgggcccactaatcaccagncaaggtcgccccctaaacccagcaggcacccaaaaccccgcgcaaccccancccacccccncacccgnacacccggcatagncggacgaccnntctcgctcaccagcacaagaccntcatcantcacccgcccancgggccccacaagncgacgccnacgcacgnaccagagacccacgcagcnctacccgcganannnatttcacgccggaancgcaagacatgagcatantcg

SEQ ID NO: 63379 - DNA, 711 bp, Zea mays
  misc_feature: Ceres CLONE 1530927
  misc_feature: Encodes the peptide sequence at SEQ ID NO. 63380
  misc_feature (456)..(456): n is a, c, t, g, unknown, or other
  misc_feature (457)..(457): n is a, c, t, g, unknown, or other
  misc_feature (512)..(512): n is a, c, t, g, unknown, or other
caaagctggagctcaccgcggtggcggccgctctagaactagtggatcccccgggctgcaggaattcgtctcacccctagaaaaattttctccttggaacaagacagacaatactggagacgaaagacggcggcaacacctggttccctcgctccatcccttccgcagaggacgaagatttcaactacaggttcaactcggtaagcttcaagggcagagagggatggattatcggcaagcctgcaattctactgcacacctcagatgctggcgagagctgggaaagaatacccctgagtgcccaacttcctgggaacatggtttacataaaagctactggggagcagagcgcagagatggttaccgatgagggagcaatctatgttacctctaaccgtggatacaactggaaggctgccgtgcaggagaccgtttcagctactctgaacagaacanngttcagtgcattagctgtgcaagctactacactgggactttcaacacggtgaacngatcggcccaacgacgctacgtgggtggtgtccagccaaagggaactcttactgaaatggggaacccggggaaccttttttggaaaccccaaaaaggggcgggggcagggggaatccaaacttggggggaaaacccaaaggggaatttttcctccttgtcacccgggagagcctcttctcccaaaaaaaaccgggaaaa

SEQ ID NO: 63380 - protein, 63 aa, Zea mays
  misc_feature: Ceres CLONE 1530927
  misc_feature (47)..(47): Xaa is any aa, unknown, or other
MVYIKATGEQSAEMVTDEGAIYVTSNRGYNWKAAVQETVSATLNRTXFSALAVQATTLGLSTR

SEQ ID NO: 63381 - DNA, 642 bp, Zea mays
  misc_feature: Ceres CLONE 1530930
  misc_feature: Encodes the peptide sequence at SEQ ID NO. 63382
  misc_feature (95)..(95): n is a, c, t, g, unknown, or other
  misc_feature (112)..(112): n is a, c, t, g, unknown, or other
aagctggagctccccgcggtggcggccgctctagaatagtggatcccccgggctgcaggaattcgtctcacccctagaaaaaaccgagctcaaancacacatcaagaaagcnaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggagggccgccctgtgacgatcgaggacgtggacctcagctctcatcaggccgcggccgacgacggggagctcgccgcgccgtgggcgggagggtccacgcagcaccacttggggaagggtctgctgaccccattcgacgggctggctcctccaggagctcatccggtacggggaagttcgccccaggcaacctagaacggcttcgaaatacgaccgctcctccccctac

SEQ ID NO: 63382 - protein, 116 aa, Zea mays
  misc_feature: Ceres CLONE 1530930
MAATVSSCLSLVPTVHHRAGGFPSSVALTNTLQRRRRSRRYLVVASATRAEQEGRPVTIEDVDLSSHQAAADDGELAAPWAGGSTQHHLGKGLLTPFDGLAPPGAHPVRGSSPQAT

SEQ ID NO: 63383 - DNA, 661 bp, Zea mays
  misc_feature: Ceres CLONE 1530931
  misc_feature: Encodes the peptide sequence at SEQ ID NO. 63384
  misc_feature (641)..(641): n is a, c, t, g, unknown, or other
gcggtggcggccgctctagaactagtggatcccccgggctgcaggaattcgtctcacccctagaaaaaatcaccccccccaaatcgaccacccctccctctccctctcttaagatcgccggcgaggggagagccgagaggcgcagggcagcccccgccgacgctcccgctcccgccgctgccgcagccgcagccgcagccgtagcggcattttgtcgagcatatggcgctcgtgcccagcggcggcgcgggcgcttgcaaggacgaggccgcccttgggctcccgtggtccgaaatgttccgctccgcctcgcgccgccggcccaagcaggagtccgacgatgcgccgcccaagaagcccgcgctgaagacggcgggtgccaaggagatgaaggccaagccgtcgtcggtagggactggagctggggcaggagccgacatcccaggggtggtcgctggagcccgacgcgcgcccggggggctcttccttccgccttggcggcacgcgggggccttggccacccggggctggtttggggggctctacggggccttttttccctggtggggtttcgcccgaaactttccctctcccgccccccgcttgcaaggggggggcggttgggctcttgtggcccccgngttcccggccttcccgcgag

SEQ ID NO: 63384 - protein, 146 aa, Zea mays
  misc_feature: Ceres CLONE 1530931
  misc_feature (140)..(140): Xaa is any aa, unknown, or other
MALVPSGGAGACKDEAALGLPWSEMFRSASRRRPKQESDDAPPKKPALKTAGAKEMKAKPSSVGTGAGAGADIPGVVAGARRAPGGLFLPPWRHAGALATRGWFGGLYGAFFPWWGFARNFPSPAPRLQGGGGWALVAPXFPAFPR

SEQ ID NO: 63385 - DNA, 1026 bp, Zea mays
  misc_feature: Ceres CLONE 1530938-R
  misc_feature (1)..(1): n is a, c, t, g, unknown, or other
  misc_feature (237)..(237): n is a, c, t, g, unknown, or other
  misc_feature (240)..(240): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (481)..(481): n is a, c, t, g, unknown, or other
  misc_feature (675)..(675): n is a, c, t, g, unknown, or other
  misc_feature (730)..(730): n is a, c, t, g, unknown, or other
  misc_feature (894)..(894): n is a, c, t, g, unknown, or other
  misc_feature (1026)..(1026): n is a, c, t, g, unknown, or other
natttaacacaaattgggtaccggggcccccccttccgaggcgacggtatcgataagcttttttttttttttttttggcggctcgcccgggcataaaaataaccctcagctttcccgatgaacacatgagtatattcagtcatacaaattgatgctactgcggtctaataaccataatagtcaccacaaccgagatatccccagtccaaaagggggagggtttcatgattattgacnacnaaatagtagtacaagagtcctcaattgcttccatgaatacccaactctaagcaatgaacaaacgaatatccagtcactggaacagtttacacttaattnnnntattccacgtcttaccaccgattgagaaccaacaaaaaaaattcaattgaaagcaccaagggctgctaataaaaatgggtcaacccatgaaactgggctgccggaagaaatttcgactcataaaaagggccccatttanccttggatcaggcctaaaaggacccaaaaattattaagccccgggtcccaaaggggggggaaatcccctccttttaaaccgccgggggtaaaaaacaaagacctctttttccccaaataggggggctttctgcacaaagcccccctctctattttcggggagaaataataaaaaatgaggtttcccgcggaaantctccagaaatggggaaaacccatattgggcgcctttttgtatacaacattgggnagggggtttcaccacccaatgttctgcaccccccctttgggggtggccacaattactcaacccctaaaaacttttatacacaagaaacaatctctaaaaaggaggggacccccggggatgagaataaaaagagggaggccacgcggctggttttcctctcttcnaaaagggagaacccccgcatagaatgaccactttttggtttgggggcacggagaaccgacgaaacaacaaggttgggcggttggccccctaaaaaaggggcacatttcaccccaagaaagaataaattatan

SEQ ID NO: 63386 - DNA, 690 bp, Zea mays
  misc_feature: Ceres CLONE 1530938
  misc_feature: Encodes the peptide sequence at SEQ ID NO. 63387
  misc_feature (424)..(424): n is a, c, t, g, unknown, or other
  misc_feature (425)..(425): n is a, c, t, g, unknown, or other
aaagctggagctccccgcggtggcggccgctctagaactagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcacagaaaaannggagggggggggcccgggccaggaaaccccgaaaagttcttgagccctgctggccgtcgccgcccatggaagctccccatcatcgggcaccctgcacctgatggggggacttcccctaaggggtccctggccggggtttgcaaccaaggaaacggccggaacctgatgcttgctccggcctgggcgccctggccaaaccgggggggtttttttcccccgcgggttcccaaagagcggggctcccgcccttaaaaacaaggttttt

SEQ ID NO: 63387 - protein, 85 aa, Zea mays
  misc_feature: Ceres CLONE 1530938
  misc_feature (52)..(52): Xaa is any aa, unknown, or other
  misc_feature (53)..(53): Xaa is any aa, unknown, or other
MAAQLHHALYELLHEAAAAQRALLLAIPFSLLLLPLLLRYLAASASASAQKXXRGGARARKPRKVLEPCWPSPPMEAPHHRAPCT

SEQ ID NO: 63388 - DNA, 606 bp, Zea mays
  misc_feature: Ceres CLONE 1530944
  misc_feature: Encodes the peptide sequence at SEQ ID NO. 63389
tccccgcggtggcggccgctctagaactagtggatcccccgggctgcaggaattcgtctcacccctagaaaaactccagcccgcggtccagcccctgtccccgtcacctcctctgctccgtagcgccgccatccgtggcggcggcaatctaccgaacaccgtgcgtgcgtgtgttgccgcaatggcctcgcaccacctcgccagccccgccgcggccgcaacctccgccgccaccgtctccagggctctcttcaagcatgcctacactaaaccctcttactcccttctccacgccccgctcctccgcgccgtcgccgcccggcccgcgctcctctccgccgccaccgcggtctccactacggcggcgcccgcggccgcagctatggacaacgtggaggagtgggggctgaggccgctggccgaggtcgacccggaggtgtacgacctaatcgagcgcgagaagcggcggcagcgagcgggtatcgagctcatcgcctcggagaacttcacctcgctcgctgtcatggaggcgctgggctccccgctcaccaacaagtactcggagggcatgccgggggcgcgctactacggcggcaacgaggtcat

SEQ ID NO: 63389 - protein, 141 aa, Zea mays
  misc_feature: Ceres CLONE 1530944
  misc_feature: SWISSPROT Homolog: EC 2.1.2.1 Glycine hydroxymethyltransferase
MASHHLASPAAAATSAATVSRALFKHAYTKPSYSLLHAPLLRAVAARPALLSAATAVSTTAAPAAAAMDNVEEWGLRPLAEVDPEVYDLIEREKRRQRAGIELIASENFTSLAVMEALGSPLTNKYSEGMPGARYYGGNEV

SEQ ID NO: 63390 - DNA, 975 bp, Zea mays
  misc_feature: Ceres CLONE 1530949-R
actccctctgtagatagctgatcaatgccacgtcggacctgatagaaaggacagctagttcagaagtacctccgatgggatgttttgtgatgggtgaggatacatcaggaaaggggcatttaaaagaaacaaaaacatcggtgacatctgcagacttcataacatccaactgctatagcaagtgccatgtatgtatgaggggaaaaaactgcctttctggataatgtcaataccaaaagcggttatgtttaggccacacaatcttctcggcaattggagaatgaagacggctcatccttacgccttctccgtcgatggctagactagacatcagggcggcgattcttcactcctgctcactatgggggccgacatgggcgggatacttcccacaaacatcagtgcatgtgctttggccttccgtcagctgcttcaccatgggggccacctcgtcgatgttcaccccgacctgctgcttgcttgtcgctctgctctgatcatcacgtttcgttgccgaattccactggttccgacaaatggaaagaccgaatctccttcccttccatggaggtacctccctcgccaaaaagaaaatgtgccgggaggtgggtcaattgaagtgtggggggagaagcacaccccaagcggggttaaaatgacccttcggccggaattagctattgtggtgagccattcggtccaaaacttctttgggttctcttaccaacagcgtggtaaacaaacgggtggccctaggtatgatggggcgcctcccccatgtagtgggcggccgggcagaaaaatagaagcgcgggttccttcgttccttgaatggagggaggggccctagttggtagaaataaagggccgtgcttccaaagtcgggggggaggaacccgcccttattggctgcaataagagcctcgcccgaccctaggggagggtgaaaacttgctgcggagtttctgcgcttgg

SEQ ID NO: 63391 - DNA, 629 bp, Zea mays
  misc_feature: Ceres CLONE 1530950
  misc_feature: Encodes the peptide sequence at SEQ ID NO. 63392
  misc_feature (341)..(341): n is a, c, t, g, unknown, or other
  misc_feature (349)..(349): n is a, c, t, g, unknown, or other
  misc_feature (384)..(384): n is a, c, t, g, unknown, or other
ggagctccccgcggtggcggccgctctagaactagtggatcccccgggctgcaggaattcgtctcacccctagaaaaagcagcactagcactggtaccagcaaccttcacgagctgcgtggtgaggttgaccaggactccttccggatcctgaaataaggccaccgctcgtttcctctccacctccctcctccttcactccctccccttgcgtttagcctcccgctgttgtggagccgcgggccattcccaaccatcgttgcggtggtggccggtattggccgagacccatgggcatccaggtcgcggcggtcgtgatcccgccgccctgctcttctcttncctcctcntcggcgtcgccttcgtcctcggccattgccacgtncgcgcaccatgccggtcctgccgccaggctggcgaggaccaatcctcccctggctgcttgaaagccgccgggtctggccggcggcccggcgggggacaaccaatcagggcgcgtctcagcgcaaacttccaaagctttggggaacaaaggcggggaacaaaaggattttccaaggagaacccgggaccccccggggggtcaaaaccccgggcccggggcggctgggcgtgcccccccgccttgaa

SEQ ID NO: 63392 - protein, 79 aa, Zea mays
  misc_feature: Ceres CLONE 1530950
MPVLPPGWRGPILPWLLESRRVWPAARRGTTNQGASQRKLPKLWGTKAGNKRIFQGEPGTPRGVKTPGPGRLGVPPRLE

SEQ ID NO: 63393 - DNA, 679 bp, Zea mays
  misc_feature: Ceres CLONE 1530953
  misc_feature: Encodes the peptide sequence at SEQ ID NO. 63394
ctggagctccccgcggtggcggccgctctagaactagtggatcccccgggctgcaggaattcgtctcacccctagaaaaaacagccatcacacgcatacctgtatacacaacgcacagcatcagaagcagatgctatctgatccacttggctgccccactcatggctatcacctccagagagatcgacagcaagccagggacaggaagatgggatctccttccacgaggaccggatagccgtttcccagacccccgacgggacatcgacgatctgccgcggaacgacatggactagtgcgcactcactcctgtctggttgctcgatcgcgcggtcctcgcccatctaggtgaggcctcagtcctgcagcgactcctgctcgaacactgggctgatatctatcgacgctgacaccttctccaataagccctagctcgactgtatctactgcaggtaggccatgctgctgtgatatctcctaatgttccgggtagctatcaacctcaattgcgtgtcactatgtcaaggagctgttgttaactgcggccatcctcatctacacggagagacggttggattcctccgtgaacactagcctgcataacttgtcatagatcatcaacatctcggcatgctcagccgatgatcatgtgacgctaattaggggatacgaagacatc

SEQ ID NO: 63394 - protein, 44 aa, Zea mays
  misc_feature: Ceres CLONE 1530953
MAITSREIDSKPGTGRWDLLPRGPDSRFPDPRRDIDDLPRNDMD

SEQ ID NO: 63395 - DNA, 656 bp, Zea mays
  misc_feature: Ceres CLONE 1530963
  misc_feature: Encodes the peptide sequence at SEQ ID NO. 63396
aagctggagctccccgcggtggcggccgctctagaactagtggatcccccgggctgcaggaattcgtctcacccctagaaaaaagcggaattcacataaaaaagcatgaaccctcgcaccggacctcaattaaaaaccgcagaaaaggaatcaatccgaccatccataaaaaggacggcgacgcggtcaccactacggcaccgccgccgccgccatcctcgacccctgaagtgaagaggcaacccgaggacgcctctcccatccacgcgcgaatcctaccgccctcacacacccaaaaacctagccgcgcgcggcacctgcatcccatggcggcaaccgcggccgcggcggggaccgggtcgtccctctcctcgcgccgcagtcgcagcgctgtctcctcgcccttccgcgcagctgcctcgcgcttccgctcgccgagatgcgtgctcgggagcgagcagctgcgggtggcgcatgaagggaagcggatgagcggcaccgagtccaggaccgccgcgtgggcgccaaaggtgcccgcaccggagtccaggcttgccgcactgccaagggagctgcgggactccaggatgaagatcttctccggcacggctaacccgtccgctcgctcaagaaattgctgcttacctggggtatag

SEQ ID NO: 63396 - protein, 109 aa, Zea mays
  misc_feature: Ceres CLONE 1530963
  misc_feature: SWISSPROT Homolog: EC 2.7.6.1 Ribose-phosphate diphosphokinase
MAATAAAAGTGSSLSSRRSRSAVSSPFRAAASRFRSPRCVLGSEQLRVAHEGKRMSGTESRTAAWAPKVPAPESRLAALPRELRDSRMKIFSGTANPSARSRNCCLPGV

SEQ ID NO: 63397 - DNA, 674 bp, Zea mays
  misc_feature: Ceres CLONE 1530965
  misc_feature: SWISSPROT Homolog: EC 3.2.1.4 Cellulase
  misc_feature (612)..(612): n is a, c, t, g, unknown, or other
  misc_feature (613)..(613): n is a, c, t, g, unknown, or other
  misc_feature (665)..(665): n is a, c, t, g, unknown, or other
ctccccgcggtggcggccgctctagaactagtggatcccccgggctgcaggaattcgtctcacccctagaaaaaaaatagaaaaaaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctggtggggccttgtggtgcgtcgtcgccgctttcgtcctcatcggcctccccatcatcatcgccaagtccatcccgcacaagaagccaggcccgccgccgccagatcagtacacagaggcgctgcacaaggcgctcctcttcttcaacgcccagaaatccggccaccttcccaagaacaatggcatcaagtggcgcgggaactctggcctgtcagacggctccgacgccaaggacgtcaagggtggcctcgtcggcggctactacgacgctggcgacnnacatcagttccacttcccgatggccttctccatgacgctgctgagcttgtcnggtgatcga

SEQ ID NO: 63398 - DNA, 634 bp, Zea mays
  misc_feature: Ceres CLONE 1530987
  misc_feature: Translation starting site: 220
  misc_feature: SWISSPROT Homolog: EC 3.6.5.5 Dynamin GTPase
  misc_feature (365)..(365): n is a, c, t, g, unknown, or other
ggagctccccgcggtggcggccgctctagaactagtggatcccccgggctgcaggaattcgtctcacccctagaaaaaaacgaccgacgcctagacgcggctgggcggtcggcctcacctcgttccccctcctcccttcttcctgctccgcgtctcgatctcgactcccccgccgcgtcgcgcgacccggccagatctcgcccaccctgcgccgcggccatggataacttgatcaccctcgtcaacaagctgcagagggcttgcacggctctcggagaccacggagaggagagcgccctcccgacgctctgggactcgctgccggctatcgccgtcgttggaggacagagctctggtaaatcatnctgtgtttggagagcgtggttgggaaggatttcctaccgaggggttcaggcattgtaacccgtcgtccgctggtgctgcagctcacagaattgatggtgacagggaatatgcagagttcatgcatcttccgagaaaagatttacagattttgctgctgtgagaaaagagatagctgatgaaactgaccgagaaacaggccgttcaaagcaaattatcactggtccctatccatttaagcatattttctcccccgtgttgggaacctacc

SEQ ID NO: 63399 - DNA, 1131 bp, Zea mays
  misc_feature: Ceres CLONE 1530988-R
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
tggcgggttgttttctctttgccgtagtggccgtgtttatgctctctggggggttgttccttgtgggggggcgnnnggggcgtctctctgtggctgggggtgttgatttcgtggatcccccaggctgcaggtgcttcgttgctcttacttattccacaaggccacggtcgggaactacttactgttcgttccagcatgctatagtaaacaactctgcaacaacatcatccccaaaaaacaagcaaacaacaaaattggtatctagtctgtcttgaatctgtgtgaaatcctctccaggccgtccttgcactcttccattgccctcttcgacttgtctcccagggtgcaccaaacgcagatacccttcccttcacttgggctgatacctcgtttgccctgggagcaacacaagccccatattgggtccaccctgcccttggatttggagcttggtggctttggaattgcaataaaagaacccccgggggggggaataacttcctttccaacgggggccccgtgagagccccccccttctttttttagcccaaaaacctttgcgctgggagagctttctccccaagacaaaaaccttttccgggcccccgggggggtgaaaaaaaaacttcccggggcgaaaactgggggttttttttcatctgtggggtcccaagaggggttttttttccgcccccctctttttggttcctcccccccgccaggtcttttagaagaagggggggctagaaatactctccccgttgagaaaaaaaactctctccccccccgctttcgcagaaaagaaaaaacaaaaaacgtgggagaaaagaaacctccttctgtgagagcaccaccccgccccaccactatttggttggttccccggcgggtgggtcctctccctctcctataagaggaggagggggagtcgttccgcgcgttaccccccccccggagggagggggccccttttttgtttttgtgtaggttttcccctccccgctcctgtgtgtcggccccctaatagcgccccgcccggtggtgggtaccgtgtttaaagaaaagtgcccctgggtttactcttctcttcctcgccctgtctgttcaggagggattgcgagaataaaagag

SEQ ID NO: 63400 - DNA, 642 bp, Zea mays
  misc_feature: Ceres CLONE 1530988
  misc_feature: Encodes the peptide sequence at SEQ ID NO. 63401
tggagctccccgcggtggcggccgctctagaactagtggatcccccgggctgcaggaattcgtctcacccctagaaaaagctcaccctatctttctcttatcttacgccgtcgtcgtcctgctccggcgacggccaggcagccgagcagataaaaagagccgaagcagcaccaccaccacgtgcctctcttctcagcttgcctgcctcactgcacccggccacaagggcaagatgcccgcctctgtcgctgtctacccggccaagatggcatgctgtctccagctccaccatcttcgccggccgtcccctgctccgctccctgctcgggtcctcttcctcctctcgaccccgcgcctgcgccccgtcagagcgtctcccggctcgtccccgcccaactccttcgctggctggtcctccgactccgacagcgcggatgacggcgccgacaaatctactctagggttcggccgagcaggagctcctcctcaaggcttcttggacctggacttgctgccctttttcttcctcgccggcattaacttttgcctgccgtctctaataataagcattgggcacccaccccagctgggaaaaatggcaaaaacttggccttacagaaaactggctgcccacggaaatct

SEQ ID NO: 63401 - protein, 125 aa, Zea mays
  misc_feature: Ceres CLONE 1530988
MACCLQLHHLRRPSPAPLPARVLFLLSTPRLRPVRASPGSSPPNSFAGWSSDSDSADDGADKSTLGFGRAGAPPQGFLDLDLLPFFFLAGINFCLPSLIISIGHPPQLGKMAKTWPYRKLAAHGN

SEQ ID NO: 63402 - DNA, 799 bp, Zea mays
  misc_feature: Ceres CLONE 1530996
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (35)..(35): n is a, c, t, g, unknown, or other
  misc_feature (36)..(36): n is a, c, t, g, unknown, or other
  misc_feature (39)..(39): n is a, c, t, g, unknown, or other
ttttttttttttntnnttttttttatttttgtttnnttnttttaatttgatttcctctcctctcccccctgtggcggccgctctatactagtggatcccccgggctgcaggaattcgtctcacccctagaaaaaaaaagaggaaaggcttgcggtggatacctaggcacccagagacgaggaagggcgtagcaagcgacgaaatgcttcggggagttgaaaattagcatagatccggagattccctaataggtcaaccttttgaactgcctgctgaatccatgagcaggcaagagacaacctggcgaactgaaacatcttagtagccagaggaaatgaaagcacaagcgattcccgtagtaacggcgatcgaaatgggaagcagcctataaccgtgaaaactggggtttgttgggagaactatacaagcgttgttgctgctaggacgaaatcggttgatgtgcctgcacccctaacatggcttaagtccacttatgtcaaaagcatcactaatctttacgctctgtaccctttgtagtactgggggcacgttggaaatctccgtggtgaatcaagccagggatcaccctttggcaaggcttaaaatacctccctggggttgaactcaatagtctaatttaactatccgttgataggtaaatggttaaaaaaaaaaccccccaagtgcgtttagttgtttttatttaccttggaaatcctggtgtttttatttctcctaaacaatttggtggatagggtgaaactcttttatttctttcaactcccggtctccagctatg

SEQ ID NO: 63403 - DNA, 664 bp, Zea mays
  misc_feature: Ceres CLONE 1530998
  misc_feature: Pfam Name: Init_tRNA_PT Pfam Description: Initiator tRNA phosphoribosyl transferase
ggagctccccgcggtggcggccgctctagaactagtggatcccccgggctgcaggaattcgtctcacccctagaaaaagggccatattctagactaggaagtccaaaaccgcaggtcccatctctttccccatgggcgcggcggctccggaggctgcggacgaggttgcgccgtctgctacgctgagcgtctactaggcggcacggtgcatcaagcggctggcgagcacgctgtactacgcgctgctgagcgtggcggaggacgcgtccttcctggcggaggtcgcggcgctgtggccctcgttgccgctggtggccaacctccgctgcggtctctggtacagccccgccccgtgccttcacagccacctgctacttcaagtcctcggatggccacgcctggaactggtccttctcaactgcgacgactaacctccacctcgccctcctcgctggggagagatgagggtgcataatagttgattcaccatcgagagggaaactattccctgatagcatgtcaaagaccatacccatttggtgctctgtcttgaaccgagcgattgagagcatcggctgcaggctatcacgaaagtgccgaagtgattatcagtcgtctgccctgctgaatggtatgctcaaacaactctgatcttgctgattgg

SEQ ID NO: 63404 - DNA, 650 bp, Zea mays
  misc_feature: Ceres CLONE 1531000
  misc_feature: Encodes the peptide sequence at SEQ ID NO. 63405
ctccccgcggtggcggccgctctagaactagtggatcccccgggctgcaggaattcgtctcacccctagaaaaaaccagcaacagccaacatatctcctcgcgtttccttgcaaccgattgccttcccccctcccaacccaagaccgatggcgcccaaggccgagaagaagcccgcggcgaataagccggcggaggaggagcccgcggcggagaagacgaccgccgggaagaagcccaaggcggagaagcggatccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttctagaagctggccggcgaggccgccaagctcgcgcgctacaacaagaagcccaccatcacgtcccgcgagatccagacctccgtgcgcctcgtgctccccggcgagctcgccaagcacgccgtctctgagggcaccgaggccgtcaccaagttcacctcctcctatgcttgcacgctcgccctctgaggcttctcttgtgctgatggtcgcctagt

SEQ ID NO: 63405 - protein, 96 aa, Zea mays
  misc_feature: Ceres CLONE 1531000
MAPKAEKKPAANKPAEEEPAAEKTTAGKKPKAEKRIPAGKSAGKEGGEGKRGKKKGKKSVETYKIYIFKVLKQVHPDIGISSKAMSIMNSFINDIF

SEQ ID NO: 63406 - DNA, 690 bp, Zea mays
  misc_feature: Ceres CLONE 1531003
  misc_feature: Translation starting site: 153
  misc_feature (360)..(360): n is a, c, t, g, unknown, or other
ggatctgcccgcggtggcggccgcgctagaactagtggatcccccgggctgcaggaattcgtctcacccctagaaaaacagccgccgctacgctttggctgcatcactcgctcctcttcggagcctccctttcgccggcggcgtaggaagagatggcagagcgtttgacccgtatcgccatcgtcagcgaggacaagtgcaagcccaagaagtgccgccaggagtgcaagaagagctgccccgtcgtcaagactgggaagctttgcattgaagtaacttcggcatcaaaactagctttcatttctgaggagctgtgcatcggttgtggtatctgtgtaaagaaatgtccatttgatgccnttgaaatcatcaaccttccaaaagacttggtaaaggataccactcacccccatgggcctaataccttcaagttgcacaggttgcctgtccccaggcctggtcaggttttgggccttgttggaacaaacgggattgggaaagtcgacagctcttaaagtgttggctgggaagctgaaacctaacttgggggcggcttcaaaaacccacctgatttggcgggaaattctatacatacttttcatggggtctggactttcagaaattactttacccgcccttattggatagataaactggaaagggaaatcatccaaaccccaagtgaggggg

SEQ ID NO: 63407 - DNA, 1025 bp, Zea mays
  misc_feature: Ceres CLONE 1531005-R
  misc_feature (55)..(55): n is a, c, t, g, unknown, or other
  misc_feature (244)..(244): n is a, c, t, g, unknown, or other
  misc_feature (245)..(245): n is a, c, t, g, unknown, or other
acaatccaatttgctactaataaacaaaccaatgccaactgaaacagaataacancaacttatcatcaaaacacataacactaattaacgatttcttttctacgggtaaaactaaacagttcacacataaatacataaatactaattattgagagtttctttccttcaggtagagcttgacagctacaaatcattcaccaagttcagttgcaagttttgcaacaatggttgtgcctggacattnnaaatgcacaaagggagcagaaatagtgcccgcatctgcagatgatgaataggcaggcctcgatcctctccacatatatcttgcacttggggcacctctgccacaagctcactagcacgaccttcctcagaagtagggacgcccccacccccaaataattacacaatcgttgggaactccgcgcacagtgaaacgatgaatgccggggaaaccttgcgacatggccccagaaaaatcccggaagcctgttatggcgcacatacgacggtttgttagtccactttcccaaaccgagttccccggtgaatgatatatacgatatcggaggaaggagaaaattcccccctggaaggtgagacgacaagaggaaattttagaagtagaagttcacaagagatgaggtaagtgcgcggagaaagaaggctgaggcgaactgataattgtctcctgagtaaaaagcgcgagggcccgtcgggggaaaattagatgtagtggggtggtgaagtgcaaaaatataacggcggagatagaaaaaatcgggctccagtggagacggccaaggtgtgtataggggaaatgcccaattggacacattgaataatattgttctgtggagctatgtacagaggaagtaaatctcagaggtttcggccgcagtgtttatagtcgacagtgggacgcatgagtttcgtaccccacaacgacggatagagagtactgtgttattgagggccgcggtgcgatatgatgaataggagagaggaggctttgtgttgggctg

SEQ ID NO: 63408 - DNA, 638 bp, Zea mays
  misc_feature: Ceres CLONE 1531005
  misc_feature: Encodes the peptide sequence at SEQ ID NO. 63409
tggagctccccgcggtggcggccgctctagaactagtggatcccccgggctgcaggaattcgtctcacccctagaaaaaattccctctctttctcccgaaattttgcatctctgattctgatagaagctgttcatgaagaagaagaataatatccgtctgcacttaaaagaaaacagttgcgccagccagtgaggagaatagcttgaaattctgctccaactcctggtacgccttgtccccaatgcgtcgaccatatccgcgatcgctgcacgtcggaatggccggcctgatcgtggccgcagcggcgctggcgtgcctgctcgcggtcgccaccctgatgtgctgcgacgtcgcggagccgtcgtcgagctagcggtccgctctgctggagttcatcatcgcgtacccggacgagcgccgcctcgtgtggaacgtcatcacatcggcatgcggctaggtcgaggtcacgtgcgacatgccgactccatcgtcgggacgtgcgcctcccgggggtgggtctgctcgtggctttcccgacgggccagatcgggcggctcaacaaactgccgggtgctcttgatgggttccctgccgggtccttaagtacgttcgcccaagggaattgtttacagctttt

SEQ ID NO: 63409 - protein, 31 aa, Zea mays
  misc_feature: Ceres CLONE 1531005
MAGLIVAAAALACLLAVATLMCCDVAEPSSS

SEQ ID NO: 63410 - DNA, 678 bp, Zea mays
  misc_feature: Ceres CLONE 1531006
  misc_feature: Encodes the peptide sequence at SEQ ID NO. 63411
  misc_feature (41)..(41): n is a, c, t, g, unknown, or other
  misc_feature (48)..(48): n is a, c, t, g, unknown, or other
  misc_feature (74)..(74): n is a, c, t, g, unknown, or other
  misc_feature (459)..(459): n is a, c, t, g, unknown, or other
tggagctccccgcggtggcggccgctctagactagtggatnccccggnctgcaaggattcgtctcacccctagnaaaatcctcctcttcccattccactctctcactctctctaatcacaatttcgacactgatcggtactctctagtgtccgactcgtcacagttttagcgagagagacagagagcgagcgagggagaggaggatgggttccacttccacgggaccggtgagcgggttcgcggcgccggagcgggacatcgacgatctgccgcggaacgacgccaactacacggggctcactccgctctggttcctcgagcgcgcggcgctggcgcatccgggcagggcctccttcgccccccgccccgggcggggggggggggctgacacctatttttgctgcccccccctcgcatccgccctcgcgcgcctatccctcgggccccggaagccgggntgccggggataccccctaagggccccggctggtcttggaaggttacttccgggggtccaagtggaggagggggttggggactggggtaaattttccggctaaacccccgggaccaggggggttcccgctctgaaaacgcgcgggccgaaagtgggggtgggggggacccaaggatactttcgccccgtgacggaagaagtgccccaagatatacggggc

SEQ ID NO: 63411 - protein, 118 aa, Zea mays
  misc_feature: Ceres CLONE 1531006
MGSTSTGPVSGFAAPERDIDDLPRNDANYTGLTPLWFLERAALAHPGRASFAPRPGRGGGADTYFCCPPLASALARLSLGPRKPGCRGYPLRAPAGLGRLLPGVQVEEGVGDWGKFSG

SEQ ID NO: 63412 - DNA, 625 bp, Zea mays
  misc_feature: Ceres CLONE 1531008
ctccccgcggtggcggccgctctagaactagtggatcccccgggctgcaggaattcgtctcacccctagaaaaaggattccactactccctcgtcctcggagcagttgctgcagctgcaacccccctgcgcctctcttctcccggtcccacccgcccctccaccgcctagggcttccaaatcccctcagcttccccggattccgctttcccccgtcgctgcaaggttccgggaggttctaatctcctttgagcgccgcctgcccgccgttgctgtttctcggtgttcaccgcgttcctccgtgcaatgcggggcctaaacgcggctggggttagggttcctggcacgcagctcgcttcaatttgattttttggaggtttttatagggaggagaagaatccgagatttcgaggagtcagtggttgcgtgcttgtctcggcggaggggaatctcaagttcgtggccggggttttagctcgacgaggcggtcaattttctacgagggattggaattctttggtcggttttgaggtgcccgtgtggaaagaaagcccggtaatttttgaatttttgggcggtaaaaacctgctggttaggctgtggtggtttccatggccggggcgccg

SEQ ID NO: 63413 - DNA, 664 bp, Zea mays
  misc_feature: Ceres CLONE 1531009
  misc_feature: Encodes the peptide sequence at SEQ ID NO. 63414
ggatcccccgggctgcaggaattcgtctcacccctagaaaaatcatggccatcgccctcgccaacggcggcggcaagccccccgactgggaggacttcgtcggcatcatcgtgctcctggtcatcaactccaccatctccttcatcgaggagaacaatgccggcaacgccgcggccgcgctcatggccaaccttgctcccaagaccaaggttctgagagatggccgatggggcgagcaagaggctgcgatcttggttcctggtgacatcgtcagcatcaagctcggtgacatcgtccctgccgacgcgcgtctcctcgagggcgatccctctcaagggtgaccagtccgcgcttaccccggagagtcgctcccccccaccaaggggtcccgggagacgaggtgttctcggggtcccccctgcaaacagggcgaagatccaggcccgggtgatcgccaccggagtggaaaccttctttcgggaaagggcgctcacctcgggggaacaccaccataccaggggggggaattttcaagaagggtctgaaaggccaaccgggaaacttcctcaaatctggcccaaaagaggggggggcattcctccgtcgaaaaatcatccgtcatgtttccccgaatcccagacaccccagaggtaatccctaaccg

SEQ ID NO: 63414 - protein, 112 aa, Zea mays
  misc_feature: Ceres CLONE 1531009
  misc_feature: SWISSPROT Homolog: EC 3.6.3.6 Proton-exporting ATPase
IPRAAGIRLTPRKIMAIALANGGGKPPDWEDFVGIIVLLVINSTISFIEENNAGNAAAALMANLAPKTKVLRDGRWGEQEAAILVPGDIVSIKLGDIVPADARLLEGDPSQG

SEQ ID NO: 63415 - DNA, 671 bp, Zea mays
  misc_feature: Ceres CLONE 1531011
  misc_feature: Encodes the peptide sequence at SEQ ID NO. 63416
ctccccgcggtggcggccgctctagaactagtggatcccccgggctgcaggaattcgtctcacccctagaaaaaaatcgtccaggtcagcacaacccttctcctcttcccccaataatccagtattccaggcgttcttccctctccctcctttgctatttttctgctgctcctccacctcttctgttatgtttggtgaagggctgaaggtaagaagctgggaacgtgcagcaaggctgcaaaaacatgtccattaatccagtcagggttcccttggatgcatatatgatggactttgtcttctctgagtcagaaggtggaatatatgacaataggaatgggatggactatcatattcctgtgtctgattctgttgcaagggaacctccaatgcatattgtacacattgcagtggaaatggctcctatcgcgaaggtcggaggccttggtgatgttgttacaagcctttcacgagctgttcaagatttaggccataaagttgaggttattctgccgaaatatgattgtttaaaccttaacagtgtgaaggatttacgctaccaacaaagttttacttggggtggccagagataaaagtatggtttggaaaggttgaagatctccctgtttatttcttggaacacaaaatgggatgttttggggttagatgtc

SEQ ID NO: 63416 - protein, 115 aa, Zea mays
  misc_feature: Ceres CLONE 1531011
  misc_feature: SWISSPROT Homolog: EC 2.4.1.21 Starch synthase
MSINPVRVPLDAYMMDFVFSESEGGIYDNRNGMDYHIPVSDSVAREPPMHIVHIAVEMAPIAKVGGLGDVVTSLSRAVQDLGHKVEVILPKYDCLNLNSVKDLRYQQSFTWGGQR

SEQ ID NO: 63417 - DNA, 859 bp, Zea mays
  misc_feature: Ceres CLONE 1531012-R
  misc_feature (1)..(1): n is a, c, t, g, unknown, or other
nccgatttgggtaccgggccccccctcgaggtcgacggtatcgataagcttttttttttttttttttaaagaaaagagatgcagagtgccaaccatacctaaagaaaagagcaaaaagaacaggatgcaaagatgttcttctgatcaggaaagaagaagaactgcttgagggtcggttgatgcatcaagctctgtacgtactggtcagggctgactaccgatgctagaactactactagaatgggacatcagatgctctcttctcctcccttgattttgctccatctgcaaggacagacagcacgtctctctctagaagaagtcagctcccagcgccggctgcccctgtggctggctcgccggcgctgctggcggctgtcacccagggggggcttaggaagggctcccccacgacgtcgaagagcgaggacgtcggtgccccggcgtcggcatcggcgccggtgctgaggaacaggagatcgtcctcaccggccatctccatgtcctccaccagcagctcgtcctcctcctcctcctcctcgtcgtcctcctccatggacggcgtgcgcagcggcgtcgtgggcgagagccccgcggtcgacgtggacgtcgggctcgggctcggctgccggtcctgcgcgtcaccgcccaccacgacggacggcggcggcggctgaggcgccgccgacgacgggaacttttggcgggtggtgccggcaagccagtttcggtgggtccgccgcccctggttgtgctccccggcggaagtgaggaatcaaattgttgggggtcctttctaccgaaaatatgaagggtttttggcgcggacgaagccatgagggggtttgttttcggggca

SEQ ID NO: 63418 - DNA, 672 bp, Zea mays
  misc_feature: Ceres CLONE 1531408
  misc_feature: Encodes the peptide sequence at SEQ ID NO. 63419
  misc_feature (375)..(375): n is a, c, t, g, unknown, or other
  misc_feature (432)..(432): n is a, c, t, g, unknown, or other
ctccccgcggtggcggccgctctagaactagtggatcccccgggctgcaggaattcgtctcacccctagaaaaatctcccgcagagcagccgacaactctctaccgtccgagaccccaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcaggncgacgaggatcaagcttacaggaaaatcaggctccgtgctgaagatgtgcagggcanggatgtgctcacaaacttttggggtatgaattttaccactgataaattgagggtccctagtgaagaatggcaaacattattcgaagcccatgttgatggcaagacacccaacactacttggtgcggttgttccgcctcgccttcaccaagaggggcccaaacaggtcaaaagaacctgctatgttcaggcatcccaaatcgtcaaaacccccaaaaaagggttaaatttatacccccccc

SEQ ID NO: 63419 - protein, 173 aa, Zea mays
  misc_feature: Ceres CLONE 1531408
  misc_feature (11)..(173): Pfam Name: Ribosomal_S3Ae Pfam Description: Ribosomal S3Ae family
  misc_feature (75)..(75): Xaa is any aa, unknown, or other
  misc_feature (94)..(94): Xaa is any aa, unknown, or other
MAVGKNKRISKGKKGGKKKTVDPFSKKDWYDIKAPSVFSVRNIGKTLVSRTQGTRIASEGLKHRVFEVCLADLQXDEDQAYRKIRLRAEDVQGXDVLTNFWGMNFTTDKLRVPSEEWQTLFEAHVDGKTPNTTWCGCSASPSPRGAQTGQKNLLCSGIPNRQNPQKRVKFIPP

SEQ ID NO: 63420 - DNA, 671 bp, Zea mays
  misc_feature: Ceres CLONE 1531412
  misc_feature: Encodes the peptide sequence at SEQ ID NO. 63421
  misc_feature (31)..(31): n is a, c, t, g, unknown, or other
  misc_feature (40)..(40): n is a, c, t, g, unknown, or other
ggcggccgctctagaactagtggatcccccngggctgcanggaattcgtctcacccctagaaaaaaaaatccggcccggcccaacactagtagcgtagctgagagcctgagacgatggccgactactaccacggcggcagggccatgtactccaacactgacgagtgctatgacgccggcaggcacggcggcagcgtgagggcgtactcgcgcaccgacgagtactacgacaacgtggacgaccgcatgaggaggcccgcgtacggcgccgacgactgcggctacggcggcaggcagaccgccgtgtacgccgacgagtactcccgcggcggccgctacgaaggctacggcgtcgagcaggagcacttccagagggaggaagaaagagcataagcccaaggaaccgcctcggccaaagtgggcgccctcgcgggcgggcccttttgctctggaccaaggggaccctgccaagaaaggacccggccaaagccccaaaggccaagaatccagggccgggggggcaaccgggggggggccttgggccccgggggctaaccttaacccaaagaccccggaaaaaaaaagaagcccccctacaaaaaaccggccccaggaaccccaggggggcgcccccgggacccggggaaccggaccgggttatcccttaaaat

SEQ ID NO: 63421 - protein, 92 aa, Zea mays
  misc_feature: Ceres CLONE 1531412
MADYYHGGRAMYSNTDECYDAGRHGGSVRAYSRTDEYYDNVDDRMRRPAYGADDCGYGGRQTAVYADEYSRGGRYEGYGVEQEHFQREEERA

SEQ ID NO: 63422 - DNA, 726 bp, Zea mays
  misc_feature: Ceres CLONE 1531413
  misc_feature: Encodes the peptide sequence at SEQ ID NO. 63423
aaaactggagctccccgcggtggcggccgctctagaactagtggatcccccgggctgcaggaattcgtctcacccctagaaaaactactcgtctccacggaatcgatcgatcggtgctttgatctctgagcctgagcaagcggtcgagctcaccaaccgccacgctcaagacaggtcgagtagctagctagctgccggagtggaaaaggaggcggtgcagtggcatggggaggccgccgtgctgcgacaagatgggggtgaagaaaggcccgtggacccccgaggaggacctcatgctcgtctcctatgtccaggagcacggccccgggaactggcgcgccgtgccgaccaacaccggtgtgtgatgaatcatctggtgatgcagggcttgatgacgcgcgcggcggatggaattgcctttcaagatccaagctccgagcttacttgatttttttgtttgtttgttggtttggtcggcacgtgtgcgcgtgtgtgcagggctgatgcggtgcagcaagagctgccgattgcggtggacaaactacctccggccgggaatcaagcgcggcaactttaccgagcaggaggagaagctcatcgtccacctccaggctctccttggcaacaggtgatggtcactcgccctgtcgtcgtcttaaagcttttgttcccgttttgttttttccgctgtaacaaatggatcggacaaaccaaatcatccacgcc

SEQ ID NO: 63423 - protein, 46 aa, Zea mays
  misc_feature: Ceres CLONE 1531413
  misc_feature: The sequence is a functional homolog of SEQ ID NO 1003 in the 11/479,226 US patent application
  misc_feature: The sequence is a functional homolog of SEQ ID NO 1800 in the 10/412,699 US patent application
  misc_feature: The sequence is a functional homolog of SEQ ID NO 2046 in the 10/374,780 US patent application
  misc_feature: The sequence is a functional homolog of SEQ ID NO 432 in the 10/412,699 US patent application
MGRPPCCDKMGVKKGPWTPEEDLMLVSYVQEHGPGNWRAVPTNTGV

SEQ ID NO: 63424 - DNA, 732 bp, Zea mays
  misc_feature: Ceres CLONE 1531416
  misc_feature: Encodes the peptide sequence at SEQ ID NO. 63425
tccccgcggtggcggccgctctagaactagtggatcccccgggctgcaggaattcgtctcacccctagaaaaaatcttggtatacacgtaatatatacacactccctcgatgggcagcgtcggcggcggcggcgagagcaagctggagagcccgctgctgggcgcgtcgtcgacgggccacggcgaggcggtggtgagcgggcagctggagagcatcctgggcgacgcgtccgtgccgtgggggacgcggatggcgtcggcgtccgcggtggagatgcggctgctggtgcgcctggccccgcccgccgtgctcgtgtacatgatcaactacctcatgtccatgtccacgcagatcttctcgggacacctcggcacgctcgagcttgccgccgcctcgctcgccaccaccgggatccaggtcttcgcctacggcctcatgctgggcatggggagcgcggtggagacgctgtgcgggcaggcgtacggggcgcacaagtacgacatgctgggcatctacctgcagcgctcccccgtcctgctgatggccacgggggtggcccctggcgggcctgtaggccttcttccgcccccgtcctgctcctgctggggggattccctcgagatcgcggtcggccgcccgcccgtctccgggtaccggcctgggccccccaatattttccgccctacccccggccaactttcctcccatcccaaaaagttccatgggcaggg

SEQ ID NO: 63425 - protein, 207 aa, Zea mays
  misc_feature: Ceres CLONE 1531416
  misc_feature (65)..(197): Pfam Name: MatE Pfam Description: MatE
MGSVGGGGESKLESPLLGASSTGHGEAVVSGQLESILGDASVPWGTRMASASAVEMRLLVRLAPPAVLVYMINYLMSMSTQIFSGHLGTLELAAASLATTGIQVFAYGLMLGMGSAVETLCGQAYGAHKYDMLGIYLQRSPVLLMATGVAPGGPVGLLPPPSCSCWGDSLEIAVGRPPVSGYRPGPPNIFRPTPGQLSSHPKKFHGQ

SEQ ID NO: 63426 - DNA, 774 bp, Zea mays
  misc_feature: Ceres CLONE 1531418
  misc_feature: Encodes the peptide sequence at SEQ ID NO. 63427
  misc_feature (372)..(372): n is a, c, t, g, unknown, or other
ttagaacatgtggatcccccgggctgcaggaattcctctcacccctagaaaaaaagcgttccagatcgtactggaccaatctgccaccacactttgatcacacacagacacaggaagttgagatcaaaaaaatgcgggctgccgctactgccgccgggttctcggccgtgctgcccgccaagggcaagccggcagcgagaagcaggctggtgccccgtgtccccgccacaaagaagagcgtccgcccagctgccgacgacgcgaccgaggccccccaaatcgactactgttcaggcggcacgggggtcccgatgaaggccttttttttcccccccccaggaggggggggggggggcccatattcccaaaaanccaaggccccccccctcgggaagtacaggtcaaactcggtatgcttggcgggcgaggcgcccacgcacaattcacttccataggtatgagcttgatagaatcaagttaactccgcaggccaatccgatggacagtcaaaccatccggcggccgcggtccccgccgatacatctcttaatttagaatagaggattcttctaacgcaacaactagatcgcccgctcaaaaatacacacgagacccaccacctgccagaaaccagcgctcaggtagcccacgaaccagtggggacagaagtaatactctcttaccatttgttatactttcactcttttacagcccctcgacagcaacaacagctcctcacccacacacgacggtcggtaaagcttcacctccaca

SEQ ID NO: 63427 - protein, 107 aa, Zea mays
  misc_feature: Ceres CLONE 1531418
  misc_feature (81)..(81): Xaa is any aa, unknown, or other
MRAAATAAGFSAVLPAKGKPAARSRLVPRVPATKKSVRPAADDATEAPQIDYCSGGTGVPMKAFFFPPPGGGGGGPYSQKXKAPPLGKYRSNSVCLAGEAPTHNSLP

SEQ ID NO: 63428 - DNA, 659 bp, Zea mays
  misc_feature: Ceres CLONE 1531422
  misc_feature (1)..(1): n is a, c, t, g, unknown, or other
  misc_feature (189)..(189): n is a, c, t, g, unknown, or other
  misc_feature (194)..(194): n is a, c, t, g, unknown, or other
  misc_feature (199)..(199): n is a, c, t, g, unknown, or other
  misc_feature (228)..(228): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (320)..(320): n is a, c, t, g, unknown, or other
  misc_feature (333)..(333): n is a, c, t, g, unknown, or other
  misc_feature (351)..(351): n is a, c, t, g, unknown, or other
  misc_feature (352)..(352): n is a, c, t, g, unknown, or other
  misc_feature (354)..(354): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (438)..(438): n is a, c, t, g, unknown, or other
  misc_feature (439)..(439): n is a, c, t, g, unknown, or other
nagccccggagctccccgcggtggcggccgctctagaactagtggatcccccgggctgcaggaattcgtctcacccctagaaaaaagccatcacacgcatactgcatacacaacacagagcatcagaaggagctacgatctgatcgacatggctgccgccaccatggctatcacctccccgcgcgctcntcggncaagncccggcgggctgggcaccaagggaaagtncttcggcgagggccccttcaccatgcccaaaaccccccccaaccccaacccggggccccccggaaacccctgggacgggggnnnnaaaaccngggttttttgggnattttggggccccccccnntnttttgggtccccccccaaaaaccccaccccgtttttttttcccccccccccccggggaaagacggggggnnnnnnnnnnnnaanncccaaaactttttttgagaaaaaaaaaaaaaaaggagggccccccggggggggggggggggtccccccgccccccccaggccccgcccccccccccgcagggcctccccccccggggggggcggcatagcggaagggggcccgctgtgcttgccgctggcgcctcccccctcccaataccccgggcggggttgggctccctccccccgccctctctcccg

SEQ ID NO: 63429 - DNA, 765 bp, Zea mays
  misc_feature: Ceres CLONE 1531428
  misc_feature: Encodes the peptide sequence at SEQ ID NO. 63430
  misc_feature (13)..(13): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
cccccaccaaccnccaacaccccacctttttttnnnnnncaccctttttccaaagctggagctcaccgcggtggcggccgctctagaactagtggatcccccgggctgcaggaattcgtctcacccctagaaaaaagctttctggcatcgctactaccagacagagaggacaggggaggtcagactcagaaacgctcgctcacgacggcagcagccatggcagcatcgtgcggcggccgcgtggtggtcttcccgttcccgttccagggccacttcaacccggtgatgcgcctggcccgcgcgctgcacgcccggggcgtcgggatcaccgtgttccacaccgccggcgcgcgggcgccggacccggccgactaccccgccgactaccgcttcgtgcccgtgcccgtggaggtggccccggagctgatggcgtccgaggacatcgccgccatcgtcacggcgctcaacgccgcctgcgaggcgcccttccgggaccgcctctcggcgctgctctccgccgccgacggcgaggcgggggaggcggggggccgcgtccgctgcgtcctcaccgacgtcagctgggacgccgtgctgtcggcggcccgcggcctcggcgtgcccgcgctcggcgtcatgacggccagcgccgccacgttccgcgtctacatggcgtaccgcaccttggtcgacaaggggatacccgccgggggaaaagaggagtcgcagggactacgcgggtcgcccgaagctaccccccgttaccgc

SEQ ID NO: 63430 - protein, 183 aa, Zea mays
  misc_feature: Ceres CLONE 1531428
  misc_feature: SWISSPROT Homolog: EC 2.4.1.121 Indole-3-acetate beta-glucosyltransferase
MAASCGGRVVVFPFPFQGHFNPVMRLARALHARGVGITVFHTAGARAPDPADYPADYRFVPVPVEVAPELMASEDIAAIVTALNAACEAPFRDRLSALLSAADGEAGEAGGRVRCVLTDVSWDAVLSAARGLGVPALGVMTASAATFRVYMAYRTLVDKGIPAGGKEESQGLRGSPEATPRYR

SEQ ID NO: 63431 - DNA, 716 bp, Zea mays
  misc_feature: Ceres CLONE 1531430
  misc_feature: Encodes the peptide sequence at SEQ ID NO. 63432
  misc_feature (402)..(402): n is a, c, t, g, unknown, or other
  misc_feature (716)..(716): n is a, c, t, g, unknown, or other
agctccccgcggtggcggccgctctagaactagtggatcccccgggctgcaggaattcgtctcacccctagaaaaagaaactcactcgccatcgccgggcatcgcgggcatcgcacacaaacgcaacctgcagccatggcacagaagctcgcgccaccgacggcggcggtcgtcgtcgtcctgctggcgctcgccttgtcggccgccgcgcaaaactgcgggtgcgcgtcgggcctgtgctgcagccggttcgggtactgcgggacgggcgaggactactgcggcgccgggtgccagtcgggcccctgcgacgtgccggagaccaacaacgcgtccgtggccagcatcgtgacgccggccttcttcgacgcgcgcggcgcgcaggccgccgcctcgtgcgangccaaccgcttctacacccgcgacgccttcctcgccgccgccggctactacccggcgttcggccgcaccggcaccgtcaacgactccaagcgcgagatcgccgccttcttcgggaacgccaaccacgagaccataaagttctgctacctcaacgagatcgacgggccgagcaagaactactgcgaaccggaacaacccgcagtggccgtggcaggcggggaaaggggtactacggccgcggcccgctgcagatctcctggaactttcacttacgggcccgcgggcaaaacatcggcttccacgggctgggccan

SEQ ID NO: 63432 - protein, 193 aa, Zea mays
  misc_feature: Ceres CLONE 1531430
  misc_feature (25)..(58): Pfam Name: Chitin_bind_1 Pfam Description: Chitin recognition protein
  misc_feature (71)..(186): Pfam Name: Glyco_hydro_19 Pfam Description: Chitinase class I
  misc_feature: SWISSPROT Homolog: EC 3.2.1.14 Chitinase
  misc_feature (89)..(89): Xaa is any aa, unknown, or other
MAQKLAPPTAAVVVVLLALALSAAAQNCGCASGLCCSRFGYCGTGEDYCGAGCQSGPCDVPETNNASVASIVTPAFFDARGAQAAASCXANRFYTRDAFLAAAGYYPAFGRTGTVNDSKREIAAFFGNANHETIKFCYLNEIDGPSKNYCEPEQPAVAVAGGERGTTAAARCRSPGTFTYGPAGKTSASTGWA

SEQ ID NO: 63433 - DNA, 719 bp, Zea mays
  misc_feature: Ceres CLONE 1531431
  misc_feature: Encodes the peptide sequence at SEQ ID NO. 63434
  misc_feature (250)..(250): n is a, c, t, g, unknown, or other
tggagctccccgcggtggcggccgctctagaactagtggatcccccgggctgcaggaattcgtctcacccctagaaaaaacctaaaggaggcgcctttccccaaatccaccaccaccgagaaacaaccgcaggcaaagccactcggcccgcggctccggtcactctgttgcggccgcgatgaaggagggcagacccagcgccggcgactacattgccagcctgctaagctcgtcgccgaggctcgacttncggcggggaggaggaggaggaggactgcctggacaggttctgcggcgacccggggttcgcggctcgcgcggcgcggctgtccagcttcagcgggcagcgcttcgccgtcaccgcgggcctcttcgggatgcccccgccgctgcccgccgcgaccggcggcggcgagattcgcgggtcccgggaggcgtcgtcagtgtccgaccaggcgtctgcaatgaacgacgccaatgccaagaaacggaaggcgcccgtctctgtcggcggccaagggcaaaaggtcaggaaaccatctggccctgcacaggcagggggaccctaaaggctccggaccccaataggtgctgctacgtggtaaaggaaggcaaagccttactcatccaacacccatttacatctctacagagccataaccaccactcaatcgtaccaaaacgaggaaactctcgaattattcaatcaatctaaataa

SEQ ID NO: 63434 - protein, 63 aa, Zea mays
  misc_feature: Ceres CLONE 1531431
MPPPLPAATGGGEIRGSREASSVSDQASAMNDANAKKRKAPVSVGGQGQKVRKPSGPAQAGGP

SEQ ID NO: 63435 - DNA, 717 bp, Zea mays
  misc_feature: Ceres CLONE 1531436
  misc_feature (254)..(254): n is a, c, t, g, unknown, or other
  misc_feature (262)..(262): n is a, c, t, g, unknown, or other
  misc_feature (294)..(294): n is a, c, t, g, unknown, or other
  misc_feature (324)..(324): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (398)..(398): n is a, c, t, g, unknown, or other
  misc_feature (717)..(717): n is a, c, t, g, unknown, or other
ccccgcggtggcggccgctctagaactagtggatcccccgggctgcaggaattcgtctcacccctagaaaaaaccatttggcggcgatcgccgtgctattgcttgggccttggactgagtaggtttggaggtagcgagacgagacactcgcccccgattcccctcccgctgccgaagcctgtgttgcggggatcgttcgcggaagcggtttttgatcggagagagagaaagagagagtgagggagggaggtaangatggacnccgcggctgcgcacatggagaggcactcgtcngcggcggccttcttgtagggcggcgtccanaacggctgcaatgatttttttttcccccccctcggggggtatgacgggggggacccctcccnnnnnaccacctncaaggaggagtacaacctccaatgcatcctcggggggggggggagggaggtcccagggcccctgtgtttggcaggaaacctggcattgaggaccctaccagccagggactcctttgggccctccaaaaaaaacctaaacaacttgccagaaaacccccggggcgcagcggccgttttcgcgcccccccttgctcggaaacttcgcaggcacgcgtgtatcacaacgaacgccgcggtggtgcgggcggtattgtcctcggcgggggccgcggggcggcttcggcttgttattggcggtcgcgggtgaagaaacggcccn

SEQ ID NO: 63436 - DNA, 822 bp, Zea mays
  misc_feature: Ceres CLONE 1531440
  misc_feature: Encodes the peptide sequence at SEQ ID NO. 63437
  misc_feature (382)..(382): n is a, c, t, g, unknown, or other
gctctagaactagtggatcccccgggctgcaggaattcttctcacccctagaaaaaatccaagctccattttctctgaggaagcgaaccttccctttccccaggcacagatccggctctccgccgccgttatggccgctcggcggctcctccttctcctcggcgttgtcgccgcgtccctcctggctgccgaaccgcggccgtgccacggcttcctcgtcgccatcccgtccgatcccaaccccgaacccatcataggtttacccccccgtcaacggacacctccgtcgctcccattttttttctcggaaacaagacggatgtagaagaagggattttttttttcccccccccccccgggagaaagaaaaggggggcgcccncccccccccccccccccccccccccccctttggattttagataaacccccccaccccctctgggccccgcgcgctggattcccaccttcctcggttggagtttggtactgccattggacgatgatgatacccccgccggcacgcccttgagttgcccttgcatatagcgcacacctctacatgctcccctgcgctatctcacccactattccttaggccgctgtccacaaggcgctatacaccgtcccataaatccgaatccgctaagttattatctgtctcacctacgtcctccatatttatctcacaggaacatatacacatccacgcctgcgtcttctctaccctcttgccctctcgctcttctgtctccgttgtcccctcgccgataactcacctcccactcacctccgcctcgctcgcaactcatgaacctccag

SEQ ID NO: 63437 - protein, 64 aa, Zea mays
  misc_feature: Ceres CLONE 1531440
MAARRLLLLLGVVAASLLAAEPRPCHGFLVAIPSDPNPEPIIGLPPRQRTPPSLPFFFSETRRM

SEQ ID NO: 63438 - DNA, 716 bp, Zea mays
  misc_feature: Ceres CLONE 1531446
  misc_feature: Translation starting site: 182
  misc_feature: SWISSPROT Homolog: EC 1.14.11.9 Flavanone 3-dioxygenase
  misc_feature (402)..(402): n is a, c, t, g, unknown, or other
  misc_feature (468)..(468): n is a, c, t, g, unknown, or other
  misc_feature (716)..(716): n is a, c, t, g, unknown, or other
accgctggagctccccgcggtggcggccgctctagaactagtggatcccccgggctgcaggaattcgtctcacccctagaaaaaatggagcagcacgcggcctagctaggtgagagtgagacagagcagacgcggcgccgggagctggaagtgatctagagctagagcggcggcggcgggcatggcaaagcatctcatctctacggctgaccacgacaggctgccggacagctacgtccggccggagacgcagcggccgcgcctgcgcgaggtcgtccccgacgcggagatccccgtggtggacctcgccgaccccgaccgcgaagccgtcgtcgccagggtcgccgaggcgtgccgcacccacggcttcttccaggtggtgaccacggggtgccggaacanctgacggcggcgatgatgtcggtggcgtacgaattcttccggctccccgcggaggagaaggccaanctgtactccgacgacccggccaaaaagatgcggctgtccaccagctttcacgtgcgcaaggagacggggcacaactgggcgggactacctcccgcctgcactgccacccgctggagcaagacgtcccccaatgggccgaaaaacccaccatccttcaggaggaccgtgaaacgcctaccggaatggcggcccgggaaactggggttccagcttgaacatccccctccccgaggggccgggccccggan

SEQ ID NO: 63439 - DNA, 752 bp, Zea mays
  misc_feature: Ceres CLONE 1531447
  misc_feature (1)..(1): n is a, c, t, g, unknown, or other
  misc_feature (213)..(213): n is a, c, t, g, unknown, or other
  misc_feature (309)..(309): n is a, c, t, g, unknown, or other
  misc_feature (395)..(395): n is a, c, t, g, unknown, or other
  misc_feature (397)..(397): n is a, c, t, g, unknown, or other
  misc_feature (400)..(400): n is a, c, t, g, unknown, or other
  misc_feature (403)..(403): n is a, c, t, g, unknown, or other
  misc_feature (406)..(406): n is a, c, t, g, unknown, or other
nggctcgcctcgacctccccgcggtggcggccgctctagaactagtggatcccccgggctgcaggaattcgtctcacccctagaaaaacacaaaatctttggttcatggaaattccttccagaagaaactctcgctgctttttggattgcgttctgagggtgcacctaggagctctggtaatggtgggccaactcaaagggcatctgcattancagctctatcatccgcattcaatccatcatctcaacaaaggctgtctaatgagaggcctaaaagcacaggcgatggacccacgcaacgtgcctcancactggctgccttatctaatgcattcaccccatccttaaaacccaaaacatcgcccccatctcggtgaggggggggggtgctcaanancanctnctntacccccccccccctctgtgttgactgctgagcattcgggaccttcgaaatttctcccaatccaacctagcaaccccgcaatataggactgatgtccacccgaattgccaaacctccagctggcccctccaggccctccttcccccccacccagaagctgggggggtccactgggtttcccccggaaaaaagatctctgcgcccaagggcgtcccgccttgaccccgaggtaccatcggcttcatgcccgaaacgaaatacactccaaacactgcgggacacgaccactccgccatgagcctcgggcacccccaacccgccccgcggggtcggggggaccaacgcg

SEQ ID NO: 63440 - DNA, 714 bp, Zea mays
  misc_feature: Ceres CLONE 1531449
  misc_feature: Translation starting site: 174
  misc_feature: SWISSPROT Homolog: EC 4.1.1.39 Ribulose-bisphosphate carboxylase
aaagctggagctccccgcggtggcggccgctctagaactagtggatcccccgggctgcaggaattcgtctcacccctagaaaaaatgatcaaccacctaagcgacggagcctccagtttacttactacgctctctggtccccatggggcccaccgtgatgatggactgcgtagatgtacccccgtcgctccattatccggaatgagaacggccttgagccctcccatctccaggacttccttcacaagcctctctttgatctgaacaacgggaacgatcaggtgcataccgatgtcgacgacctgtacctacacgatgctctacacattgacgtacctgccaccactaacgatggagtacttgctgtcccatgtggactacctgctgccctcaggatgatatatgtgccacccacccaggagcgtcagattacattcaccggagaagatgtgctccccgtgctactacggaggactgctatgcaccctgtgaaggctgccctgttctgcgtcctcgaccccaactctgtagtgctggacctacgggatctcttcaaatcctaccctgacaccttcacacgcgtcatcagcttccacacatcgagcagacgctctgagattacttcgactcctacggaccccgggcaacgactagcactgactccgaggtggacacccgcctgctagctaacctcctgcgtgagctaaaaactga

SEQ ID NO: 63441 - DNA, 721 bp, Zea mays
  misc_feature: Ceres CLONE 1531450
  misc_feature: Encodes the peptide sequence at SEQ ID NO. 63442
ggagctccccgcggtggcggccgctctataactagtggatcccccgggctgcaggaattcgtctcacccctagaaaaaagcgaatcacgtgacttcccctccccttctcccctctccactccatcgtctaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccatagtttgggtgccaaaattcccgccgccgccccctctttcgaaagtcccatgagatcttccatttacgacattgatgacgacggtgatgacgaccacgatttggatatgagggatcccactcctcagctagacgagctcgatgaagagattgttgagtctgatcttgagctcgaaggagaaattgtacagtctgaccatgatgacccaccacagaagatgggaaatccttcactggaggtgactgaggaaaaccgtgatgcttcccaagaagcaaaaggcaacgctatggaagcaatttctgaatgaaaacttgaagatgctattgaacaccttaccaacgcaatagtgctgagtccactctcagcaatcatgcatggaactagagcatctgtgtttataaaaatgaagaaacaggctgctgccattcgtga

SEQ ID NO: 63442 - protein, 137 aa, Zea mays
  misc_feature: Ceres CLONE 1531450
MDASKLRELRDFVEACKKNPSLLADPNLSFFRDYLHSLGAKIPAAAPSFESPMRSSIYDIDDDGDDDHDLDMRDPTPQLDELDEEIVESDLELEGEIVQSDHDDPPQKMGNPSLEVTEENRDASQEAKGNAMEAISE

SEQ ID NO: 63443 - DNA, 761 bp, Zea mays
  misc_feature: Ceres CLONE 1531453
  misc_feature: Encodes the peptide sequence at SEQ ID NO. 63444
  misc_feature (15)..(15): n is a, c, t, g, unknown, or other
agctcctggagtccncgcggtggcggccgctctagaactagtggatcccccgggctgcaggaattcgtctcacccctagaaaaaaaaacagcgagtgtcatccagtgcaagctcccagtcccagggtagtagaggactagaggcaggctagagcaaagcacgcggattgcgtggctagcgcaataatggcgatggccacggccaagctcgtccttctcatggtcctcgtggccggcagctccagcggcggcagcgcgtgggggccgctgatgagccgcctccggatgccgacggcgcggtcgtccgtggaggtggcggcggagcgcctccaggaggactacgtcgtatcggcggctgcgccgctcatcccggcggtgcgggcgctgctgggctccccgggggacccgcccccgcgcgccggcgggccctgcgacatctggctcccggccgaggaaacttaccacaagcgcgcctggacgactggtgccggccagctgccaacgctacctccgtccactacatgcttccgcggccactacccgccgggaattccctgcgtcttctttccacagaggccgttccccactccccaggcccctcaaacttgtagtgcaaccccccttgaatgtccgggtcccctccctcaactcataaaaactacccttatcctattccttccctcagaaggcacacccctgggcttcccggacactaaaacttctgtcagccgccaacgaaccctctaacgcgacactcccccg

SEQ ID NO: 63444 - protein, 186 aa, Zea mays
  misc_feature: Ceres CLONE 1531453
MAMATAKLVLLMVLVAGSSSGGSAWGPLMSRLRMPTARSSVEVAAERLQEDYVVSAAAPLIPAVRALLGSPGDPPPRAGGPCDIWLPAEETYHKRAWTTGAGQLPTLPPSTTCFRGHYPPGIPCVFFPQRPFPTPQAPQTCSATPLECPGPLPQLIKTTLILFLPSEGTPLGFPDTKTSVSRQRTL

SEQ ID NO: 63445 - DNA, 733 bp, Zea mays
  misc_feature: Ceres CLONE 1531454
  misc_feature: Encodes the peptide sequence at SEQ ID NO. 63446
  misc_feature (386)..(386): n is a, c, t, g, unknown, or other
  misc_feature (394)..(394): n is a, c, t, g, unknown, or other
  misc_feature (566)..(566): n is a, c, t, g, unknown, or other
tccccgcggtggcggccgctctagaactagtggatcccccgggctgcaggaattcgtctcacccctagaaaaagaagacttcccttcgtctgcttcccagagacccagccatggcgatctcccagatctcacgcatattcctggccatccttctcctggccgccgccttcgccgccgccccagctgcgcttgcggacggcgacgacgtggtggcccttaccgaatccacgttcgagaaggaggtcggaaaggaccgcggcgccctcgtcgagttctacgccccctggtgtggtcactgcaagaagcttgctcctgagtatgaaagacttggtgcaagttttaagaaagctaactctgtcttgagggggggggttgattgtgatgancacaaaantttgtgcagcaagtatggagtttccgggtatccaacaatccaatggttcccgaaaggatccttggagcccaaaaagtatgaaggacaacgcactgcaaaagcccttgctgaatttctcaatactgagggaggcaccaatgtaaagctggcaaccctttcctaggagggttgnggttccccccccaaagacctttgacttcattggccttgaagaaaaccaaaaagggccttggtgaagttcaaggccccaggggggggggcctggacaaagtcttgcgccccccctatgaaaaagggggcttcctgttttcaagttggaagaaaggaattgttattggg

SEQ ID NO: 63446 - protein, 148 aa, Zea mays
  misc_feature: Ceres CLONE 1531454
  misc_feature (32)..(137): Pfam Name: Thioredoxin Pfam Description: Thioredoxin
  misc_feature: SWISSPROT Homolog: EC 5.3.4.1 Protein disulfide-isomerase
  misc_feature (92)..(92): Xaa is any aa, unknown, or other
  misc_feature (95)..(95): Xaa is any aa, unknown, or other
MAISQISRIFLAILLLAAAFAAAPAALADGDDVVALTESTFEKEVGKDRGALVEFYAPWCGHCKKLAPEYERLGASFKKANSVLRGGVDCDXHKXLCSKYGVSGYPTIQWFPKGSLEPKKYEGQRTAKALAEFLNTEGGTNVKLATLS

SEQ ID NO: 63447 - DNA, 714 bp, Zea mays
  misc_feature: Ceres CLONE 1531459
  misc_feature: Translation starting site: 406
acccgcggtggcggccgctctagaactagtggatcccccgggctgcaggaattcgtctcacccctagaaaaagggaactgaaagcaaaccaaaaaagaaagagagggggagagacacagaggcctcactccacacactgtcttgtctctcagtcccagagctttcttggatcgcgaggaatccactggaaattttgcaattgtagtagagaactgtatcgtccgacgaaggtgcatggtgttggccatgggtcacggcagggaacagagacgagcagggcggcgctctccccccagctcattgatcctgtcctcgctgtaaggtattcctgcggtggcctccgaatttcactcgatcgaacacgacatgaagcggccacgcggcgccagcccccctctggctgcgatgaccaatccgaacgatgatggttacggcgtggtcgggatggaggcggacgcggacgcggacgcggacgaggagatgatggcgtgcggcggcggcggggagaaatatgcggcgcctgagctcccagcaggtgcgcgcgctggagcggagcttctaagtggagaacaagctggagcccgagcgcaaggcgcggctggcgcgcgacctcggactgcagccgcgccaggtcgccgtctggttccagaaccgccgcgcccgcttgaagaccaagcagcttgagcgcgactactccgcgcttcgccagtccta

SEQ ID NO: 63448 - DNA, 728 bp, Zea mays
  misc_feature: Ceres CLONE 1531462
  misc_feature: Encodes the peptide sequence at SEQ ID NO. 63449
  misc_feature (728)..(728): n is a, c, t, g, unknown, or other
aagctggagctccccgcggtggcggccgctctagaactagtggatcccccgggctgcaggaattcgtctcacccctaggaaaatggtttcttctccttgtatgcacacaaacccatcgcagggcattctcgagcatagcttctctgcctctctctcccctcctctcctctcgtccactcctttgtccaaagcttcgagatggctcagcagcagaaggtggtggtcagggttccaaccatgacagatgacaagatcaagcagaaggccatcgaagctgttgcggacatttacggtaacattttgcacctctggttgactgtcttcctgttctttttttcctctcttctggatgatggattgttctgctgttgaggcttggaaaatatgttctgcaaaagaaggcattggatatgatatttccacatactagcatattgtttgtttcaatgtttgcccaccatacaatgttcaaggcacatactttgaatgattaggctgagtttaagacagaagctcgagaggataaatcatattaggccttgtttgaatgcacatgtatccacctcaatccatgtgtgttggggtgagtttccctaccaattcactccaacacacatgggattgtggcgaatccatgggcatgcaaacatgcccttaagaattcgcttataaacatgttaacgcaaagatgaggaacccttcgggaatccacgggtggtcggaaggan

SEQ ID NO: 63449 - protein, 57 aa, Zea mays
  misc_feature: Ceres CLONE 1531462
MAQQQKVVVRVPTMTDDKIKQKAIEAVADIYGNILHLWLTVFLFFFSSLLDDGLFCC

SEQ ID NO: 63450 - DNA, 723 bp, Zea mays
  misc_feature: Ceres CLONE 1531465
  misc_feature: Translation starting site: 241
  misc_feature (388)..(388): n is a, c, t, g, unknown, or other
  misc_feature (400)..(400): n is a, c, t, g, unknown, or other
atatctggagctccccgcggtggcggccgctctagaactagtggatcccccgggctgcaggaattcgtctcacccctagaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataacaccgcgggacggggggggatgccttcancaccttcttcanccaaactggtgctgggaagcacgttccccgtgcaatcttcgttgatctagaacccactgtgatcgatgaagtgcgcactggcacgtaccgcccggcttcttccaccctgagcacctcatcaggggcaaggaggatgccccctacaattttcgcccgtggccactacacaattggcaaggagattgttggatctgtgccctggaccgaaacccgcaagctggctgaccactggccccggacctccgcggcttcctggggctccagggccggtgggggcgggccttggctccgggccttcgattccctctcccctagaagccctg

SEQ ID NO: 63451 - DNA, 734 bp, Zea mays
  misc_feature: Ceres CLONE 1531469
  misc_feature: Encodes the peptide sequence at SEQ ID NO. 63452
  misc_feature (617)..(617): n is a, c, t, g, unknown, or other
ccccgcggtggcggccgctctcctactactggatcccccgggctgcaggaattcctctcacccctagaaaaagtcctcaatctcaatcccacaccaccaccacctcctccggtccccaacccctgtcgcaccgcagccgccggccatggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagccacctcctcctgtaggcgcgggcgatcttcaaggacccattccggacgggcaacaacatcctatgtgatgagcgattgctacaccccctccggcgagccaattcccaccaacaagaagtaccactcctccaagatctttagcagcccctgaggtcacctcccaggaaccccagggatcgtattgaacccggaagaccccccctccccggaagggacaccaaaaagccccccttgagttggcccataagatggtcttcccccagccccnggggccccctaagtagaagatctaaaggggcttacgcaacatgttcgatcccgctccgcccctgtcagggacacgccaccccaaaaagtgccccgctctattattcgcggaaacccc

SEQ ID NO: 63452 - protein, 72 aa, Zea mays
  misc_feature: Ceres CLONE 1531469
  misc_feature (17)..(73): Pfam Name: Gln-synt_N Pfam Description: Glutamine synthetase, beta-Grasp domain
  misc_feature: SWISSPROT Homolog: EC 6.3.1.2 Glutamate--ammonia ligase
MACLTDLVNLNLSDNTEKIIAEYIWIGGSGMDLRSKARTLSGPVTDPSKLPKWNYDGSSTGQAPGEDSHLLL

SEQ ID NO: 63453 - DNA, 703 bp, Zea mays
  misc_feature: Ceres CLONE 1531471
  misc_feature: Encodes the peptide sequence at SEQ ID NO. 63454
ccgcggtggcggccgctctagaactagtggatcccccgggctgcaggaattcgtctcacccctagaaaaactccctccctccctccgcccgttcgttccccaacagcacagcacgaagacactagacagcagccgccgccgccgccgccttcgcccgcgtaaccgggacagcgtacgcgcacggtggatcgcacggtgtgccggcgatgatggcggggaacgaggaccagctgcgggcggtggcggcgcgggccgtcaccgactcgctgcgcgcggccgcgtcccgctgctcggccgccgaccgcgccgcgcgcttccgggactgcgtccgcagcctcgaggccgagaaggccaagatggaggtcttccgccgggagctccccatcagcgtccacctcgtcgccgacgtgatcgactggctcaaggaggagctcgcgcagcaccgccgccgcccgtcggacctcttcgcgccaccagcgccgccgccgccggcaaaggacggagccgtcttggcggacgcggacgccaacgacaagcgcagctggatgagctccgtgcagctctggagctgcggtagccacgacgacagcaccgccaacaccaacggcgccgccgccgccgcccacaaggtacggagcgcgggcgtgagtcgccagaactagacgtcccgtttttaaaaaaaaaagaggataaaacaaaacga

SEQ ID NO: 63454 - protein, 151 aa, Zea mays
  misc_feature: Ceres CLONE 1531471
MMAGNEDQLRAVAARAVTDSLRAAASRCSAADRAARFRDCVRSLEAEKAKMEVFRRELPISVHLVADVIDWLKEELAQHRRRPSDLFAPPAPPPPAKDGAVLADADANDKRSWMSSVQLWSCGSHDDSTANTNGAAAAAHKVRSAGVSRQN

SEQ ID NO: 63455 - DNA, 711 bp, Zea mays
  misc_feature: Ceres CLONE 1531472
  misc_feature: Encodes the peptide sequence at SEQ ID NO. 63456
tccccgcggtggcggccgctctagaactagtggatcccccgggctgcaggaattcgtctcacccctagaaaaaaattgtacccgtgtttctgttgattcgtctcgttttctcccttcccctgcgggctggagagcggcggcgaacgagacaaggtcaccggtgacgttcctcacctactccctaccgcctttcgctttccggcccggcctgccgcaagctcgcgcgccgcctacatcgacccctccccgcgccgcaggccgcctcccacagacgcggggcagccacgtcgcccggctcggagggattcggttcggcccgtcgtgctcccctccgcactcttctattggcctggagagcagcggagatccaccagcaatttggattgcttctcctttttcttggatatacttggtctcctcggtgttggctaggcaatccagctttccaaagtgtgatcggacaggtttattttggttctgagatggctgatgaggactcatccgacttcaccttctgcagggttagttctgcagagaatgacagtcaaccagaatctcctaaagccattcctatggcaagtatgacgctcgaggatgttcgtgttataagtgcagatacttcaaagaataatggcatgaaaactgttgactcagaaaaagataggtctggtaaacatgtcagtgtttcaacaaaagacgataaacatgaag

SEQ ID NO: 63456 - protein, 76 aa, Zea mays
  misc_feature: Ceres CLONE 1531472
MADEDSSDFTFCRVSSAENDSQPESPKAIPMASMTLEDVRVISADTSKNNGMKTVDSEKDRSGKHVSVSTKDDKHE

SEQ ID NO: 63457 - DNA, 685 bp, Zea mays
  misc_feature: Ceres CLONE 1531474
  misc_feature: Encodes the peptide sequence at SEQ ID NO. 63458
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (437)..(437): n is a, c, t, g, unknown, or other
  misc_feature (477)..(477): n is a, c, t, g, unknown, or other
ccccgcggtggcggccgctctagaactagtggatccccccgggctgcaggaattctgtctcacctcctagnnnnnnnnnnnnnnnaaaaaaaaaaaaaaaaaaaaaaaaaacacgccacgcttctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctcgccgtggctcgacggcagccttccccggcgacttcggctttgatcccctggggcctcgaatctgaccccgaagagcctgcgggtggaacgtgcangccgaaacttggtgcactgcccggtgggccaatgctctgncgcgggggggcatccttcttcccggaatttccttaaaccaaaaaatgggggttccttaaaaccccccctttttggaaaccccccccgggaaaacaaaaaatatttttcccgaaaacccccccccccccttttttttattgagaggtttttctctctttccggggggggcccaaaagggcccccccccctgggtttaaaaataaacaaa

SEQ ID NO: 63458 - protein, 85 aa, Zea mays
  misc_feature: Ceres CLONE 1531474
MALVSASSSSTTAVTALPRNGQRASSSFLGGKTLLRQAEAARPSFAVRAAADPNRPIWFPGSTPRRGSTAAFPGDFGFDPLGPRI

SEQ ID NO: 63459 - DNA, 798 bp, Zea mays
  misc_feature: Ceres CLONE 1531476
  misc_feature: Translation starting site: 211
  misc_feature: SWISSPROT Homolog: EC 4.4.1.5 Lactoylglutathione lyase
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
tttctgtgttccactgttacaccgcggnnnnggttnnnntnttcaaagctggagctccccgcggtggcggccgctctagaactagtggatcccccgggctgcaggaattcgtctcacccctagaaaaagctcgactcaaatcgtgaaactattgagaaaattccattccaacgacatcgaaggagcctgcgaagcgagcgagagtctataatggcggacggaggcgagctgcagctgctgggctcatggtacagcccctacgtgatccgcgccaaggtggcgctggggctgaaggggctcagctaccagttcgtcgaggaggacctctcccgcaagagcgacctgctgctgaagctcaacccggtgcacaggaaggtgcccgtgctggtccacggcggccgccccgtgtgcgagtcgctcgtcatcctgcagtacgtcgaggagacctttcccacccacagggacccctctcctccccgccgacgcctacgaccgcgccatggctcgcttctgggcagcctacctcgacgacaagttctacaaggagtggaaccggctgttctggactactacggcggagaaggcggcgggaggcgctcggcgtcctcgtccccggggctgaagacgctggatcaggcgtttcgggggaatgctcacaaaggggaaaccctttcttccggcgggcgaccgccgtttggggcctccgtggaacattccggccttcggggaacctttcgcggcgtgatgggaaccaagggggagggtggtaacaagggcccggccccgggcgtttaaaag

SEQ ID NO: 63460 - DNA, 662 bp, Zea mays
  misc_feature: Ceres CLONE 1531477
  misc_feature: Encodes the peptide sequence at SEQ ID NO. 63461
tccccgcggtggcggccgctctagaactagtggatcccccgggctgcaggaattcgtctcacccctagaaaaagacgctacgcggcgtgacttctcccgaaacctccacatacccaaacccaccgaccgccgcctaggcttccacctctcccgctcaaactccggccactgaggtcgaacccgagcccgcgccgcagcggcacgatggtgaacgacgccgcggcgatggccgtcgtgagggcggcgcgcccagccctccgtggcgcccacgatggcgtcgccttcgccgcccacgccgccttcctcgccgatgggtactcgctctgcgccgtcggccctgccgcgctcgccgacccctcgcccttaggtgatgaggaggtggggattgatggttggaacatcatggagaattgttacgcctttttgtatagcaaggaggagaagggcaagaagaaaagggtactagtgaaatgtctggtgatcggtgaagtacttgcaattgatgtcttggatcttgaggcacaaggataaggcgcctttataatatccaaattaatgtggaagaacttctttgtcgaagaagcagcccaaggaattattgggggaatgttacaaaaaattttttcaaggcctccttgggaaactgggaaacctcaaagggg

SEQ ID NO: 63461 - protein, 108 aa, Zea mays
  misc_feature: Ceres CLONE 1531477
MVNDAAAMAVVRAARPALRGAHDGVAFAAHAAFLADGYSLCAVGPAALADPSPLGDEEVGIDGWNIMENCYAFLYSKEEKGKKKRVLVKCLVIGEVLAIDVLDLEAQG

SEQ ID NO: 63462 - DNA, 687 bp, Zea mays
  misc_feature: Ceres CLONE 1531483
  misc_feature: Encodes the peptide sequence at SEQ ID NO. 63463
ctccccgcggtggcggccgctctagaactagtggatcccccgggctgcaggaattcgtctcacccctagaaaaaacagccatcacacgcatactgcatacacaacgcacagcatcaaaagcagctgcgatctgatcaacatggctgccgccaccatggctatcacctcccgcgcgctcgtcggcaagccggcggctggaacgagggacgtcttccgcgagggccgaatcaccatgcgcaagaccgccgccaaacccaagccggcggcgtccggcagaccatggtacggtgccgaccgcgtcctgtacctgggcccgctgtccggctcgcccccgagctacctgaccggcgagtatccccggcgactaccggtgggacaccgcggggctgtccgcggacccggagaccttcgccaagaaccgcgagctggaggtgatccactgccgctgggccatgctcggcgcacacgggtgcgtgttcccggagctgctcgcccgcaacgacatcaagttcggcgaggctgtgtggctcaaggcgggctcccagatcttcagcgagggcgggctcgactacctcggcaatccgagcctggtccacgctcatagcatcctggccatctgagagtgccacgtgctgctcatgctcgccgtcaaggggtaccgcgtcgacggtcgcccactcggcgagc

SEQ ID NO: 63463 - protein, 55 aa, Zea mays
  misc_feature: Ceres CLONE 1531483
MLGAHGCVFPELLARNDIKFGEAVWLKAGSQIFSEGGLDYLGNPSLVHAHSILAI

SEQ ID NO: 63464 - DNA, 740 bp, Zea mays
  misc_feature: Ceres CLONE 1531484
  misc_feature: Encodes the peptide sequence at SEQ ID NO. 63465
ggagctccccgcggtggcggccgctctagaactagtggatcccccgggctgcaggaattcgtctcacccctagaaaaaaagccacctacaccaccaccccgccggccacactcgtctttctcacgagccacaggcacaggcaggctctcgagctcagtccacccagcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggttcccacaccaacgccgccgccgagatcttcaggatcgccgccaccatgaacggcctcgtgctcgtcggcgtcgccgtcgggttcgtgctgctccgggtggagggccgccgtcgaggagtccgagtagggtgcgtgggcctgccactgtcggctgtcgccccgggccgcagtctgcttcggaaccgtgatatatatataaccagatgtacgctttcgaatcaatttactttgggatgtatccctgaccattggtgaatactggggaaatatgttttttggagtccaccccgcttcttgaagaccacaattattaacaatatcttcaacatcccttcctc

SEQ ID NO: 63465 - protein, 160 aa, Zea mays
  misc_feature: Ceres CLONE 1531484
  misc_feature (79)..(112): Pfam Name: PetM Pfam Description: PetM family of cytochrome b6f complex subunit 7
MASSFAVATVPSLAAPAAKKRSGGVTYVEGMNAYSGLKGLNKVNMLGVRKTADYSFAKVVASLSPAGRKRRGGAFGSHTNAAAEIFRIAATMNGLVLVGVAVGFVLLRVEGRRRGVRVGCVGLPLSAVAPGRSLLRNRDIYITRCTLSNQFTLGCIPDHW

SEQ ID NO: 63466 - DNA, 871 bp, Zea mays
  misc_feature: Ceres CLONE 1531486
  misc_feature: Encodes the peptide sequence at SEQ ID NO. 63467
  misc_feature (12)..(12): n is a, c, t, g, unknown, or other
  misc_feature (13)..(13): n is a, c, t, g, unknown, or other
  misc_feature (19)..(19): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (871)..(871): n is a, c, t, g, unknown, or other
ttttttttttcnncatttncgtacttccccttnanncnnnnnaaatactgagactccccgcggtggcggccgctctagaactagtggatcccccgggctgcaggaattcgtctcacccctagaaaaatccactgccctccgcgcatctccttggctctcgtcgtgaccacgcctcgcttccagcctcgaccggccttcatttttgcgcccacaatacccgcatcgacctccctcgccgtcgcgaacgcgaggacccgctcctgcgccggctccgccgttcacgcttcgcccttcagcgaggccacctcctcctcgcgcttctgccgtgaagcctggtaatactcctaccgatggctcctccaaatccgcattcgcgtcccctcgatgaaagatgatgaacacgggccgtagggacgaacgagatcgaggctggcagctgtctgaaattgcaaaggcccccccccctcttcttgatgtgtgtcccaagggccataggggctcctacggaggagggggatggaccccagtagtggtgggaattggtggaggcacagtggtcctgggtgaacctcaagactgctttttcagcttatgggtcggttcatggccttttctaaggccggcagaacccgtctggcttcttttatacattggctggttgtcttaaaaaactttttttggaactctttgtccgcgtgaagggccgcctgggctttgttcttgtggtctagcttatacaccacgggggatgacctatttgtccttatgtccatgcaggatacactctcaagaatctgcctgtctattacatttttggacggattgcttcgttcaccacattcggtgtagcctcagtataaacgagctggcn

SEQ ID NO: 63467 - protein, 91 aa, Zea mays
  misc_feature: Ceres CLONE 1531486
MMNTGRRDERDRGWQLSEIAKAPPPLLDVCPKGHRGSYGGGGWTPVVVGIGGGTVVLGEPQDCFFSLWVGSWPFLRPAEPVWLLLYIGWLS

SEQ ID NO: 63468 - DNA, 643 bp, Zea mays
  misc_feature: Ceres CLONE 1531487
  misc_feature: Encodes the peptide sequence at SEQ ID NO. 63469
ggagctccccgcggtggcggccgctctagaactagtggatcccccgggctgcaggaattcgtctcacccctagaaaaagctcgtgccagcaggccattcttctcgccttactccctcacagaacccagtaaaatattgccagtcccgccgtcgagatggccccacgccgcctgatcgtcctcgacgtcgtcgccctcgcggccaccgccgccgcggccaactccggcttcgcggactcgaacccgatccgccccgtcaccgaccgcgcggcctccgcgctcgagtccacggtcttcgccgcgctcggccgcacccgcgacgcgctccgcttcgcacgcttcgctgtgaggtacggcaagagctacgagagcgcggcggaggtccacaagcggttcaggatcttctccgagagtctccagctcgtccgctccaccaatcggaaaggcctctcctaccgcctcggcatcaaccgcttcgcggacatgagctgggaggagttccgtgcgacccggctcggcgcagcccagaactgctacgccacgcttaccggcaaccaccggatgcgcgccgccgtcgttgcgctgccggagacgaaagactgggaggaaggatgggatggttaaaccaattgaaaaacccgggc

SEQ ID NO: 63469 - protein, 155 aa, Zea mays
  misc_feature: Ceres CLONE 1531487
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
MAPRRLIVLDVVALAATAAAANSGFADSNPIRPVTDRAASALESTVFAALGRTRDALRFARFAVRYGKSYESAAEVHKRFRIFSESLQLVRSTNRKGLSYRLGINRFADMSWEEFRATRLGAAQNCYATLTGNHRMRAAVVALPETKDWEEGWDG

SEQ ID NO: 63470 - DNA, 729 bp, Zea mays
  misc_feature: Ceres CLONE 1531488
  misc_feature (344)..(344): n is a, c, t, g, unknown, or other
  misc_feature (374)..(374): n is a, c, t, g, unknown, or other
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (382)..(382): n is a, c, t, g, unknown, or other
  misc_feature (566)..(566): n is a, c, t, g, unknown, or other
tctccgcggtggcggccgctctagaactagtggatcccccgggctgcaggaattcgtctcacccctagaaaaatcagccgcggggactgcctccctagtcccctaccctcgctttctttctcgctcacccctttcttcccgaagctgtctgtcctgctcctgcgcgcgttggaggaaggaagcctaggaaagccaccgctcaccttctcgctcgctccaccaccgaacgcctcttggtgggagaagaattggccgaaaagcttccggttggctggccgggatctcttcgtctttaataccggacccctggggggattgcctgctgcctccttaaaacaaaccanacccgcaaagggtggggggggggggggaanaanannanaaaaacccccccccacccctttggccttttgtgaaaaaggaaaaaaaagccccccgggggaaggcgaaaggattcccaaaaaaaaagaaagggcctgggggtcccctgggccctccccctttttttcgccgcgcggctttcgggggggggggtctccctcctccgggggcgaaggaccccatanaaagggggccccccaaaagaaaaagggatcttcgggaagggccctggaacacctcttctaaaaaaaaacccccccgtctgggagggctaaaggtgtaccactttccccacctctcccccgggaagatcacaagggaacggcgttttaaaagaagcccccgtgg

SEQ ID NO: 63471 - DNA, 651 bp, Zea mays
  misc_feature: Ceres CLONE 1531493
  misc_feature (83)..(83): n is a, c, t, g, unknown, or other
  misc_feature (100)..(100): n is a, c, t, g, unknown, or other
  misc_feature (651)..(651): n is a, c, t, g, unknown, or other
ggagctccccgcggtggcggccgctctagaactagtggatcccccgggctgcaggaattcgtctcacccctagaaaaaagacntcctttccttttcctcntcgctccctcgctctttctcccgcaactcggcgtcggcgaccgctgccgctgccctacgccaggtgcactgctgctggtctagtagcctcgtcggtcccttcgacaggttttctttcgggtcttcgcccgcgacgagcacccgcccagtgggccaattgataatgttggcggtcagaggggctgaaacataaaaatggctggaaaaaaagaatgcacggaatggcctggttcccggtcccgtctttcttttgggggaaaacttattagggcaacccctggcttaaaaaattgcccggccaaatttgggttccacaaaattcgaaagaaaacgcccccccccttgtgaaaagggcgcccttgggcccccccccaccatttttttttttttgtgggggggaaaaaaaacaagggggccccggaaaaaaaatttgggggtgccctttttttatatacgaacggggcgtccccacaaaatttatgtgtagttttgttcctcgtccgagctttagcccctagacgtgtaattttttttgtttttaacccccccccn

SEQ ID NO: 63472 - DNA, 764 bp, Zea mays
  misc_feature: Ceres CLONE 1531496
  misc_feature: Encodes the peptide sequence at SEQ ID NO. 63473
  misc_feature (32)..(32): n is a, c, t, g, unknown, or other
  misc_feature (385)..(385): n is a, c, t, g, unknown, or other
  misc_feature (394)..(394): n is a, c, t, g, unknown, or other
  misc_feature (395)..(395): n is a, c, t, g, unknown, or other
  misc_feature (764)..(764): n is a, c, t, g, unknown, or other
tccccgcggtggcggccgcttctataactaantggatcccccgggctgcaggaattcgtctcacccctagaaaaaaaggagacggtactagtaaactgactaactgctgcccactcgccggagaaccatggccacggcggcggcgtgtgtgcgggtggcgtctccgttcacgggcccacctatctggcatcccagacacgtcatctcaacgaggcggggacccaggagggccgggctggccgtcacggcggcggctgccgccggtggatcgccgcgcactgtgctcgtcaccggcgcgggcggcctaacaggccaaattgtgtacaagaagttgaaggagaaggtattatacccctcccccacggggggggggggggaagggganaaaccaaanncaaaactcccacgcggggaacaagatgtttgtccggccacctcagaagacccctaagaacattgctcctgcgaatcaaaggcatttgacccccttcatcaatcccaacagccgcgggccccaaaaaaagaaacccgcggttttgaatcctaaccaaagagggggaccccccccgattttttacttcttaaaacaaagggaaatttatccctgatgcaacggagagaattgcaaaatggcccaagaaaaagaccagaatttacagggctccctaacaaaccactctggcggcaaacccacccacaaaagtgttgcgcggggaaacctacctgaggaaaacaaacaaaaaaatatacttcacaccgcatan

SEQ ID NO: 63473 - protein, 107 aa, Zea mays
  misc_feature: Ceres CLONE 1531496
  misc_feature (86)..(86): Xaa is any aa, unknown, or other
  misc_feature (89)..(89): Xaa is any aa, unknown, or other
  misc_feature (90)..(90): Xaa is any aa, unknown, or other
MATAAACVRVASPFTGPPIWHPRHVISTRRGPRRAGLAVTAAAAAGGSPRTVLVTGAGGLTGQIVYKKLKEKVLYPSPTGGGGEGXKPXXKLPRGEQDVCPATSEDP

SEQ ID NO: 63474 - DNA, 872 bp, Zea mays
  misc_feature: Ceres CLONE 1531497
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
tcaggcgggcaaccccacaancataccaacccannnnnnnnaaaaanttaagctccccccggtggcggccgctctacactactggatcccccgggctgcaggaattcgtctcacccctacaaaaaacttgcctacagagttggtcgcagagaatccccaagcaaacaaacagggtagagggagaggagaggagaggagaggacaggagaggttgggtctgggacaccatggctccgatgaagctgtacggggcggtgattgtccggcaacctgaagaggtgctgcactgcgctgggacgaggctggctcccgagtacgagcaccgggcacccccactgacgcacccctcgactacaaaaaggacgagcagcttcgtcgcccagccgctttgataaggtatccaactctcgccggacccggtcttgtacgacgttcggatggctcgccatcttgcgtcgaccccccccccaaaaacaccacgcactatcttctttacgtgacagcccacctccagggagggcctcgactgcgtggaatggttctggatcaaagagggaggggtacggggggcctccggcttgcatctggcatggttctgtcttctcagggtcttcagtcttcgagcgccgctccggcgggggacctaccaccccccaaacagcttgggcgtcgacgggaaacctctcggacaggtcctctaaaacagtgggtaagaggtgggcacgaaagtctaggccttggaagataaaccttgccctgtcctttgtctggaggggattaccttcccgctccttggtccaagccttggaagaggtccggtcagtgccggatgcgacgactttcgatctagccgcccgccccttctagtgaca

SEQ ID NO: 63475 - DNA, 707 bp, Zea mays
  misc_feature: Ceres CLONE 1531506
  misc_feature: Encodes the peptide sequence at SEQ ID NO. 63476
tccccgcggtggcggccgctctagaactagtggatcccccgggctgcaggaattcgtctcacccctagaaaaaaaaactagcgcttactgttttgcacggccatagtctcgatccccaccgagtccagcaaacagcaccaccccaccctcttcgcggctccggcagccgcgccaccatggcttctcctgcgggggctaacagcggggatgaacctggtaccatccccagagatgtgagagtggagaatgggcatggagttgttggaagaagagacgggggtcctgcatccagctattgggacctgttgagagcacacctctctgatcctttaacaggtgttctcatggatgatgcattgattttatcatgtggccattcatatggaagtagtggaatgcaacatgtctacagaatgaaagcttgtggtaagtgtggcatgccaattactgaggccgccattcgaccaaacttggctcttcgccttgcagttcaggcattcaaacgtgaagaagactcagcaaagtcattgaaaagaagaagagagcgccttgaactggataaatgtggtgacgatgatccaaatcgaactgaacttgctactagaggtaaaggtgtgcagtttcctttttctgtcttcgacagggtcataatcaagggaaacaagaggaaccccggaacggtttgtgggacgtcaagcagttgtgac

SEQ ID NO: 63476 - protein, 177 aa, Zea mays
  misc_feature: Ceres CLONE 1531506
MASPAGANSGDEPGTIPRDVRVENGHGVVGRRDGGPASSYWDLLRAHLSDPLTGVLMDDALILSCGHSYGSSGMQHVYRMKACGKCGMPITEAAIRPNLALRLAVQAFKREEDSAKSLKRRRERLELDKCGDDDPNRTELATRGKGVQFPFSVFDRVIIKGNKRNPGTVCGTSSSCD

SEQ ID NO: 63477 - DNA, 783 bp, Zea mays
  misc_feature: Ceres CLONE 1531511
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (41)..(41): n is a, c, t, g, unknown, or other
  misc_feature (360)..(360): n is a, c, t, g, unknown, or other
  misc_feature (407)..(407): n is a, c, t, g, unknown, or other
  misc_feature (474)..(474): n is a, c, t, g, unknown, or other
  misc_feature (620)..(620): n is a, c, t, g, unknown, or other
  misc_feature (670)..(670): n is a, c, t, g, unknown, or other
tataattatgataagttaatgaattagcngnncactctctntcttttatactggagctccccgcggtggcggccgctctagaactagtggatcccccgggctgtgggaattcgtctcacccctctaaaaaaaaaatatagcgcttgctgttttggacgggtcatatccgcgatcccccacgactccagtaaagagctgcaccccaccctcgtcgcggctccggccgccgcgccatcatggcttcttctgcgggggctaacagcggggatgaacgtggtaccctccccagatatgtgagagtggaaagatgggcgtggatttggtggaagaagacacggtggtcctggctcctactattgngtcctgttgagagcacgccgctctgatcctttaacaggtgtctctcntgaatgatggcgttgatttcatcttgtgtccttttgcttggagtttttcaaaggctgcatgccgatngaaagcatgctggtggtaggagggggcatgccaagtacagggcccgccattccaccgtgccttgggtcctcacctgtgaatccaggtttactgacgcgcaaaagattcattgattccgttgtgatataagaaagaatgccttgaantgcaataaattgggggtggatgaacacaaccaaactgaccttgctacaanaaaggaggggaagatagggtaacttttgttttcctcgcgtgttgcgtttcatccggaaagaacaagtacaccccacgtaaccgtccatgacgtaccaccaaacttgtttgctc

SEQ ID NO: 63478 - DNA, 698 bp, Zea mays
  misc_feature: Ceres CLONE 1531514
  misc_feature: Encodes the peptide sequence at SEQ ID NO. 63479
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
agctccccgcggtggcggccgctctagaactagtggatcccccgggctgcaggaattcgtctcacccctagaaaaaactcgcacgcaggctgtgcggcacacggacagtgcgcggtggccgtgcacccagccacccaccagggcaccaggccatcgtgacgagccgcgcgctaggcgcacgagcgcgaacacgaacacgaacaccataacgcggcggccatggtgggcggcggcggcgacccaaggccggaggacgagcccttctccgacggagacgccacggagtcggacaccgacgagtctcctccgcaggggattagtgctcgccgccccggcgccaccactaacccgatcctgactcgcctcgcggtgtcgcggaacccgagcccgctggccgcggccaccgcggcccccggggtgggcctcctccccttcgcctggggagcccgcgcgggaaccctcgtcggcgccgttgtcggaaacggtaaaggctgggctttgagaaaggttttaagggacttttccgggaaggcgcttccggcggcaaagaaaatttgcggcccttgcaggagaaaaaaattttnnnaacccggtctttgtgcaaaaatacctggaaaacaaagagaggtttcaatgcggggatgggtgggtttttatcgagcccttggggctaaatttttcaggggtgcccccgaaat

SEQ ID NO: 63479 - protein, 159 aa, Zea mays
  misc_feature: Ceres CLONE 1531514
  misc_feature (122)..(122): Xaa is any aa, unknown, or other
  misc_feature (123)..(123): Xaa is any aa, unknown, or other
MVGGGGDPRPEDEPFSDGDATESDTDESPPQGISARRPGATTNPILTRLAVSRNPSPLAAATAAPGVGLLPFAWGARAGTLVGAVVGNGKGWALRKVLRDFSGKALPAAKKICGPCRRKKFXXPGLCAKIPGKQREVSMRGWVGFYRALGAKFFRGAPE

SEQ ID NO: 63480 - DNA, 677 bp, Zea mays
  misc_feature: Ceres CLONE 1531516
  misc_feature: Encodes the peptide sequence at SEQ ID NO. 63481
  misc_feature (589)..(589): n is a, c, t, g, unknown, or other
ggagctccccgcggtggcggccgctctagaactagtggatcccccgggctgcaggaattcgtctcacccctagaaaaagagccgagctggctcgttatccacccctaactaccaccgcaccacgcgctcccgtttccgccgatccgagcgcgcagatcgcggaagcccagcggctcagagtccagggggagggagctcgcggcggctgaggaaggcgttcaccaccgtcgcggatttcattgaggaagagatggggctctcctttgggaagctgttcagccgcctcttcgccaagaaggagatgaggattctcatggtcgggctcgatgccgccggtaagaccaccatcctctataagctcaagctcggcgagatcgtcaccaccatccccaccattggattcaatgttgaaactgttgagtacaagaacattagcttcaccgtttgggatgttggtggccaggacaagatcaggcccctgtggaggcactactttcagaacacgcagggacttatttttgttgtagacagcaatgatagggaacgtgttgttgaggctagagatgagctccacaggatgctgaatgangatgagctgcgtgatgccgtgctgcttttgtattgcaacaaacaagatcttccccatgctatgaatgctgctgaaattactgacaagc

SEQ ID NO: 63481 - protein, 142 aa, Zea mays
  misc_feature: Ceres CLONE 1531516
  misc_feature (1)..(142): Pfam Name: Arf Pfam Description: ADP-ribosylation factor family
  misc_feature (113)..(113): Xaa is any aa, unknown, or other
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNXDELRDAVLLLYCNKQDLPHAMNAAEITDK

SEQ ID NO: 63482 - DNA, 1007 bp, Zea mays
  misc_feature: Ceres CLONE 1531517
  misc_feature: Encodes the peptide sequence at SEQ ID NO. 63483
agggccattcgtcgtctccgttgtctttgttgcagatcggtgctcctctcaccaccaggccgccacagctcgccggctttcccctccctgccatcgagcaccacctggtacgctctccgcttgatctccccttcctgctgcggagccgtgcgagcaaaccttaacgtagtccgtaggtacgccctccccttgttcttcccttcctcctgtgcgaaaccgtgcgtccaaaccctaacatactattcgtactcggacctaaatctaatgacaagtgtatatgcatgcattacgcctacagccaactaacttcgattgctctgcaaaaattatggagtgtagtgtacatgtgtatacccatgtccttcactgagtccacccctgcttgacagagcaaacagagcaaggaaatagtttaagaatggctgcgcggagcagttctatggttgtcgaggatgactacgagacggatcagaagaagcaagctgctgcagatgttctttttcactattcacaatttgttatggtttgcattggtgaggatgttcgccctactgatctcaggttacatcttatgaaggaagtttcaggaatgtccacttctctgaaggagcctcaacaggctgctgcctcaccggcttccagtggggaaccgtcttcctctggaacgatgaaaggtgacaagaatgaaatctcctaagcttcataaattattatccaactcaggacttcttctgttccttacgcactgagaagattgtaatgttcagaacttcggatgatgaggcttacttgcaatataggaatgtaaatatgttaggaacattgttcatagctgtctgctgttctgctgctttagcttctttcgtgacagcctgcttcatgtatgaaactttgaatccatttttattcagggggcagtaacgtaaatgctgttgtaattttttttaaatggcaggtgaatattgtattctgaataagtcatgtttgctacaaaaaaaaaaaaaaaa

SEQ ID NO: 63483 - protein, 92 aa, Zea mays
  misc_feature: Ceres CLONE 1531517
MAARSSSMVVEDDYETDQKKQAAADVLFHYSQFVMVCIGEDVRPTDLRLHLMKEVSGMSTSLKEPQQAAASPASSGEPSSSGTMKGDKNEIS

SEQ ID NO: 63484 - DNA, 672 bp, Zea mays
  misc_feature: Ceres CLONE 1531518
  misc_feature: Translation starting site: 63
  misc_feature (428)..(428): n is a, c, t, g, unknown, or other
  misc_feature (546)..(546): n is a, c, t, g, unknown, or other
  misc_feature (592)..(592): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (605)..(605): n is a, c, t, g, unknown, or other
  misc_feature (621)..(621): n is a, c, t, g, unknown, or other
  misc_feature (626)..(626): n is a, c, t, g, unknown, or other
ggatcccccgggctgcaggaattcgtctcacccctagaaaaataggctcgacgcggctctgaatgtttggagccggctgcccgtccgcctgcctctacgcctccgacgccgaagacgataaagtgcgagcggtctgggtccaccacctccaatgacgcactgtccttgaagccggaggaggagcgcccggcgggcgtagttgaggctgttgtagaggtggagaacgaggaggaggaagaggtgactgaggcgactgaaggctatgagccctgtaaggtggtggcgagcggattgtcctacgcgacctccgaggcggacatccggaagctgttcgagttctaggggcccatccagtcgatgcaggatgctcccttcccgtactccggcaacttccgcggccttgccttccctctgcttcgattcagacnaagatgctataaaagctcttgagcttgatcggattcaaatttggcatcacatacttgaggtttaaaaggtgacatgatgacctgctacctcaatcaagaagataaaggcaaagttcgnaatcggaacccaaggaagttctgaagggttgccttctcggctctgngttttggtnnnantcatctaagggaatantttgnggccctaaaagatagttctgaagggtatttcttctcccacctctcc

SEQ ID NO: 63485 - DNA, 584 bp, Zea mays
  misc_feature: Ceres CLONE 1531521
  misc_feature (273)..(273): n is a, c, t, g, unknown, or other
  misc_feature (295)..(295): n is a, c, t, g, unknown, or other
aaagctggagctccccgcggtggcggccgctctagaactagtggatcccccgggctgcaggaattcgtctcacccctagaaaaaattgggagctcactcgctggtcgttgcctgctgcggattgcccccaggcggccccactcactccgctgttgatatttcgtttggttctcctttccgtcttgtccgtcgccgaggccttcttccctcgctcccagctccagcagcagatcaatcctccaacacgaacaggaaggaggtaggaggcctgangggctgaagttgaacatgagtngcgtcgcggttcgtcgtcgctgaaccggaaggcgccgctctttcatcccggcggccctgctggaagtgggagaaacttcccccccccaatgtggtgggaactttattacccacacccgcctggttcccgaaaccttggtcccccaagacccccccctggaaaaaataccccaaaactccagtttggccccccccctgcccaaaaagaaagaagagaaccctttttacggagaaaaggcccccccgccccccccccttaaaaaaaaattgggttctaggggggaaaattt

SEQ ID NO: 63486 - DNA, 717 bp, Zea mays
  misc_feature: Ceres CLONE 1531527
  misc_feature: Encodes the peptide sequence at SEQ ID NO. 63487
acccgcggtggcggccgctctagaactagtggatcccccgggctgcaggaattcgtctcacccctagaaaaagcgggatgctgtgccgcggccgacgccgtccggggctgtggcggtggccgacggcgctgcggcggctgtcccggctggcaccgcctgcgcctgcgcctgccgacccggtggtggttcgcgtcgacgccaacaacgtcgcgcgcttgggggcgcccaagccccggccgaggccgcggcagttgctctcactgccgccgttccccgcagggcaggaccctctcccaggaaggaaggtggcgccgcgacgcgtgacggcagtgagctgggtgaagcactatttcgccgacgtgccgcaggaggccgtgcaggctcatttcaacaggagaatggttttttctgagtgctatgaccacaaggtttcagctgacagcattcgaactcagaagcatcatctgaaaaagataaaacataatgatgctatggagcctggaatgaggattcaccttcctgtttcagtggctgagagtgacataaagaagcgttatgagaccattccgactgccacactgcatcctaataaagatgagatcgagtacctgaggaggctagtcatctacagggactctgctatattggtgcttaacaagccccccaaagtgcccatgaaaggacatttgccagtacataacagcatggacgtgcttg

SEQ ID NO: 63487 - protein, 213 aa, Zea mays
  misc_feature: Ceres CLONE 1531527
MLCRGRRRPGLWRWPTALRRLSRLAPPAPAPADPVVVRVDANNVARLGAPKPRPRPRQLLSLPPFPAGQDPLPGRKVAPRRVTAVSWVKHYFADVPQEAVQAHFNRRMVFSECYDHKVSADSIRTQKHHLKKIKHNDAMEPGMRIHLPVSVAESDIKKRYETIPTATLHPNKDEIEYLRRLVIYRDSAILVLNKPPKVPMKGHLPVHNSMDVL

SEQ ID NO: 63488 - DNA, 929 bp, Zea mays
  misc_feature: Ceres CLONE 1531531
  misc_feature (19)..(19): n is a, c, t, g, unknown, or other
  misc_feature (20)..(20): n is a, c, t, g, unknown, or other
  misc_feature (41)..(41): n is a, c, t, g, unknown, or other
  misc_feature (768)..(768): n is a, c, t, g, unknown, or other
  misc_feature (794)..(794): n is a, c, t, g, unknown, or other
acctcaccagtataaatcnntaatgtaaatcgacatttaanagactacattctagtgctccccgtctgagggggctgcctatcaaatagtggatcccccgggctgcaggagttcgtctcacccctagaaaaaaatcgcaaagtcgcaagcggatcgcaaactcgcaatcaaggctgctcccctccgtctccgtgttcgccactcggttcaccgcccgccgccgccgagacctccacctcgccggctactccagaccccataaaatgctgcgctacggaggtggccccctgtcgggtggatcgatggacacatccgcgcccatagacaacggaggcgcagcaagacggaaactcaccgatacaccaaaacatgtcttcaatctcgagtgaaaaaggaaaaaaggcattaatcccaatacataactggctggtaatcctagacctggtaaccacatctgatatgcattgacagatgcttcaatctcttgcaagatcgggaattcgacatgagtatcaacacgtaccttaattcctttaacccattagtaatagaagaaatcctgatttaacttgcacggcttttcttgtatgtatcagcacgcattgtaaaaaaatgaggactaactattttggagtcagctcgccagatacaagtagtggatgaaatatgtgatcgaaaccctcatgtagatcttgacatgtgcatcccatatgcgtgacgacttttgtaatgacatatgagatgtacacgatacaagaaataatatanggatagcgaagagatcacgcttcggncgaacccatactagaagtatcacgaagtcacggcgcttaagacaatgataacatactgcacacgagtcacaacgaaatatatcctcgtgatataaaagcaatctaactgtccgctcactcatgatacgcttcctc

SEQ ID NO: 63489 - DNA, 807 bp, Zea mays
  misc_feature: Ceres CLONE 1531540
  misc_feature: Encodes the peptide sequence at SEQ ID NO. 63490
ttcagggctgtgcttggatggggtttggtgtgtttacgttaagccgtctgttgtggtggggggggaggccgctctagtagtggaggatcccccgggctgcaggaagtcgtctcacccctagaaaaaacggaggtacaggagcgagggggaaagtgggatggtagtgggggcatcatcggtgtccggcgccgcaacatccggaggtacctctggtagagctccgccacggagaggagaagtcgtgcgagggctgccttcactactcgtcagtgctctgagtcccgcggctacgagccggtctgcgttgggatcccccgttcgcagcccccttgttcctaagtagctgatgatatgagcctaatgaggacacgacagcgcaggagcatgatctcaagcggatcgggcaccggtgcgcggcttactccgtgttcgtgagacggggacggtcaagcgtggtgagggcgaggggcaagaccttgttgcccgtattgcatgcagcctcgcagattagtctgtggcacagcaccattggacccagaggagaagcagtccggcagcgtgaggcaaggctcccggcagctggtttgcaataggatggaggactgcctgctccgcttcgctggcaaggaagggggaaagcaaaaaaccttgggtaaactttattacgagggccggggattttactgggagggcgtggtttttcagaagaaaagtgttggggggggagggtcccccatttcgcaggcggcgtccgtggaaaaaagtttctgggggcgagatccggcccccaataataggtgacggcag

SEQ ID NO: 63490 - protein, 39 aa, Zea mays
  misc_feature: Ceres CLONE 1531540
SGLCLDGVWCVYVKPSVVVGGEAALVVEDPPGCRKSSHP

SEQ ID NO: 63491 - DNA, 725 bp, Zea mays
  misc_feature: Ceres CLONE 1531541
  misc_feature: Encodes the peptide sequence at SEQ ID NO. 63492
ggagctccccgcggtggcggccgctctagaactagtggatcccccgggctgcaggaattcgtctcacccctagaaaaacttcttgcgtcttgccaaccaaagaggagttttctttccgtccctgttgggacgtgtgcttacttctgtgcagcaatggcggcggcgccatagattgaacgagtgtttcttattgaccgcctcgcctctttctttgggatctccgaagttgcctctatgaagccgtcggcatctcattctgggcggcggcggccctgaccctgagccggaggaggagggcgccacggcggcgtacgcggagcggtggccgcggtggctgcagccgctgctgtccgcgcgcttcttcgcgcagtgcaggacgcacagctactccaaccgcagcggcgaatgcaacatgttctgcctggactgctcggccaccgggggcacgggcgcgggcgcgctctgctcgctgtgcctggcgcagcacgggcaccgcgaccaccacaccatccagatccggcgctcctcctaccacgacgtcatccgggtctcggacatccagcgcttcatggacatcgccggcgtgcagacctacgtcatcaacagcgcccgcgtcgtcttcctcaacgagcggccgcagcagcagaagccgggtggcggcaaggccgcgtcgtcgtcgtcggcctcccgcaacctctgcgaggtctgcgcccgcagcctcctcg

SEQ ID NO: 63492 - protein, 104 aa, Zea mays
  misc_feature: Ceres CLONE 1531541
  misc_feature (1)..(104): Pfam Name: PLATZ Pfam Description: PLATZ transcription factor
  misc_feature: The sequence is a functional homolog of SEQ ID NO 668 in the 10/666,642 US patent application
MFCLDCSATGGTGAGALCSLCLAQHGHRDHHTIQIRRSSYHDVIRVSDIQRFMDIAGVQTYVINSARVVFLNERPQQQKPGGGKAASSSSASRNLCEVCARSLL

SEQ ID NO: 63493 - DNA, 711 bp, Zea mays
  misc_feature: Ceres CLONE 1531542
  misc_feature: Encodes the peptide sequence at SEQ ID NO. 63494
  misc_feature (387)..(387): n is a, c, t, g, unknown, or other
  misc_feature (450)..(450): n is a, c, t, g, unknown, or other
  misc_feature (495)..(495): n is a, c, t, g, unknown, or other
  misc_feature (576)..(576): n is a, c, t, g, unknown, or other
  misc_feature (577)..(577): n is a, c, t, g, unknown, or other
  misc_feature (631)..(631): n is a, c, t, g, unknown, or other
  misc_feature (633)..(633): n is a, c, t, g, unknown, or other
  misc_feature (634)..(634): n is a, c, t, g, unknown, or other
  misc_feature (688)..(688): n is a, c, t, g, unknown, or other
acccgcggtggcggccgctctagaactagtggatcccccgggctgcaggaattcgtctcacccctagaaaaattaaggagctcgacagacgaacaggtcaggggcaatcagcaatatctgtggatgataccttgaaggttgttgcatgcaggcagcaagggaagcggttggcatcacttgagatggagctggctgcagcaaagcataaaggttttgttggcaaatatactcctgagacaaatggaactcattctgggaaaaagccactgattgttattggaataatgagtagctttgggaggaaaaactaccgtgatgctgtcaggaaatcatggcttccaacaggttcaatgctgaagaaactagaagaagaaaaaggcattgtantacgttttgttgttggaagaagtgcaaatcgaggtgatactttcgatagggagattgatgacnaaaataggagcaccaaggatttcttgatactggatgatcatatanaatctgatgaagagcttcctaagaagacaaaaagtttctttgctaatgcagcagacacattcgatgctgcactttatgctnnggtcaatgatgatatatacataaatgttgatactttcagcgcaatgctccaaantnnctgggacaggcctcaggtctaaactagtttgcagaaaatcgggcccaggttttntctgaacttaacccacaaaatgg

SEQ ID NO: 63494 - protein, 157 aa, Zea mays
  misc_feature: Ceres CLONE 1531542
  misc_feature (69)..(69): Xaa is any aa, unknown, or other
  misc_feature (90)..(90): Xaa is any aa, unknown, or other
  misc_feature (105)..(105): Xaa is any aa, unknown, or other
  misc_feature (132)..(132): Xaa is any aa, unknown, or other
  misc_feature (150)..(150): Xaa is any aa, unknown, or other
  misc_feature (151)..(151): Xaa is any aa, unknown, or other
MELAAAKHKGFVGKYTPETNGTHSGKKPLIVIGIMSSFGRKNYRDAVRKSWLPTGSMLKKLEEEKGIVXRFVVGRSANRGDTFDREIDDXNRSTKDFLILDDHIXSDEELPKKTKSFFANAADTFDAALYAXVNDDIYINVDTFSAMLQXXWDRPQV

SEQ ID NO: 63495 - DNA, 689 bp, Zea mays
  misc_feature: Ceres CLONE 1531546
  misc_feature: Encodes the peptide sequence at SEQ ID NO. 63496
acccgcggtggcggccgctctagaactagtggatcccccgggctgcaggaattcgtctcacccctagaaaaagtgcatcgtcatccaccacgatcgataaagctaattaagctgctactgctacgctagcctcgatcgatcaagcaagcagctcacagacccaccggcccacccacccacccacatggcggcgtcccgttccgctctgatcacgctgctcgtccttgtgagctccgtcgcggcggcctcggcgaccacgttcaccgtcggcgacagtagcggctggagtcgtagcgtcaactacgacaactgggccagtggcaagaccttcacggatggagatcagctagtgttcaacttcgccaccgggaaccacgacgtggtggaggtggacaagagcggatacgacggctgctccaccaccaacgccgccaacacaatccaaaacggccccgccaccgtcaacctcacctccggcacccactactacatctgcggcatcagcggccactgcagcggcgggatgaagctcgctgtcaccgtcggctccggctccggctccggctccgggtcccccacccccggcggcggctcgcccagcacacccacaccaaccaccccgagcgcccccgcccccgacactccggccggcgcgtccgtgcgcctcaccgccggcccagcgctcgccg

SEQ ID NO: 63496 - protein, 168 aa, Zea mays
  misc_feature: Ceres CLONE 1531546
  misc_feature (34)..(114): Pfam Name: Cu_bind_like Pfam Description: Plastocyanin-like domain
MAASRSALITLLVLVSSVAAASATTFTVGDSSGWSRSVNYDNWASGKTFTDGDQLVFNFATGNHDVVEVDKSGYDGCSTTNAANTIQNGPATVNLTSGTHYYICGISGHCSGGMKLAVTVGSGSGSGSGSPTPGGGSPSTPTPTTPSAPAPDTPAGASVRLTAGPALA

SEQ ID NO: 63497 - DNA, 599 bp, Zea mays
  misc_feature: Ceres CLONE 1531549
  misc_feature (215)..(215): n is a, c, t, g, unknown, or other
  misc_feature (397)..(397): n is a, c, t, g, unknown, or other
  misc_feature (456)..(456): n is a, c, t, g, unknown, or other
tcccccggggctgcaggaattcgtctcacccctagaaaaacctagcaacaacctgtccaagaaccagcagccaaaggacaagacaagagacacaacgaaagggaaaggaacccaagagaaagatcggagaagagaggaggccttcgcctttttgggacctttgcccccgtccctgggattcttggtgcccccccgggaccccttgagggttcccnccccgggatttccccccccccccccccggggggggaaaaaaaagggaggactcttccggggggggccctggggcccaaatttttttttaaccaacaagggggtggggggaaaaattcccccccccccgcggggggaaccccccctccctttgtttttttttaaagggggcccaccaattttntttttttttttttttttttgtgtcccccgccccccctctggtgtgttttttttgggccnccccccccccgggggggggggggggggcgccccccttgtggtgagggaaccctcccccgcccggggcggggagtaaaaaggaaatattttttggtgtttggacgcacggggccgcagacctcctccccagagagggggggggg

SEQ ID NO: 63498 - DNA, 808 bp, Zea mays
  misc_feature: Ceres CLONE 1531552
  misc_feature: Encodes the peptide sequence at SEQ ID NO. 63499
  misc_feature (28)..(28): n is a, c, t, g, unknown, or other
  misc_feature (41)..(41): n is a, c, t, g, unknown, or other
  misc_feature (42)..(42): n is a, c, t, g, unknown, or other
atggtttgtgtgcgggaggtactatccntttttcgaggggnntaataactggaactccaccgcggtggcggccgctctagaactagtggatcccccgggctgcaggaattcgtctcacccctagaaaaaaaggcttcctttcctctcccttcccgtccaagatggaagcagagtacccccaccagcaggcggccccctcttactccacgaccgccaccgtcttctggccgtacgcgactcgccgcagaaagagagccgaggacggcagcgacctctcgctggcgtcggatatggatctcgacgccgacgcgcagcgcgccgcagataagctgaaagcagtgtcagaggaacttggacatgagatccgggttttttcaagtgagaactttgctctacaaccgagcaagctgcctagtgcagatcatgaggaaggtgacgacttttatgagcttcaccccgctgattactacaacttgatttcaaacaggatgggagagctatctaaaatgctaaagactcgcaagatgcgggaagcaaaacttgctgctcagcgagcaaagcgaacaaaggcagtaatggaggggtgcgattccctgatggctacatacttgaggctgactttcttccatcagagaggattcatagttctaggggacctggttcatgaaaggactttggtatgacccaaatctggccattcctaatctctataaaagacctcccaaaaatagcggaatactgggaacacattccccaggaactttcttatagcttctgtggtttttgttcccaagagagactaaagggt

SEQ ID NO: 63499 - protein, 173 aa, Zea mays
  misc_feature: Ceres CLONE 1531552
MEAEYPHQQAAPSYSTTATVFWPYATRRRKRAEDGSDLSLASDMDLDADAQRAADKLKAVSEELGHEIRVFSSENFALQPSKLPSADHEEGDDFYELHPADYYNLISNRMGELSKMLKTRKMREAKLAAQRAKRTKAVMEGCDSLMATYLRLTFFHQRGFIVLGDLVHERTLV

SEQ ID NO: 63500 - DNA, 773 bp, Zea mays
  misc_feature: Ceres CLONE 1531556
  misc_feature: Encodes the peptide sequence at SEQ ID NO. 63501
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
ttatttattttattttttaaccctgaacctctcccggnnnnnnntaatactggagctccccgcggtggcggccgctctattactagtggatcccccgggctgcaggaattcgtctcacccctagaaaaaatcacggcggcggcggcggaagagtagcagcagcaggcggcgccgagtagcgtctccccacctcgagcttgccaccatggctagaggattgaagaagcatttgaagaggctcaatgcgcccaagcattggatgctggacaagcttggcggagcttttgctcccaaaccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaacgagaactacaggctgctgtatgacactaagggccgcttccgccttcacccaatcagggatgaggatgctaagttcaagctttgcaaggttaggtctgttcagtttggggcaaagggcatcccgtacctgaacacgtatgacggccgcaccatccgctaccctgacccgctcatcaaggccaacgacaccatcaagaatcgatcgggagaccaacaagattgtggacttcatcaagtatggatgtttggaaacgtccacatggtgactggatggaaaggaa

SEQ ID NO: 63501 - protein, 189 aa, Zea mays
  misc_feature: Ceres CLONE 1531556
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGAKGIPYLNTYDGRTIRYPDPLIKANDTIKNRSGDQQDCGLHQVWMFGNVHMVTGWKG

SEQ ID NO: 63502 - DNA, 634 bp, Zea mays
  misc_feature: Ceres CLONE 1531561
  misc_feature: Encodes the peptide sequence at SEQ ID NO. 63503
  misc_feature (199)..(199): n is a, c, t, g, unknown, or other
  misc_feature (562)..(562): n is a, c, t, g, unknown, or other
ctccccgcggtggcggccgctctagaactagtggatcccccgggctgcaggaattcgtctcacccctagaaaaaaaccgccctcattccaaaccctagccgtcgccaaccttagagctctcggacatggtggctcctcctccactccccctcgactcctcctccatccccgatgcggcggcgccagcctgcaggtacgntttccttcctagtccatctcgatcttctcccccagtccccccagtgggccccaatccccgtccttccaaagggggcatgtgggcgagggttccttttggttgcaaaattccgggggtgccaaaaattttaaaatttccccccgggggacccggagaaaactttttatgggggggttttgggggggggggggttttttgggggaggccgcgaaatatatttttttcccaggggggctccgggggtgtttttttttcccccccccccaaagggggaagagagagggggcccctgggggggggaaaaaaaaaacacaaaaaggggggggggggggtgaaaaaaacctcaccccccagaaaacaatntttttgcccctcttttttttttcttttttttttttttaagggggggggggcgggacccaaaaataatggggg

SEQ ID NO: 63503 - protein, 52 aa, Zea mays
  misc_feature: Ceres CLONE 1531561
  misc_feature (10)..(10): Xaa is any aa, unknown, or other
MRRRQPAGTXSFLVHLDLLPQSPQWAPIPVLPKGACGRGFLLVAKFRGCQKF

SEQ ID NO: 63504 - DNA, 842 bp, Zea mays
  misc_feature: Ceres CLONE 1531565
  misc_feature: Encodes the peptide sequence at SEQ ID NO. 63505
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
aattcatcttttctcttccggttctcccnnnnccgaaannnnnnnaaacatgacactccccgcggtggcggccgctctagaactagtggatcccccgggctgcaggaattcgtctcacccctagaaaaaatgcgtgacgggtactctggccgctgtggcttcgctggcggccggcatagcagcagccgcagcaacgatggcaggggataccacgggaacccttgcttgacgatgcaccaaccgtgggcgtccctgctggtgcacggcatcaagcgtgtcgagggccgctcatggccatccccaatcacaggccgcctgtggattcacgcaacatcaaaggttcctgaccccgacactatcaaagccatggaggatttctacagggagatttatgccgtcgatggcatcactggcatcatgttccctgagcattaccctgtctcacgcctccttggctggcccccggtggttaggctgcctccgggtctgaaaagcttcgttcgcctggggaacactgtgcctggagattggccgggctttggaaggccttgactgagctttttcttggggtttggtcaaaaatcccataaaaatgcgggggggcttcccattctgagcatgcttagttcctccccgttagaccttacccttcgcacaactaacggtctctctgattgcggcctggtgagggcggccccatctaccttgtctcccggtcccctgcgcccggtcaactcgcctctcctcccgaaacccccaataaaccccctcttctctcgagacactccggacttccctaatctatgcgcctcactttcaccacctcgctccgcccgaactgt

SEQ ID NO: 63505 - protein, 140 aa, Zea mays
  misc_feature: Ceres CLONE 1531565
MRDGYSGRCGFAGGRHSSSRSNDGRGYHGNPCLTMHQPWASLLVHGIKRVEGRSWPSPITGRLWIHATSKVPDPDTIKAMEDFYREIYAVDGITGIMFPEHYPVSRLLGWPPVVRLPPGLKSFVRLGNTVPGDWPGFGRP

SEQ ID NO: 63506 - DNA, 941 bp, Zea mays
  misc_feature: Ceres CLONE 1531567
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (941)..(941): n is a, c, t, g, unknown, or other
ggttggggtgttttttttctgttggggngnnnnttcnnnnntccagactggagctccccgcggtggcggccgctctagtactagtggatcccccgggctgcaggaattcgtctcacccctagaaaatcgcctccgcccccgatccagatccaggtgctcttcctttcgccgcggctgagaagcaactctccctctctgtcctcttcctgtcgccgcactcattctctcttgccggggtggaataggaaacgggcctactccatggcggatttctccgtggaagcgtgcccttctgtgaggaacattttacttctgtgattttcaaggaaagcgcgcttgcttgttaagcatttcctcagactgattggccgaagtcaggggggagaagttagcgctacggaaacggtgtggttgtaagagtaaacatctggacgtagaagtgggggggggagtgggacgcttgaaagtagccctttggtattcaacccccctctatatgtgaggtttcactctggattgtgtatccagacgccggtggccgctgtgggggctcgaccggccggcgactatgtagcgcgaggcgggccgctccgcgccctttgctccagggtggagccggcgatgggggatgtctgtcgttggcggtcgacggggcggatgtgcgcgcgtgccggggcggctgtacgcttggacgtcgtcgcgccgtcgggcgtctcgcgccgatcctgcgggcatgggggggctctatcccttctggctcgcctattggtcgctcggcagtgcgggggcgcgcgtggtgctcgtatgcacggagtgaattctagcgtgcttgctgatcctcgcgcggcgtgtcggtgatcggagcgcgtaagttgatgcgcgtcaggggcgggtgtgtgttgctgggcccggcggcttccgcgtttgggcacgtcgtatcn

SEQ ID NO: 63507 - DNA, 769 bp, Zea mays
  misc_feature: Ceres CLONE 1531570
  misc_feature: Encodes the peptide sequence at SEQ ID NO. 63508
  misc_feature (28)..(28): n is a, c, t, g, unknown, or other
  misc_feature (34)..(34): n is a, c, t, g, unknown, or other
  misc_feature (769)..(769): n is a, c, t, g, unknown, or other
ttattttttaaaagaggaccctccatcntctaanttgttcgaatatagaatagatgggactccacgcggtggcggccgctctagaatagtggatcccccgggctgcaggaattcgtctcacccctagaaaaaacactgaccgacacagcagctccgctcgtcgatcagctctcggctgaccactcatcgccagtgggtgcctgccgaccaggtctcgccgccgccaccgccgcggtagagaggggagggagagggggaaaaaactggcccagatcgagaggtacagcacgaaaaagagaggcaagagagataggggaccggagggcggcgggccggggcccaagaccgaggggctcgtgcgcatgaagctgatgaggctcctgtcgctcgtccccttcggctgccgtgctggacccatcgacgacgcgccgccgcccgtggaccacgccgccgccgcgaggaggcgccggaggaggagggccaacagggccgcccagctgctgggggcctgctgcgggtgcgccgcaatagtggcgcccctcgctcggcgacaatctgcgaggagtacagcagcaccaccgaacgccctcaaggtcaggaaggcggcgtcccgaggacctcgcccggggcgctgccccgccgcgcacgggtggcaagcaagtacccggcacctttgaagggcgcgtctgtcccctgcccagcgttccgcgcccaaaccggggttccctggtttttagaactatggacgatctggctaacaggccggcan

SEQ ID NO: 63508 - protein, 104 aa, Zea mays
  misc_feature: Ceres CLONE 1531570
MKLMRLLSLVPFGCRAGPIDDAPPPVDHAAAARRRRRRRANRAAQLLGACCGCAAIVAPLARRQSARSTAAPPNALKVRKAASRGPRPGRCPAAHGWQASTRHL

SEQ ID NO: 63509 - DNA, 805 bp, Zea mays
  misc_feature: Ceres CLONE 1531578
  misc_feature: Encodes the peptide sequence at SEQ ID NO. 63510
tttagattttttggcttttgtttattaaccacaaagccttataaaataatggaactccccgcggtggcggccgctctataactagtggatcccccgggctgcaggaattcgtctcacccctagaaaaaggagcgtgacattgttgtgcgccttccactgccagtaatggaagcaggcgccggggaagcagcaccaagcgcgccgcgcagactgaccctgccgtggaaggtgcgtctcctgctcctctgcctcgatgtcgtcgccggtctctcgatgcgtcgcgacggcaccatcaaccgctccatcttcaacctcttcgaccttcatgccaccgccagcacgcgcccggacaggcaaggcgtccggtccgccgacgtggacgtggacgcgtcgcgcggtctgtgggcgcgcgtgttctggtcgtcgtcggaatcgtccgcggccccactcccattcgcccccctactttcacggcggcgccttcacgcttgctctctgcggcctccgacgtctaagacgccatgtgctcgccggttcttgccgcgagctggtggccgtcatcgagttcttcaaactaccctctctgcacccaagcaccgttgccccttcctcattatctaggacggtggttccctggatttctataacttcgcctccgctgggtctccccgtatgcgtacaacatcccccggggactctctccctgcggcttccatcatccgggaaaagacacccgtgcgcccaacattgcccccactatcttggtggtcatatgcttgggaagaacgggcccttcctcccccgc

SEQ ID NO: 63510 - protein, 151 aa, Zea mays
  misc_feature: Ceres CLONE 1531578
MEAGAGEAAPSAPRRLTLPWKVRLLLLCLDVVAGLSMRRDGTINRSIFNLFDLHATASTRPDRQGVRSADVDVDASRGLWARVFWSSSESSAAPLPFAPLLSRRRLHACSLRPPTSKTPCARRFLPRAGGRHRVLQTTLSAPKHRCPFLII

SEQ ID NO: 63511 - DNA, 725 bp, Zea mays
  misc_feature: Ceres CLONE 1531582
  misc_feature: Encodes the peptide sequence at SEQ ID NO. 63512
atagctggagctccccgcggtggcggccgctctagaactagtggatcccccgggctgcaggaattcgtctcacccctagaaaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacaccaggggggcatacaaggctgcccaggacattgctctggctgagcttgctccaactcaccctattaagcttggactggcactttacttctcagtggtctactatgaaattctgaactccctgaacgcgcctgccgtccttgcaaagcaaggttttggaca

SEQ ID NO: 63512 - protein, 206 aa, Zea mays
  misc_feature: Ceres CLONE 1531582
  misc_feature (8)..(206): Pfam Name: 14-3-3 Pfam Description: 14-3-3 protein
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTRGAYKAAQDIALAELAPTHPIKLGLALYFSVVYYEILNSLNAPAVLAKQGFG

SEQ ID NO: 63513 - DNA, 767 bp, Zea mays
  misc_feature: Ceres CLONE 1531584
  misc_feature: Encodes the peptide sequence at SEQ ID NO. 63514
aaaatattttgataagagggtaattaaattatagcatccccaaaaagtgaactccccgcggtggcggccgctctagaactagtggatcccccgggctgcaggaattcgtctcacccctagaaaaatcttcttccgtttccgtctcccctcttctttgttacaataaacaaccaatcgaagccccaggcaacatcgaccgactagagtagatagagctcagtggcggccgccaagaaacacctgcgccctaaggcgagcagcggcaggcataggatgggcaggtccccgtgctgcgagaaggcgcacacgaacaagggcgcgtggaccaaggaagaggaccagcgcctgatcgcctacatcaaggcgcacggcgaggggtgctggcgctcgctgcccaaggccgccggcctcctccgctgcggcaagagctgccggcttcgctggatgaactacctccgcccggacctcaagcgcggcaacttcacggacgacgacgacgaggtcatcatcaagctccacgccctgctcggcaacaagtggtcgctcatcgcggggcagctgccggggcgcacggacaacgagatcaagaactactggaacacgcacatcaagcgcaagctgctgacccgcggcatcgacccgcagacgcaccgcccgctgagcgccgccgccgccctcaccgccggccttccgtcgcccgcgcgcccgccaacgtgatgttcgcgcgcccggcgccctccgaaggaggcgggcacagcagcggcggg

SEQ ID NO: 63514 - protein, 147 aa, Zea mays
  misc_feature: Ceres CLONE 1531584
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
MGRSPCCEKAHTNKGAWTKEEDQRLIAYIKAHGEGCWRSLPKAAGLLRCGKSCRLRWMNYLRPDLKRGNFTDDDDEVIIKLHALLGNKWSLIAGQLPGRTDNEIKNYWNTHIKRKLLTRGIDPQTHRPLSAAAALTAGLPSPARPPT

SEQ ID NO: 63515 - DNA, 785 bp, Zea mays
  misc_feature: Ceres CLONE 1531590
  misc_feature: Translation starting site: 191
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
nnnnnnnnnnnnnnnnnnnnnnnnnttttttttgggtggtcctgtgtggtgtctttgagtttccccgcggtggcggccgctctatactagtggatcccccgggctgcaggaattcgtctcacccctagaaaaagtggctccttacttccgcgccgccgcccctacaggtaaggaagaggaggagggcaggatgtcgcaccgtaagttcgagcacccgaggcacggctccctcggcttccttcccaggaagcgctcctcccgtcaccgcggcaaggtgaagtcattccctatggatgaccccaagaagccttgcaatctcactgccttctttggttactatgctggcctgactcacattgtccgagaggttgagaagccggaatcccaactccataagatacgaaacttgcgatgctgttaccgtcattgagacccctcctcttgtcattgttgggctcgcgtcatatgtgaagacccctcgtggtctgtgaacactcaactgtggttgggaccctcatcttagcgaagaattgaggataaggttcttaaagaactggtgcaggagcgagaagagggctttcacatagtatgcctctcaagaggtagaatgatgcttggctagaaatgaaatttctccttgctggtcttgacatgattgaagaaaacacgccctcgggttccccagggatccatatagcgtaaatcaccctagaatttattggaaattatgctcgagggcgtttgaaacgcccagaacacgagaggacctcaacccgtgtaatcgc

SEQ ID NO: 63516 - DNA, 783 bp, Zea mays
  misc_feature: Ceres CLONE 1531591
  misc_feature: Encodes the peptide sequence at SEQ ID NO. 63517
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (33)..(33): n is a, c, t, g, unknown, or other
  misc_feature (45)..(45): n is a, c, t, g, unknown, or other
nnnnnnnnnnnnnnnnnnnnaaaaggaaagggnttgtccttcctnttataaaatggaaatccccgcggtggtggccgctctagaactagtggatcccccgggctgcaggaattcgtctcacccctagaaaaaaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtgaccccggccttcgtgggccagttcccgggcgtcaacgggcttggcatctctgcggccaggctcgacatcgaggtgggcggcgtcgtgccgctgcacacccacccggcgggctcagagctcctcttcgtgacccaaggcaccgtcgccgccggcttcatcaactccggctccaacaccgtctacaccaagacgctgtacgcccggccacatcatgggtgttcccccagaggcctgctccactaccagtacaacgcccggcacccggcgctgcccgtggagcctccctcccccttcaaaaagtcaccaaacccccggccctcgcagattaaccgaacttttgcgacttctttggccaaacaaaccctccccctcccg

SEQ ID NO: 63517 - protein, 196 aa, Zea mays
  misc_feature: Ceres CLONE 1531591
  misc_feature (55)..(191): Pfam Name: Cupin_1 Pfam Description: Cupin
  misc_feature: SWISSPROT Homolog: EC 1.15.1.1 Superoxide dismutase
MAKMVLLCVLVSFLLMPLASLALTQDFCVADLTCSDTPAGYPCKSSVTANDFYFHGLAGQGKINPLIKAAVTPAFVGQFPGVNGLGISAARLDIEVGGVVPLHTHPAGSELLFVTQGTVAAGFINSGSNTVYTKTLYARPHHGCSPRGLLHYQYNARHPALPVEPPSPFKKSPNPRPSQINRTFATSLAKQTLPLP

SEQ ID NO: 63518 - DNA, 689 bp, Zea mays
  misc_feature: Ceres CLONE 1531595
  misc_feature: Encodes the peptide sequence at SEQ ID NO. 63519
  misc_feature (689)..(689): n is a, c, t, g, unknown, or other
tggcggccgctctagaactagtggatcccccgggctgcaggaattcgtctcacccctagaaaaacttagctgttggtttcatttatttccagggtatacatgcacagatgccttcgtctggaatgggtctgacctcacctagatatccttctaggatgtacccagacaacagattatatgggcagtatggtcagtatgggaacacactgaagggtggccttggttttggatcaaacatgtatagctcgagaaacaatgggaggtggggagttgtggataccaaatacaagcccagagggcgtgcaccttttggttttagtggtgagaaccaagatggctttaccgagctgaacagaggaccaaggtctggtggtttcaagcaccaaaaacaattcggtcctactgtaactattgctgtgaagggccaagccctcccttcagtggggaaacagaacagtactcttccagacaaaggccaatttaaccaggaagggtttcctttaacctacaaggatgcaaagttctttgttatcaaatcatatagtgaggatgatgtgcacaagagtataaaatacaatgtgtgggctagcactcctaatggaaataagaagctggatgctgggtaccgagaggctcaggagaaatccagtgactgcccggtgttcttgtttttctctgtgaacacaagn

SEQ ID NO: 63519 - protein, 193 aa, Zea mays
  misc_feature: Ceres CLONE 1531595
MPSSGMGLTSPRYPSRMYPDNRLYGQYGQYGNTLKGGLGFGSNMYSSRNNGRWGVVDTKYKPRGRAPFGFSGENQDGFTELNRGPRSGGFKHQKQFGPTVTIAVKGQALPSVGKQNSTLPDKGQFNQEGFPLTYKDAKFFVIKSYSEDDVHKSIKYNVWASTPNGNKKLDAGYREAQEKSSDCPVFLFFSVNT

SEQ ID NO: 63520 - DNA, 861 bp, Zea mays
  misc_feature: Ceres CLONE 1531597
  misc_feature: Encodes the peptide sequence at SEQ ID NO. 63521
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (861)..(861): n is a, c, t, g, unknown, or other
nnnnnnnnnnnnnnnnnnnnnnnnnnnnnnnnntgggggggttgaggaaaatgactcaacgagcgagtttgttgttcttttatctattgtattccccgggctgcacgaattcttctcacccctcgaaaaaaaatcgaaaaccactcgaacacaaactcaggcaaggcaaaaggaacccgcatcatccgaggctcatgcagggaagtgcatcatcatcatcatcagaagaagatgtgcccaaccaacaaggggatgaccggagagccgagctcgccatgcagctcgggatcagcctcgaccttaccggagcaccaccaaacggtgtgcaaatccccccccaatcggccaccggggcggaccaaattcccggagacgcggcacccggtgttccgccgggtccggcgccggggcatcgccgggcggtggccgtgcgaggaggagggggcccggccacgcccggctgcacgcctccggccccggacccggcacaccccgcccgaagcggccggacactcgcacaccaacccccgcctatgctggttacctcccaccgggaagagaagagccctggctggcgttttatacttttaccagaaatatagacccctggcacaccccccccatagcccccccagccctccctgaaccaacccacactcaaccaaatccgccggccctccccggtgaccccactaactccccaaacgcaaccaatctcccctacgcccacggaaaggtggcgggtcggggggtgatagaaggcgcctggtgtatgctagaggcgttcaagacctttggcgtgcctgaataataggtagagatctctgtgaggaaggagtgtgaaaaggcgagtcctgtggn

SEQ ID NO: 63521 - protein, 137 aa, Zea mays
  misc_feature: Ceres CLONE 1531597
MCPTNKGMTGEPSSPCSSGSASTLPEHHQTVCKSPPNRPPGRTKFPETRHPVFRRVRRRGIAGRWPCEEEGARPRPAARLRPRTRHTPPEAAGHSHTNPRLCWLPPTGKRRALAGVLYFYQKYRPLAHPPHSPPSPP

SEQ ID NO: 63522 - DNA, 720 bp, Zea mays
  misc_feature: Ceres CLONE 1531602
  misc_feature: Encodes the peptide sequence at SEQ ID NO. 63523
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
nnnnnnnnnnnnnnnnnnnnnnnnnnnnnnnnnnnttttaccttttttaaaagttgggcttcaccgcggtggcggccgctctataatagtggatcccccgggctgcaggaattcgtctcacccctagaaaaaatccaattcctgctgctgatcttgatcctgcaccccgagccgtacacgagagctagtctgtagaacttgcaggagcggagcagaactaagtgcagagaacaggacatatggctactccggcggtgaatgtttacggttgggctatctcgccattcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagcagacggcgatggtggacgtgtggctggaggtggaggcccaccagctgagcccgccggcaatcgccatcgtggtggagtgcgtgttcgcgcccttcctgggccgcgagcgcaaccaggcggtggtggacgagaacgtggagaagctcaagaaggtgctggaggagtacaaggcgcggctggacacgtgcacatacctcgccggcg

SEQ ID NO: 63523 - protein, 160 aa, Zea mays
  misc_feature: Ceres CLONE 1531602
  misc_feature (4)..(79): Pfam Name: GST_N Pfam Description: Glutathione S-transferase, N-terminal domain
  misc_feature: SWISSPROT Homolog: EC 2.5.1.18 Glutathione transferase
MATPAVNVYGWAISPFVSRALLALEEAGVDYELVPMSRQDGDHRRPEHLARNPFGKVPVLEDGDLTLFESRAIARHVLRKHKPELLGGGRLEQTAMVDVWLEVEAHQLSPPAIAIVVECVFAPFLGRERNQAVVDENVEKLKKVLEEYKARLDTCTYLAG

SEQ ID NO: 63524 - DNA, 803 bp, Zea mays
  misc_feature: Ceres CLONE 1531604
  misc_feature: Encodes the peptide sequence at SEQ ID NO. 63525
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
  misc_feature (59)..(59): n is a, c, t, g, unknown, or other
  misc_feature (75)..(75): n is a, c, t, g, unknown, or other
nnnnnnnnnnnnnnnnnnnnngggaaaggggnnnnnnnnnnnnnnggnaagagtgggantccccgcggtggcggnagttctaaactaatggatcccccgggctgcaggaattcgtctcacccctagaaaaactctgccgctcgcttcgtcactcgccgcgccacgccaaagaccatgaaaaaaaaaggacgattttttcctagctgccacttccctcacgccatggaggaggagatgccgctgctgctgctctccgcttcctccgccgccgtcgctgtctgagctcccccttcgctcgatctctccatcgggtcgggactacctctcctagatagtgaatcaaagcatgggagctttcgccgcgctgttcgaccccctgtactgcccggaggagctcctctatctctaccgccaggaaaccggcgagggtgcggacgagcagtggccgggccagctcggacagctggagccggctgtcctcgaacgacgagcggccggcgctgcgcgaggcacacagggccaatgaaggggtggcgccgagcggatgatggcaggtacagaggttcacatgtttttttatgccgctgtcgggcccggcctcccgcgcccgcgggggcggcgaggcctgagccacgctcccccgaccgcaatacaacacacaacttacctcaaaccagcagcaatccttccaccgggggagacaagacaaccaagatttatattatcaagttcattggtaatggggagggcctctaatccgcccggcccgcccggggtgatcgccgggctgtggccgggtgcgg

SEQ ID NO: 63525 - protein, 59 aa, Zea mays
  misc_feature: Ceres CLONE 1531604
MGAFAALFDPLYCPEELLYLYRQETGEGADEQWPGQLGQLEPAVLERRAAGAARGTQGQ

SEQ ID NO: 63526 - DNA, 761 bp, Zea mays
  misc_feature: Ceres CLONE 1531608
  misc_feature: Encodes the peptide sequence at SEQ ID NO. 63527
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
nnnnnnnnnnnnnnnnnnngggggggnnnnnnnttaccccnnnnnccaaactggagctccccgcggtggcggccgctctatactagtggatcccccgggctgcaggaattcgtctcacccctagaaaaaaatcagttccacaatccacttgcctcggccgctatcgtgaccgggaacaacaactgcgagatggccacggtggagacctcgggcacggcgatagggtcctccgggagatgggcactacacggcaagacagccctcgtcaccggcggcacccgcggcatcgggcgtgcggtagtggaggagctggcggcgctgggggcggccgtgcacacatgctcccggaaggcggagtagctcggcgagcgcatcaaggagtgggaggccaggggattcagcgttaccgggtccgtctgcgacctctccgagagggaccagcgggagcggttgctccacaaggttgccgaccgcttcggcggcaagctcaacatcctcgtaaaccatgtaggaacaaacataaggaaacccactactgagtttactgcagaggaatactcggcatctgaaggatactaaacttgaatacgcatatcacttttaccaaagttgcacatccctcttttgaaaaccatccggcccaagcagacaatatatttatattcaaccggctgctgggaaccatcaccaaaccttacccgggaactttagaatactaataaacaaaagaagtgaaacttaacccacctcaatccaaaaca

SEQ ID NO: 63527 - protein, 56 aa, Zea mays
  misc_feature: Ceres CLONE 1531608
  misc_feature: SWISSPROT Homolog: EC 1.1.1.236 Tropinone reductase
MATVETSGTAIGSSGRWALHGKTALVTGGTRGIGRAVVEELAALGAAVHTCSRKAE

SEQ ID NO: 63528 - DNA, 886 bp, Zea mays
  misc_feature: Ceres CLONE 1531610
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnnnnnnnnnnnnggggggnnaaaannnccccnnnaaacccnnnnnttgccccgcgctccccgcggtggcggccgctctagaactagtggatcccccgggctgcaggaattcgtctcacccctagaaaaaaaagccaatccggacctctcgcctcctctctcgcgttgtcctcgttccgccctgctccggttccccaatccttcgccgccttcgttgcctaccgtctcctccgagccagatcgatacaatcggagccgtgatccggccaacgcgcggagcgtggttgcccgattctctccccgctgcctccccctcccctgccgcggccacaccgccttttctgggtaagggggatcaccctgatttgatctttttgtctcggcaccgttgcggtccccccggcagagcatattttttttttcccccccccccaccggggggggggggggggcccttctttttgtttttctctctccccttcccccccctggtggtccttccgccaactcccttcgcctcctctaccaccatccaccgcccatttgttatcccaccaaatttgtcctgatttggtgtgcccttgtcccgctgagaccggtggaaaggctcactccccgtgatccccccccacctcgtcgccattccataatttgttacatctcgtcccccacacctcttcgctcccccgccccccaccctacgctcgccgcatggctccagcccgcggcaccggtgaacctccccctgcccactctatccccatgtggggggaggatggccggaatcgcggggggaggggggacgtcgggcggtggggagtcgtgtgccgcgtgtgacggcgggcggcagggggggggccggttagcaatgcgcatttcccgtcc

SEQ ID NO: 63529 - DNA, 877 bp, Zea mays
  misc_feature: Ceres CLONE 1531611
  misc_feature (1)..(1): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (877)..(877): n is a, c, t, g, unknown, or other
ntttttcctttttcnnnccgtctccttcttctattctctcggtnnnaaaaaaagagagctacccgcggtggcggccgctctataactagtggatcccccgggctgcaggaattcgtctcacccctagaaaaagaaagtaaggactcactttagtaagctatttctgcaaaagtatctaagttgatttttgctaaagcctctccttgattcccaaatccagcatacccttgagagtcttttctttagtcgggtaagacttgctgagtaattccatacccacggttttattccctgttgtttttcaggttttaatctttgtgctagtgttgatggagataagtagcggggggatcggccttcttataagtctaagtacttcttgctacgcttcttgttgccaatgcgccacttgagcttagccgctattatcaagctgtacacctccgcactccccgccaataaaataattggtggaattccccccccaacctatataaatttggacaaatcaggatttcctgcttgtcagttaataaaaaaaaaaaaaaccaaaacggctcgaagggtacaccccaacccttcccctaataactgaataacattatttacctcgcccgcttccacccgcggccagtcccaatcctccaacgaacctggaacctcgtgaaaaaaaacttagcaggagaacacaaaacttaaaacagggacagtgaagaaaaaataaacccctttatcaaacactcctgtgaagtaaaataaataagaaaaagggtctcgacaccccaaatcaccccctttcaccaaaaagtgtgccccccacgccttggaatcgtctctaattgggaaacattggcccccgcacgcagaatgaacggtn

SEQ ID NO: 63530 - DNA, 686 bp, Zea mays
  misc_feature: Ceres CLONE 1531615
  misc_feature (686)..(686): n is a, c, t, g, unknown, or other
gcggtggcggccgctctagaactagtggatcccccgggctgcaggaattcgtctcacccctagaaaaaatttcattccccacaacggtcgaggtcacagtctcactttctcgcgcgggatctaattaagcaaccgcctgggctagcatcaacctggtccctctccgcgactggctctctccggatacgtctcgagcacgactacgtcacccgtcttcctgtagagccgcccgactattcataagaccctcgtcaatgcctatccggcccttgcgccccgaagacctcgccacggactcatagcaccgatgaacgttagtccaatgataccgcaaagaatggagatagctgacttgctattgcccctgctacaaccgtggctactgccttatcctgagctaggacacctacacctgcacagacaagagcaaacagtaaacgagacactaacgctcctgaccgctatgagcgctccgtcgcgtcttaccggacctgcacagcgtcctatgagacgaatacaaagattgcgaatgcttcatcgttcactgtcaaatcctaagatcacactggatgcactatcctgcgcatgcaattgctcatacacccaagagttatctctgcatgtgataatgtcactgccccgctcctgtacaacatcaatggttagatccacacacagagccagcn

SEQ ID NO: 63531 - DNA, 837 bp, Zea mays
  misc_feature: Ceres CLONE 1531628
  misc_feature: Encodes the peptide sequence at SEQ ID NO. 63532
  misc_feature (12)..(12): n is a, c, t, g, unknown, or other
  misc_feature (35)..(35): n is a, c, t, g, unknown, or other
  misc_feature (837)..(837): n is a, c, t, g, unknown, or other
cccccccccccnccccgcccgcccccgccgcgccnctacaacacccaaactggagctccccgcggtggcggccgctctagactactggatcccccgggctgcaggaattcgtctcacccctagaaaatgtgtaccggaaggtgcaccatccacgggttctaatgaagtcaagacgggagaaacttgaaagtcgcttcattttggatgtgactgttcttgatggaacactgatgacaccttctaccccgttcaccccctagaaaaataagatttggcgcatgcataacaatgggtctattgtgtggccacggggcacacagcttgtctgggttggtggagatcactttgcattgtacacatctgttccattacagattcctgaggagggtcttcctgtggacaaagagattgatgttcctgtcgatcttgcggcaccaactgggtccagggaagtgactatctttatgcacgttgggtccccccttctgggcagaaatttggccactctagtttgggtcccactccacaagtggaaaaaccccttcctttggtaaatgaacaaaaacgcgggaaggcccgcctatttaacctcctcagcgggccttcataatagctcctagctcgtaacacatacctaactttattttcatgtgaaaatctggcatcctggctgcccctctagcccgtttatggttggtggctctattcgcccacaatgggaaactggccttgattctcgttccagaccggcatttctcccctaacaccccccccgcaataccccggtgtactttttcgcccgcctgtggcctgcgaatcccccctcttgtggatggn

SEQ ID NO: 63532 - protein, 91 aa, Zea mays
  misc_feature: Ceres CLONE 1531628
MHNNGSIVWPRGTQLVWVGGDHFALYTSVPLQIPEEGLPVDKEIDVPVDLAAPTGSREVTIFMHVGSPLLGRNLATLVWVPLHKWKNPFLW

SEQ ID NO: 63533 - DNA, 810 bp, Zea mays
  misc_feature: Ceres CLONE 1531633
  misc_feature: Encodes the peptide sequence at SEQ ID NO. 63534
  misc_feature (45)..(45): n is a, c, t, g, unknown, or other
ccggccccccccccccccttttattataaaagaaacgaagaaaanaaaaaaacagaatccccgaggtggaggacgctatagaactaagtggatcccccgggctgcaggaattcgtctcacccctagaaaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgactatgcgcaagacagcggcgaaggcaaagccggcggcgagctccggcagcccgtggaacggccccgaccgcgtgctctacctgggcccgctgtccggcgcgcccccgagctacctgacgggcgagttcccgggcgactacggctgggacaccgcggggctgtcggcggacccggagacgttctccaagaaccgggagctggaggtcatccactcccgctgggccatgctgggcgcgttgggctgcgtgttcccggagctgctcgcccgcaacttcttctaattctgaaaggcccagttggttcaaggacgggtcggcaaatcttcaccgtagggtgtggctgggactaccttcgtgcaaccccgaagcctggatccaccgcgcagaaacaattcctctaccctactagggcccatgcccaaataacgatgtctccataggatcgcccattcagaagcaggtcatccactagatcaaccacagaaatgtgtccgaccaaccggtaccacaagtctcgtccacgaa

SEQ ID NO: 63534 - protein, 123 aa, Zea mays
  misc_feature: Ceres CLONE 1531633
  misc_feature (64)..(124): Pfam Name: Chloroa_b-bind Pfam Description: Chlorophyll A-B binding protein
MASSTMALSSTAFAGKAVNVPSSLFGEARVTMRKTAAKAKPAASSGSPWNGPDRVLYLGPLSGAPPSYLTGEFPGDYGWDTAGLSADPETFSKNRELEVIHSRWAMLGALGCVFPELLARNFF

SEQ ID NO: 63535 - DNA, 749 bp, Zea mays
  misc_feature: Ceres CLONE 1531635
  misc_feature: Encodes the peptide sequence at SEQ ID NO. 63536
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (30)..(30): n is a, c, t, g, unknown, or other
  misc_feature (31)..(31): n is a, c, t, g, unknown, or other
  misc_feature (38)..(38): n is a, c, t, g, unknown, or other
nnggggncccgcggcccggnncnccccccnncccgcgngttttttctttttaaaactgtgactccccgcggtggcggccgctctataactagtggatcccccgggctgcaggaattcgtctcacccctagaaaaaggaggacaacggtgtccagcataagagagagaagaggaggggaggaggtgcgagtagcaagaatggcgtgctccaccaatctctgcttctcggcgtcgattcctcctcttccagcctcttcttcttcttcttctgtctcctcccccttcctcacgatggagcgtgtgtcctatgttccgtccttgtccaggtggacaatccgatacaagcaattggggcatgcatatcggagaagccaagttctggactttgctagtgcacatgtatgcgtcaagcatttcgagcatcacatggtaaaagaagctcaagtgagaatgttgtgatgggtgatcaactggaagctaaccgtctagctgctaaacaaatgcaagaaattagggccaaagaaaagctgaataggcgcactccagcagaagctatcaatggggcattggcaatgatacggctgactgctggattgatagtggaagctcaaacaggataaggcatcttagggcagctagctggatatctgacggctatttctagtttatttggacaataatagtgcgccatctttggagatttattttttcacgttccttggcccccatatgtcttatctgttgcatcca

SEQ ID NO: 63536 - protein, 72 aa, Zea mays
  misc_feature: Ceres CLONE 1531635
MRQAFRASHGKRSSSENVVMGDQLEANRLAAKQMQEIRAKEKLNRRTPAEAINGALAMIRLTAGLIVEAQTG

SEQ ID NO: 63537 - DNA, 700 bp, Zea mays
  misc_feature: Ceres CLONE 1531642
  misc_feature: Encodes the peptide sequence at SEQ ID NO. 63538
aagctggagctccccgcggtggcggccgctctagaactagtggatcccccgggctgcaggaattcgtctcacccctagaaaaataattcacgtacaaacagctagctgttccaggcacgagattcttccggatttgtttccttgtaataattccccttgagcgtgtgtttggtatgtttctacaattctactacggagcactgtatgcatgcagttcaatctcgatctcgatggctggcttattccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactac

SEQ ID NO: 63538 - protein, 92 aa, Zea mays
  misc_feature: Ceres CLONE 1531642
  misc_feature: SWISSPROT Homolog: EC 3.2.1.23 Beta-galactosidase
MHAVQSRSRWLAYSKKKKKNETLEVPNSPYSESYYARSLAVVLQRRDWENPGVTQLNRLAAHPPFASWRNSEEARTDRPSQQLRSLNGEWKL

SEQ ID NO: 63539 - DNA, 644 bp, Zea mays
  misc_feature: Ceres CLONE 1531643
  misc_feature: SWISSPROT Homolog: EC 3.2.1.23 Beta-galactosidase
ggatcccccgggctgcaggaattcgtctcacccctagaaaaaatacctttctcggccttttggctaagatcaagtgtagtatctgttcttatcagtttaatatctgatatgtggaccatgtgttcactttgatattaaatttattttttgtgggggagggctcactacagtagcttgctactggggtcctcacgtgtcgcttgggcgttgcactacagcccaagcctggcgcaccccaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcaactcatttttttaaccaataggccgaaatcggcaaaatcccttataaatcaaaagaatagaccgagatagggttgagcgttgttccagtttggaacaagagtccactattaaagaacgtgga

SEQ ID NO: 63540 - DNA, 711 bp, Zea mays
  misc_feature: Ceres CLONE 1531650
aagctggagctccccgcggtggcggccgctctagaactagtggatcccccgggctgcaggaattcgtctcacccctagaaaaagtccttttggctgttcggcctacgattgagtggatgacctcctttcccatccagctgtagcttgcacgcaagcgggctcctgagagttccgctcgattcatcctccctaggtcgggctgaccagactcctccgaccgagactctctcactgcccacttttcccgccatagagctgcttgttcggagatcccaactggcctctgtgttgcgcttctccgactggtacatgcccgggatggacgtttctatccccctggccatgcatcgcccgataaccagctggcgcaatatcttaaaggcccatccctaatctccttcaacacgccgctcacctctgaatggccaaggtaatccgctccttctctattgtcttccactactgcgttaatgtgatctcaagactcgcactccctcggatactacgttcacccgtgccctctctcctacccctcaaactactccctccattcatgcttcactgatcgatcggcttgtgacagcactaccactattaaatagagtatactctcaaggcaagcgacgacagacggctccctgggcgatggcccactacatcgaccatctccctgatcacatttcttcctgtcgagatgccgattagccccaa

SEQ ID NO: 63541 - DNA, 941 bp, Zea mays
  misc_feature: Ceres CLONE 1531651
  misc_feature: Encodes the peptide sequence at SEQ ID NO. 63542
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (631)..(631): n is a, c, t, g, unknown, or other
  misc_feature (941)..(941): n is a, c, t, g, unknown, or other
nnnnnnnnnnnnnnnnnnnnnnnngggggggnnnttttttttttnnnnttcaaactgggactccccgcggtggcggccgctctagaactagtggatcccccgggctgcaggaattcgtctcacccctagaaaaagatacttcattagtggttcactggatgaaaaagtccgcatatggagcattcaaaaccgtgaaattgttgattggaaagatttgcatgaaatggtcactgctgcttgctataccccaaatggacagagtgcactcattggttcccataaaggccgctgccatatttatgatacctctgataataagcttctcctaaaaaaaaaaaaaaaacctgatgctcgtagggacccaattctccctatagtgagtctgtagatcgacccgctctctgtttcgtcgttgttactaagttcgtggattgggcaacaacctcgggcgtcaccgcaactaaatccccccttccgcgcgcctcccccccgttttcacccttctgggtttttaatagcgcgaaagagggccgctcctacagaaagcgccccgtcccccaccaaaatcatcgcgccactctaactaaatggagcgggaatggtcattattggggaaaaggacatgaaaacntatgtgttaaaaaaataaaatacaccccataataaaccaatgttctgctctaattgaagggcgacacgtgtgcatggaaactacgatatacaactaaacaaggacggaaataaaaaggcgccggaaaattacacagcggcgctagacggccgccggagtcacaatgaagcccggggggttggcccgcccagagccgggcttctataccggacaaaaatccaattgcttgtttaaccttatatctcgttcttgttcccgctctttgttttggctcgaacaaaatacatacgagccgtactaaaaaagacan

SEQ ID NO: 63542 - protein, 54 aa, Zea mays
  misc_feature: Ceres CLONE 1531651
MVTAACYTPNGQSALIGSHKGRCHIYDTSDNKLLLKKKKKPDARRDPILPIVSL

SEQ ID NO: 63543 - DNA, 698 bp, Zea mays
  misc_feature: Ceres CLONE 1531658
  misc_feature: SWISSPROT Homolog: EC 3.2.1.23 Beta-galactosidase
tccccgcggtggcggccgctctagaactagtggatcccccgggctgcaggaattcgtctcacccctagaaaaaatggaaacttacatgtccaaacactcgaaactatccctctctgcggtgacttaagcccccagacacatttatggtcacagagtctgaccgtccgttgtcagtcgggcaagttctcttgcacacaatgccttcgcttgagaacataccttcatgaaccagacgctcggggcacccaattctccctatactgagtcgaattacgcgcgctaactgaccggagatacaaaaaagcttatctggcaaaacccgggcgccacccacctgaatcgccttaaaacgcaaccccctttcgccagatggcgtaatagcgaagaggcccgcaccgatcgcccttcccaacagttgcgcagcctgaatggcgaatggaaattgtcaccgttaatatttttgctaaaattcgcgataaatattatgcaaaccagctcatttttttaaccaatcggccgaactcggcaaaatccctcattacccaaaataatagacctagatacggttgaccgttcttcaactgtggaacaagagtacagtatcaaagaaggtgcactccccaaccgaagcgcgaccaaacatgtataatggcaatggcccactacgtgaaccatcaccataatcaagtattttgggg

SEQ ID NO: 63544 - DNA, 865 bp, Zea mays
  misc_feature: Ceres CLONE 1531660
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (785)..(785): n is a, c, t, g, unknown, or other
nnnggggnnnnnnngggggggggggtnnnntnnnnaaacccccccatattggccgtccccgcggtgggggccgctctagactattggatcccccgggctgcaggaattcgtctcacccctagaaaaacatggagggccggccgggggaacggggtgaaaattctcgcaggattcgtcgtgttcccgctctaactatggcacgctttgtgtaaacaaggactacgtatatgattgactgagcgtactacgtcgggtttgtgtgtcgctgttacaacgagagcgagcgaggaaacatgtgatctcggtctcaacattatgaaagattagaaaattttcaaattacagatcatcgacccaaaaaagagtgaagttgacgctacgcggatacaaatccacccccaccacgaagccggattgcgggacgatgtggggggggacggtgtttattgcgagctggggcttggttaattattgtgtttgtggccccccctttttttacctttgtttaaaaattgcccctggggggcgatctacgccttgaaataactgaatgagggtccgggcataattttaggacccctctccagacaaattgtggagagtgttttatttggttggaacgccgcgacctcgaaaaggcggaataataaaatttcggtaaggaatatcgcggtggcgcttggtactcgctcaagttcttgcatatagtgttttttattcgtattccttgtcgggtcactctccactaattccccctgctattatatctttcaaaagcggggagnccggttatcgcgggttcgtttgttcctgatcatcccatagggaagccgcgggtcccccaccacttctacctacctcttag

SEQ ID NO: 63545 - DNA, 729 bp, Zea mays
  misc_feature: Ceres CLONE 1531673
  misc_feature: Encodes the peptide sequence at SEQ ID NO. 63546
aaaagctggagctccccgcggtggcggccgctctagaactagtggatcccccgggctgcaggaattcgtctcacccctagaaaaatcaccaaggaagaggagccagaacagtactggcagaccgcgggggagagggagggcgagaaccccatgatgacacccctgccctacatcatcatcttcggcatgtccacccccttcgtcatcctcgccatcgccttcgccaatggctggatcaaggtccctgtgcgatgaccgtaacgcgatcagccagcctggatcatagatgctgactcgtcagccttcatctcatccagcgtgtgtcctgcgactttgtaccttcatatatagagacaagagttctcgcttgtgacccccctgcctgagggggggggggatgtaaccccaaactgttttccttttcccaaaacttcgttcttcaagctttgttccaatttcggggcttcattcataaaaaaaaaaaaaaaacgagaccctctaggtacccaattcccccttttagggagtcgtaattccccccgcttccctgggccgccttttttacaacacccttgaattgggaaaaaccctggggttttcccacctttattccccttgaaagcactatcccccttttccccaggtggggtggatacgccaataagctccctctctctttttccctttctccagcggtgcggctttcttttatgtggataaggtagtttg

SEQ ID NO: 63546 - protein, 34 aa, Zea mays
  misc_feature: Ceres CLONE 1531673
MMTPLPYIIIFGMSTPFVILAIAFANGWIKVPVR

SEQ ID NO: 63547 - DNA, 647 bp, Zea mays
  misc_feature: Ceres CLONE 1531684
  misc_feature: SWISSPROT Homolog: EC 5.2.1.8 Peptidylprolyl isomerase
  misc_feature (647)..(647): n is a, c, t, g, unknown, or other
aaggtggagctccccgcggtggcggccgctctagtacttgtggatcccccgggctgcaggtattcgtctcacccctagataaagtgccctagacaaagaggataggttcgcctccggttccagagcggataggattgcgccgcctgattggcgattgctgatagtctgccgccggtgccctcgcccgatttgctccgccgagaacaacatggggcagaagctataatctcagtccgtcgccacctagaggctacaggagaagaactcgcagcccaagtcctcgtggtcggtatggaggccgtgatactgatagggacctcccaactagtcttttggtgaggaatcttcttcgggattgtaggcctgatgaccttcgtagaccatttgtgaaatttggccccgttaaagacatatatctgcctgaggattactacactcgggatcctagaggatttgggttcatccaatactttgatcctgatgatgcttctgatgcaaagtactatatggatggcacgatgctgcttggaaaggaaattgcttttgtctttgcccaggtaaacgagatgacgccttctgtcctgagggcccgggaattaataagtggcagtaggcgttcttatgatgagaggttgcgctcaaggtcn

SEQ ID NO: 63548 - DNA, 791 bp, Zea mays
  misc_feature: Ceres CLONE 1531686
  misc_feature: Encodes the peptide sequence at SEQ ID NO. 63549
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (21)..(21): n is a, c, t, g, unknown, or other
  misc_feature (22)..(22): n is a, c, t, g, unknown, or other
ttaaaaccnnnnntaaatatnnggccaaccgcggggacccttaccattgagttttgtgtcaggatggagctacccgcggtggcggccgctctagaactagtggatcccccgggctgcaggaattcgtctcacccctagaaaaccgccccgctccttgcagccgatccccaattcctccttcggatctcgcatacagcgcagcgcacgtgtgaaggaagggggacacggagaaagatggggctcgagtactggaagctctacatccggcagctcgcctataaggacatgcggatcctcatgggcggcctctacgccgccggtaaaaccaccatactctagaagctccatctcggaaagatggtctccaccgtccccaccattctttttcaatgttgaaactgttgaggacaagaacattactcccaaagaactggaatggtctgcggtatggaaaaaatcagacctcgttatggaagcattacttgcaagaacaccccaggaaatactgtctggaagcggacccccaatggacccgtgaccaaagatagccgaagctcgaagcataaaaagcctcaacgaagggccggaacaaagcgataaacttcccaagataacaggagcccagtttggtgaagtagacctagggagaaaaaaaaaaattcccctaagcggccgattttaattgccaggccccgcaaatatatagtcgaaccaacagctgttgtgaattataatatatgtaagcgagctgtcgcagagcgcgaggaagcgtgggagtagaccaaccccag

SEQ ID NO: 63549 - protein, 34 aa, Zea mays
  misc_feature: Ceres CLONE 1531686
MGLEYWKLYIRQLAYKDMRILMGGLYAAGKTTIL

SEQ ID NO: 63550 - DNA, 640 bp, Zea mays
  misc_feature: Ceres CLONE 1531688
  misc_feature: SWISSPROT Homolog: EC 3.4.22.16 Cathepsin H
ggagctccccgcggtggcggccgctctagaactagtggatcccccgggctgcaggaattcgtctcacccctagaaaaataaaagtataaatgtattaagagttcatttgtattttaacaaaaaacattggtcaaagttatattttggagaccgtgtcgttgtcctaaacgacaactaataggaaaccggagggagtaagcaattaagcatttgaatataattcagataatttttagcagccagttattagacgttcttatatttctttttacatgttcttttcactctttatcttttcttctgcatagaaatggccatcatagcatgttctgaaagtagaaaaagggggtcgtgcataaaaaataattaaattcgtttgatgcttattatggcagcactactggtgcacttgaggctgcatatacccaggcaactggcaagcccatctctctctctgagcaacagcttgttgactgtggttttgcattcaacaatttcggatgcaacggaggccttccatcccaggcctttgaatacatcaaatacaatggtggccttgacactgaggaatcttacccttaccaaggtgtcaatggaatctgcaagtttaagaatgagaatgttggagtcaaggttttgg

SEQ ID NO: 63551 - DNA, 804 bp, Zea mays
  misc_feature: Ceres CLONE 1531695
  misc_feature: Encodes the peptide sequence at SEQ ID NO. 63552
  misc_feature (1)..(1): n is a, c, t, g, unknown, or other
  misc_feature (11)..(11): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (186)..(186): n is a, c, t, g, unknown, or other
  misc_feature (722)..(722): n is a, c, t, g, unknown, or other
  misc_feature (723)..(723): n is a, c, t, g, unknown, or other
nggggaactgncgcccnnnntttttnnnnnnnnnnnnnnnnnnngagactnnnncaacactcggactccccgcggtggcggccgctctaaaactagtggatcccccgggctgcaggaattcctctcacccctagaaaaactcctgccttcctccatccctcccccctaccctaccccccacacggncacacacacaccggcgcgtccgacccccacgccggcgactgctcgaccggtcggctccgatggggtacgtgctgtcggcggtgggcagggtgctggagcagcccacggcgtggggggcggcctgggagatggcactcctcgcggggcccctgtgggcggcggccctcctcggactgctgctcggctgggcctggcccctgcgctgggcatcccgccctcgacggtcccttcgtgccaccaccgcgggggggggggggggggggacttcatcccccctttctttctcactcgtacttttcggaaggacccataatccccgggcctcttacagtgggcgcggtaccgggacccgcccgagcaatcgcgaggcgagtggtgataccccgatcgccagcggcctacctgaaacacctggaaaaatcaggaggtggtttggggactattgtccgtgtgagataactgaagacaaacactaactcgtttcgccgttggcagcacattgaggccaaaaattagaagacgcggtcaccctaccnncgcaagggcctccggtctgtgtatgtcggctcacagagaaaacagcatcatgggcgcccccggcttggtgcggatgacacg

SEQ ID NO: 63552 - protein, 138 aa, Zea mays
  misc_feature: Ceres CLONE 1531695
MGYVLSAVGRVLEQPTAWGAAWEMALLAGPLWAAALLGLLLGWAWPLRWASRPRRSLRATTAGGGGGGTSSPLSFSLVLFGRTHNPRASYSGRGTGTRPSNREASGDTPIASGLPETPGKIRRWFGDYCPCEITEDKH

SEQ ID NO: 63553 - DNA, 631 bp, Zea mays
  misc_feature: Ceres CLONE 1531698
  misc_feature: Encodes the peptide sequence at SEQ ID NO. 63554
ggagctccccgcggtggcggccgctctagaactagtggatcccccgggctgcaggaattcgtctcacccctagaaaaaaaagaaaacccaacgcaaaagcaacaaacaactcccaaggtccaaagcccacccgtactcatccgcgatccccaaccatggccgtcggcgacgtggagacggcggcgccgctgctgcccccgccggcctctgccctggcggacgagccctccgcgggcccgcccccagacgaccggctcggcatcggctacctcatcttcttcaccctgggcgccggcttcctgctcccctggaacgccttcatcaccgccgtcgactacttcgacttcctctacccgggggcccccgtcgaccgcgtgttctccatatcctacatggggagggccgggctgtacggagcgttcgatgtgactgtcgccgccacggctctgtgcggggtcgccgacgcgctcgtgcagggaggcgtcatcggcttcgctggggagctgcccgaacggtacatgcaggccgtcgtcgccggaaccgccgcctcaggagtgcttgtctcggcattgagagtcttcaccaaggcactgtacccacaggacgcgaacgggctaaggcaaagcgcgat

SEQ ID NO: 63554 - protein, 158 aa, Zea mays
  misc_feature: Ceres CLONE 1531698
MAVGDVETAAPLLPPPASALADEPSAGPPPDDRLGIGYLIFFTLGAGFLLPWNAFITAVDYFDFLYPGAPVDRVFSISYMGRAGLYGAFDVTVAATALCGVADALVQGGVIGFAGELPERYMQAVVAGTAASGVLVSALRVFTKALYPQDANGLRQSA

SEQ ID NO: 63555 - DNA, 641 bp, Zea mays
  misc_feature: Ceres CLONE 1531703
  misc_feature: Encodes the peptide sequence at SEQ ID NO. 63556
  misc_feature (619)..(619): n is a, c, t, g, unknown, or other
ctggagctccccgcggtggcggccgctctagaactagtggatcccccgggctgcaggaattcgtctcacccctagaaaaagctgcgtgtccctctctctccctgcgctcgtgctccgcccaggcccctttcctccaccgcgggcgcaaaccctaaccctacagccgctcgccccgcggcgcctgccaatggcgccccccgtgtgagtgtgtgtgagaggcagagacctagaggccgctacccggggaggagagggagggagagggagaggctgatagatgtataagcaggggggagcgggggtaggggctggtctggaccggaaacggatcagcgacgcgctagacaagcaccttgagaaggcggtcgcatcgccgtccacatcgagggggtcagcgggcggcggcggtgtgcgcgaccaccaccgcctcatcgtgccgtcctccgtgtcgtccatccccaagggccgctgctccgaaggtgacgtcatgcgttattctccccctttcagtttcaggtgaccgcgccatggtctcgtggcgtgccgcgaatccgtgcctattttggtgtgatcatgagtcatgaggctgtggcagctgtgttacttttcggtgcagtangatgcacgtgcggaaagagatt

SEQ ID NO: 63556 - protein, 80 aa, Zea mays
  misc_feature: Ceres CLONE 1531703
MYKQGGAGVGAGLDRKRISDALDKHLEKAVASPSTSRGSAGGGGVRDHHRLIVPSSVSSIPKGRCSEGDVMRYSPPFSFR

SEQ ID NO: 63557 - DNA, 900 bp, Zea mays
  misc_feature: Ceres CLONE 1531705
  misc_feature: Encodes the peptide sequence at SEQ ID NO. 63558
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (21)..(21): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (900)..(900): n is a, c, t, g, unknown, or other
ttaaaaaaannnaaattatantggaatccccctcttnnnnnnnntttttatnnncccaaaactggagctccccgcggtggcggccgctctagaatagtggatcccccgggctgcaggaattcgtctcacccctagaaaaagtgctatccccgcccattcgtcaccagccaggtcccggaaccttatcaccaaatccttacgtcatggcgggcgcgctcttctccagctcgctctcgccccgcttcctcggcctatcctcctcgaagccggccgcgcccgtggcctcagactttctccccttcaggctggccgctgcactctgtgtccggcgcccgggccttccaacgcgggtctacgaatgccgttggccggccaagggggatctttgcgagtttgggtaccttagggggggggaaggagtatgtatttttttccctccctcccataagagaggggggggggggtatcacacccgtcactcttagcagcacctgcgccgcccccatgcgggtgggggcatactagtgcagcgggggctcctattcaatttataggggaaggcgatccggtgatctcatatcgggagccactgagcggttggtgcggatatttgtcgccgacctttacatggctggactgcgtgtgagggctcgcagtgatattcgcgcacgtcgcgcgggacacgcgggatgtatcgggggtggggagattacacgacgtggcgagcaatacgacgccggtgggcggtgatggcgtcccagccgaagtgataccctgggtgggtcgccggttgatcgatctctggagcagggtgcgggagcggtagaaacgacccacttgcatgatggatgatccgttctactctcatcctacccgcccggacatggggggccagggggn

SEQ ID NO: 63558 - protein, 93 aa, Zea mays
  misc_feature: Ceres CLONE 1531705
MAGALFSSSLSPRFLGLSSSKPAAPVASDFLPFRLAAALCVRRPGLPTRVYECRWPAKGDLCEFGYLRGGEGVCIFFPPSHKRGGGGYHTRHS

SEQ ID NO: 63559 - DNA, 621 bp, Zea mays
  misc_feature: Ceres CLONE 1531706
  misc_feature: Encodes the peptide sequence at SEQ ID NO. 63560
ccccgcggtggcggccgctctagaactagtggatcccccgggctgcaggaattcgtctcacccctagaaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcgattgtaggtcccccctagaaaaaaaaacctcctctcccctcgttctcctccgcctcctcctcccacctccccacacgggcacacctgccctccccgtcgccgcggacccactcccatggcaaagctcccgcgtctaccctgctcgtttgccgttctcgcgctcatgtgcatcatcccgctcacagcgccgcggcctgcactgtcctcgcgcgcggccccaagggacggtgtctccttcgc

SEQ ID NO: 63560 - protein, 84 aa, Zea mays
  misc_feature: Ceres CLONE 1531706
MVMASSSGLRSCSAVGVPSLLAPSSRSGRLAPFCANATTSGRVTMSAEWMPGQPRPAHLDGSSPGDFGFDPLGLATVPENFERL

SEQ ID NO: 63561 - DNA, 633 bp, Zea mays
  misc_feature: Ceres CLONE 1531707
  misc_feature: Encodes the peptide sequence at SEQ ID NO. 63562
ggagctccccgcggtggcggccgctctattactagtggatcccccgggctgcaggaattcgtctcacccctagaaaaaacgcacaacacaagagctactaactactatagctcctcatctcaagtgtgtagacgagactgagagagcgccatggccagcctccaagtcactcctacttcggcgttcactcagtggaatgagctgaagttcgaaggcctgtacttgttccacaactacgtgggctcaggcgccaaccaaactcaggtcataagcaacaaggcgccgattggcatcggtgccaccgtagttaacaactggacagtgtgtgacgggccagggccgaacgcaaagctcattgcccgtgcacagggcttgcatatccaagccggcaactgggtcaactccttcagcctagtgtttgtggatcaaaggttcagtgggtccacgcttgaagtgaccgggatagtagttgaatccggggagtgggctattgttgggggcaccggtcagtttgccatggcaaatggtgtcatctccaagaagctccatgggaagacaagcgaaggggacatcatacaactcaccatccatgctttctgtccggtgctcggagcgacaaagcgctcggccaca

SEQ ID NO: 63562 - protein, 161 aa, Zea mays
  misc_feature: Ceres CLONE 1531707
  misc_feature (3)..(152): Pfam Name: Dirigent Pfam Description: Dirigent-like protein
MASLQVTPTSAFTQWNELKFEGLYLFHNYVGSGANQTQVISNKAPIGIGATVVNNWTVCDGPGPNAKLIARAQGLHIQAGNWVNSFSLVFVDQRFSGSTLEVTGIVVESGEWAIVGGTGQFAMANGVISKKLHGKTSEGDIIQLTIHAFCPVLGATKRSAT

SEQ ID NO: 63563 - DNA, 712 bp, Zea mays
  misc_feature: Ceres CLONE 1531711
  misc_feature: Encodes the peptide sequence at SEQ ID NO. 63564
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
ggggggggagggggagggaaatggggtccggggnnttnnnntanaaattannnnnggaaaactggagctcaccgcggtggcggccgctctataatagtggatcccccgggctgcaggaattcgtctcacccctagaaaaaccgcgtcgccttatcgggagcaacggcaacggcagcctctcctccgcgccatcaggcagccatgggtccgggcgcgtccacctccgcgcagccgctgtcccgactcctcctcagcctcccgaagccaggcgccgcgaggcacccccgctcctcctcctcctctccttcccagcctcgcccggacgtcgccgcggccaggagccccggcctcgtcctccggcggcgcaaggcagcggccgccctgctgtcgaccgccttcctctcccgattcgccctccccgcggctgccgcggacggcggggagtgcccgctggaggtggcgccgtcctggctcaccttctgcgaccgcgtcgtcggcaccggcgccgccgcccaggagggacaactcatcagggcgcattacacggggaaggctggagagacggaacggtgtttcaacaactagctacaagacgcggggaaggccgcgtcaccattccgccgttgggagtacagaagaaggttgatccaaaggggaggggggactcatgggctatttggttaggacgtgctaaaagggaaatcccctaccg

SEQ ID NO: 63564 - protein, 127 aa, Zea mays
  misc_feature: Ceres CLONE 1531711
  misc_feature: SWISSPROT Homolog: EC 5.2.1.8 Peptidylprolyl isomerase
MGPGASTSAQPLSRLLLSLPKPGAARHPRSSSSSPSQPRPDVAAARSPGLVLRRRKAAAALLSTAFLSRFALPAAAADGGECPLEVAPSWLTFCDRVVGTGAAAQEGQLIRAHYTGKAGETERCFNN

SEQ ID NO: 63565 - DNA, 731 bp, Zea mays
  misc_feature: Ceres CLONE 1531712
  misc_feature: Encodes the peptide sequence at SEQ ID NO. 63566
  misc_feature (33)..(33): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (68)..(68): n is a, c, t, g, unknown, or other
  misc_feature (83)..(83): n is a, c, t, g, unknown, or other
ggcaggaacggaaaagagggaggcgcaaaaaanttttctnnnnnnnnnttnnnnnnnaaaaaaaaggnactccccgcgggggnggccgctctagaactagtggatcccccgggctgcaggaattcgtctcacccctagaaaaaggactctagccatttactgcaagaagccattttctttcttctctagccgccgccgccgccggccggaacctggcgccgagcgcccttctcttcctatccagccgcagctgccagggcgtagtactcctggccggcgtctccctcctctcttcctgcgcattctcctctctggaaaggttttgcaggtttcacacttcttatcatggatgataagaacaaagtcaaaaaggaaatagatggccccctttggacccccacctcgcaaggggggacttaaattcccacctaaagtacctcagaagaaacctgctaaggttgtcccaaagaaggaaccagttgaagagagaaaggacgatgctttggataaggagttattggatgaaacttaagaaggccgcaaaacaagtatcccctcaagaattaaggcccgacaaaaaagcccagaaaggggtacccagggttgccactttggaacaaggaaaacctctctagttaatgccaagaaaaattttttcccagtggcccacaaaaaaggaatttcttctccagcggaggggggggaagcatacccgaaaggttttacccaaa

SEQ ID NO: 63566 - protein, 50 aa, Zea mays
  misc_feature: Ceres CLONE 1531712
MAPFGPPPRKGGLKFPPKVPQKKPAKVVPKKEPVEERKDDALDKELLDET

SEQ ID NO: 63567 - DNA, 763 bp, Zea mays
  misc_feature: Ceres CLONE 1531714
  misc_feature: Encodes the peptide sequence at SEQ ID NO. 63568
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (81)..(81): n is a, c, t, g, unknown, or other
ttgtggggggggacgtcgtcgcatggtgttgtnnnnnnnnnggttnnnnnncacaatgaggctccccgcggtggcggccgnttttcactcctggatcccccgggctgcaggatttcgtctcacccctagaaaaaactcgagctcgagcgatcccactcccgatcagcagctgatcgctcactcttgcagctcgatcattctttagctgctctagctctagcctctagccctagctagtagctagccactcggtcgtgtagtcatcagccttctgatcgtcacccatgggcactgccgaggtccagaccccgaccgtcgtggcgaccgaggaagcgccggtggtggagaacccggctccgcccgccgttaatggccaaagaagctgcccccgccgcccaaggccaaagtggaaggagccagctgcccccggcgggagaaccaacccagctgccgccgctaaaacccccacaacatcacccggagaaaacgaaaaaaaagaaaacgcccaaaggaaggaagaaaaattgcacaaagaagcatgaaatcccggaaaacggaaaccaggcgatcaaataaaaattaaaggaataagatgaaaatctgaaagaggtcaaaatggcgtaaaatcgaaagtgaaagctgaggcgggccgggagatacaccataggaatcttatctgtcaaacaaaaaaatcaccccctggggtttatgatctgggcgcaattatatggaagccacacacaacagactcaacatcaatacc

SEQ ID NO: 63568 - protein, 85 aa, Zea mays
  misc_feature: Ceres CLONE 1531714
MGTAEVQTPTVVATEEAPVVENPAPPAVNGQRSCPRRPRPKWKEPAAPGGRTNPAAAAKTPTTSPGENEKKENAQRKEEKLHKEA

SEQ ID NO: 63569 - DNA, 622 bp, Zea mays
  misc_feature: Ceres CLONE 1531715
  misc_feature: Encodes the peptide sequence at SEQ ID NO. 63570
ccccgcggtggcggccgctctttaactagtggatcccccgggctgcaagaattcgtctcacccctagaaaaatccaacgacgcaattgacatcccctcgcctaccccagctctacccgcgacgaagcatcaccaggaaagatgacgtgctcaatggatctcccggccaaaggcgggttcagcttcgacctgtgccgccgcaacagtatgctggagaagaacgggctcaaactcccgggattcaggaagaccggaacaaccatcgtcggcctcgtctttcaagatggggttgttcttggggcagacacaagagcaactgaggggcctatagttgctgataagaattgtgagaagatccactttatggcgccaaacatttattgttgtggagcaggaactgctgctgacactgaggctgttacagacatggtcagctcgcagctacagctgcaccgttacgcaacgggtcgcgaatctagagtcgtaactgctcttacactgctgaagtcacatctctttaggtatcaaggccatgtcagtgctgcccttgttcttggtggagtggattgtactggaccgcatcttcacactgtttatccacacggctccactgatactcttcc

SEQ ID NO: 63570 - protein, 160 aa, Zea mays
  misc_feature: Ceres CLONE 1531715
  misc_feature (35)..(160): Pfam Name: Proteasome Pfam Description: Proteasome A-type and B-type
  misc_feature: SWISSPROT Homolog: EC 3.4.25.1 Proteasome endopeptidase complex
MTCSMDLPAKGGFSFDLCRRNSMLEKNGLKLPGFRKTGTTIVGLVFQDGVVLGADTRATEGPIVADKNCEKIHFMAPNIYCCGAGTAADTEAVTDMVSSQLQLHRYATGRESRVVTALTLLKSHLFRYQGHVSAALVLGGVDCTGPHLHTVYPHGSTDTL

SEQ ID NO: 63571 - DNA, 652 bp, Zea mays
  misc_feature: Ceres CLONE 1531716
  misc_feature: Encodes the peptide sequence at SEQ ID NO. 63572
  misc_feature (288)..(288): n is a, c, t, g, unknown, or other
ggcggccgctctagaactagtggatcccccgggctgcaggaattcgtctcacccctagaaaaagaggaattcgcccccgaatccatcgatttgctcagtccagtccgccgatccgtggatcgattcgtgcgtgggctctgtcctccccggggttccgatctggtcctcgcctcgccggaggaggagctggaggagatgaacggcaccgggggcagccaccaccagcagcagcacaggctccggcagcagcagcagcagcaggcgctcctgatgcagcaggcgctgcancaacaccagcagctacatcagtaccagtccggcgtcctcgccgccgcggttttcgcggccttgacccggaggggggctgtttccaatggcaatctttccccctggccttgatccttcccctttggtcgcattgggtatgttggaaacgtgaaccccctatgtcccggatagcccttttgattgaagttttcccgaggggttggccttgtggtaaagtagcaagcctctttccggaaggtatattcgttcctttggggtttgggggactcactattgctcgaagggtctgcctgccctcgccaatcttgaaccccgtttggggccagtctcttgatttggggcgtggttttccgcggtggttctt

SEQ ID NO: 63572 - protein, 67 aa, Zea mays
  misc_feature: Ceres CLONE 1531716
  misc_feature (31)..(31): Xaa is any aa, unknown, or other
MNGTGGSHHQQQHRLRQQQQQQALLMQQALXQHQQLHQYQSGVLAAAVFAALTRRGAVSNGNLSPWP

SEQ ID NO: 63573 - DNA, 805 bp, Zea mays
  misc_feature: Ceres CLONE 1531717
  misc_feature: Encodes the peptide sequence at SEQ ID NO. 63574
  misc_feature (20)..(20): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (805)..(805): n is a, c, t, g, unknown, or other
taagttgaggggtgaatggntggataaggagggtggaatggnnnccccccnnnnaaaaactggagttccccgcggtggcggccgctctttactagtggatcccccgggctgcaggaattcgtctcacccctagaaaaaaggccagccaccatggctccaccacctctgttcccgctcccgcctctcctcatcctcctcgtcatcgtgcctctgttccccaccgccgcgccgacggccacgacgctgccgctgtaccgccacctaccgcacgtagccgaggccgtggcatcgcaccaccaccacccgctgtcccgcctggccgccgcgtcgctggcccgcgcgttgcacctcaagcgccgggaccccaaccaccacatccagaaaggatcaggcggtcacccgtcagttacaatccaccagccgcgcttgtaaccgcacttactaactgcggcttacacctttcacgggcgttccttcaggtatgcataccgcaagccgcttcccacgttgctgcttctaacaaccgaggcagcacactcttcactgtggggttgatctatggcaaactaaatagtcaaaaataaatgggccgaataactaggttccctccgaccatacaattctaccggacgcgtcctcggtgtttttccaacacccgaagaaattccgtcacttacatataaataatacagggtaagatttcactattaatactatacgcttggccctttagtgttgtcacctactgtgcatgcaaatatatctttagcgtccctacgggggcggtacatattatacgcccttn

SEQ ID NO: 63574 - protein, 93 aa, Zea mays
  misc_feature: Ceres CLONE 1531717
MAPPPLFPLPPLLILLVIVPLFPTAAPTATTLPLYRHLPHVAEAVASHHHHPLSRLAAASLARALHLKRRDPNHHIQKGSGGHPSVTIHQPRL

SEQ ID NO: 63575 - DNA, 633 bp, Zea mays
  misc_feature: Ceres CLONE 1531725
  misc_feature: Encodes the peptide sequence at SEQ ID NO. 63576
tatctggagctccccgcggtggcggccgctctatactagtggatcccccgggctgcaggaattcgtctcacccctagaaaaagtatatccgtatatgcctatgactatgagccgtgctggaacactatgatcagaaactgcgaaatggagcccagaatgttcttgccaaaaaaaaaaaaaatcaagctgcccattccctcgtgacagcagctgcctgcctgctccgaggcgccacccagctcttcctcgccccagcagccgcttcccgagatccttttcactttcaccaccagggtacatagaccgcatctgcggtgctctgcgctcctcggactcgatttgttggttcatccatccagctgccgccggacgtcgatcagctacctatcttgaaaccacaggaccgagcgtggaaactcccggaccggacattccattttccattccgaagggggggtgagaaggcggggaatgagtacaaccaaggtgaagagacgtgtgggcaagtatgagctcggccggaccataggcgagggcaccttcgcgaaagtcaggttcgcgagggacacggtcaccggcgaggccgtggccattaagatcctggacaaagagaaagtcctcaggcacaagatg

SEQ ID NO: 63576 - protein, 54 aa, Zea mays
  misc_feature: Ceres CLONE 1531725
  misc_feature: SWISSPROT Homolog: EC 2.7.11.1 Non-specific serine/threonine protein kinase
MSTTKVKRRVGKYELGRTIGEGTFAKVRFARDTVTGEAVAIKILDKEKVLRHKM

SEQ ID NO: 63577 - DNA, 694 bp, Zea mays
  misc_feature: Ceres CLONE 1531728
  misc_feature: Encodes the peptide sequence at SEQ ID NO. 63578
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (12)..(12): n is a, c, t, g, unknown, or other
  misc_feature (15)..(15): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nnnntttaaaanccnattcttatttttgtagacatctttttnnnnngtatnnntttaatattggaactccccgcggtggcggccgctctagaatagtggatcccccgggctgcaggaattcgtctcacccctagaaaaagagttgaaattgggatatataaaatctccacctccgaccctcctgtcccgctcctcttctatttgttcgtttacagcccccagctcatcaaagatcacattttgagcaccgctatataaacaaagttggcaggagtcgtagattagcaggccgcccgtctatttttttgttcatgttttgaaagtgaaggaggatttgggtgggcaacgtctacctctgccaaaaataatcggcgtccatatgcaggcgtcgtatctttagaataagtgaatagcaggcagatggcaggcggcggattcgtggaggacatgatgagggagcagagcctcctggaggcgacgtgcggcgacctcttcgaccacatcgacgacctcctcgacttccccaacgaggactccgccgccgccgtgctcctcctggacgcgccagcgcccgagagcccgctgtcagcgcgcatcatcgacgtcggccgcgccggcaatgcgctcgttcccgcctgctgccccccgcgcatcaagacgcttctgctagcgccttcttcgtcgacacagtggt

SEQ ID NO: 63578 - protein, 91 aa, Zea mays
  misc_feature: Ceres CLONE 1531728
MAGGGFVEDMMREQSLLEATCGDLFDHIDDLLDFPNEDSAAAVLLLDAPAPESPLSARIIDVGRAGNALVPACCPPRIKTLLLAPSSSTQW

SEQ ID NO: 63579 - DNA, 576 bp, Zea mays
  misc_feature: Ceres CLONE 1531731
  misc_feature: Encodes the peptide sequence at SEQ ID NO. 63580
gctctagaactagtggatcccccgggctgcaggaattcgtctcacccctagaaaaaacccatcagccatccccttttgctgcaaatctttctctgaattgtgggtctccgacaatggcggcgctagctccatccaagattctgggcatccagctcaacttcgcggggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggactacctcaccggagaggtccctggagactatggctacgacccttttggcctgggctagaagccagaggacttcgccaagtaccaggcctacgagctgatccatgccagatgggccatgctcggtgccgctggcactgtcatcccagaggcctgcgacaagtccggcgctaactgtggccctgaggctgtctggctcaagaccggc

SEQ ID NO: 63580 - protein, 30 aa, Zea mays
  misc_feature: Ceres CLONE 1531731
MLGAAGTVIPEACDKSGANCGPEAVWLKTG

SEQ ID NO: 63581 - DNA, 779 bp, Zea mays
  misc_feature: Ceres CLONE 1531733
  misc_feature: Encodes the peptide sequence at SEQ ID NO. 63582
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (76)..(76): n is a, c, t, g, unknown, or other
  misc_feature (449)..(449): n is a, c, t, g, unknown, or other
  misc_feature (779)..(779): n is a, c, t, g, unknown, or other
aatgggnnnnnnnnnnnnnnnnnnnattnttnnnnnnnnnnnnnnnnnnnnnccccccgagactccccgcggtggngggcgctctagaactagtggatcccccgggctgcaggaattcgtctctcccctagaaaaaaccggtctactcctcgatcggaaaggccgcaactacctagatctcgaaccctcgccgccgcttctttcccgatcgccgcggccatggcgaaggagttccccgtgccgccggtggacttcacgccgtccacaccgacgcaccgccggtaccctccccagggggtgggggcctcccctccgcccgcgttcgcgccgccccgcctctccacctcatcaggcggcaaaccgagtccccttaatgtcgttccatgaatcagctgcaaaggtcctcctccttcctctttccccccccctgttggggggggggggggggntttcccccgtttcccagcttatcctccaaaaaataaaaccgcctgattcttcagagaagcccaggaataagcacccacccaaattctcgctggaagaaaaaagcacagtcgggccgcagcattattaattattggggaacccatcccatgacgggggaaaaggcaaagcttggtcgtggccacgttgctacctatcgcacgcaaggacatttgagaaagtattgcctaagcacaagacgggtgtgggggaaggatgagacaacttgatgaaataactgcaaatcagtaacaagcggaacaaaacagcgtagtacgactgcctatccttgn

SEQ ID NO: 63582 - protein, 55 aa, Zea mays
  misc_feature: Ceres CLONE 1531733
MAKEFPVPPVDFTPSTPTHRRYPPQGVGASPPPAFAPPRLSTSSGGKPSPLNVVP

SEQ ID NO: 63583 - DNA, 818 bp, Zea mays
  misc_feature: Ceres CLONE 1531749
  misc_feature: SWISSPROT Homolog: EC 3.2.1.23 Beta-galactosidase
  misc_feature (451)..(451): n is a, c, t, g, unknown, or other
gaaatagaattggacaggtggacgcgtgtaaaaataaccccaaaaaaaaaacaaaacaacgcggggagggacgctcttcaaaagtggatcccccgggctgcatttatccatctcacccctagaaaaaagtattttttagtggtagctttcaatactgttttgaacctgtagttggctttattttctgagtaaaatgcaccactcgaactttactcaaaaaaaaaaaaaaaaacgagacgctcgaggtacccaattcgccctatagtgagtcgtattacgcgcgctcactggccgtcgttttacaacgtcttgactgggaaaaccctggcgttacccaacttaatcgccttgcagcacatttttttttcgccagctggcgtaatagcgaaaaggcccgcaccgatcccccttcccaacagttgcgcagcctgaatggccaatggaaaaatgnaccccccggggtgagttttgttaaaattcgcgttaaattttttgttaaatcaagctcattttttttaaaccaatatggcaaaaatcgggcaaaatccctttttaaatccaaaagaatacaaccccagagttggggtcgaagcgttggctccagttttcgaaagacaaattcccctaattaaaggaacgtgggactccacacgccctaaggggtgcaaaaaaacccatcttctcaggggggatgtctccccctacctgaaacccacacaaccctacactaaatctttttttgggggtccgaagagagcctagaaagcaccaaaaatcggaaaaccctaagagggggaccccctcaaattaagtagcat

SEQ ID NO: 63584 - DNA, 851 bp, Zea mays
  misc_feature: Ceres CLONE 1531753
  misc_feature (19)..(19): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (577)..(577): n is a, c, t, g, unknown, or other
  misc_feature (851)..(851): n is a, c, t, g, unknown, or other
tacatggtcccccccctcnaaacccnnnnnnttannnnnnncctaaatgcgctccccgcggtggcggccgctctagaactagtggatcccccgggctgcaggaattcgtctcacccctagaaaaaacatcgggaaccgccgccgacgccgcaggaggagacgcatcgaggttagcacgcgaagaagcgaccatgagggccaagtggaagaagaagcgcatgacgaggctcaagaggaagcgcagaaagatgaggcagagatccaagtaggcagatcgagatggaattgtggacctgatgacatgcgtgggtacctacatttcttcggatggcgttggtgtgcctgtggagagatgtcctcctgccatggtgtcccggtccgccatcaagttgaacgtcttgcccctgcccctttcagagggggggtgggccgtggttctaacttgtattttgaatcccccccctgggggggttggggaggggggccccactttgcgtttttggtggaccttttttgggatgggagcgttttattcggcgtgaaaaatagtcgtaccgggcccagattttggagcctngtacaactggaagatgagcaagcgcggggtgccgctccgcggtggccccggagtgccgccctgagtattgagggtggtgtttgggggtggtcggtgccctggggcgtcctttctccccacctgttccggatcagtggagacaccgctaggcttttcacgccagtcgttaattggcctcgcgtggtgcgatcccccccgttttagtgcgcgcgggccggattacgcgcccaaggcgtgctgctccatggcgtgctcgcctcgccagggcgggcgn

SEQ ID NO: 63585 - DNA, 720 bp, Zea mays
  misc_feature: Ceres CLONE 1531755
  misc_feature: Translation starting site: 356
  misc_feature: SWISSPROT Homolog: EC 3.2.1.23 Beta-galactosidase
  misc_feature (363)..(363): n is a, c, t, g, unknown, or other
  misc_feature (364)..(364): n is a, c, t, g, unknown, or other
ccgcggtggcggccgctctagaactagtggatcccccgggctgcaggaattcgtctcacccctagaaaaattctgaactgaaagagtgcatctgggcagatgctgtgaaagaaagtgaaagatgatgagctactctaggcatgtgcttggctggatcttttttttttctgccattagactgtacgctcgtttcaggatatccgagttgttttttcctgctgaactgcttaactctagggtgtactcaatccatcatgtatgttgcaattttcagaacttgcctatggtacttgaaatggacttcagggctacttgctccagctctctgtgtaattgctaatatacattgtaattgatgcttannaaaaaaaaaaaaaaaaaaaaaaaaaaaaaaaaaaaaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccttttcgccagctggcgtaatagcgaagaggcccgcaccgatcgcccttcccaacagttgcgcaccctgaatggcgaatggaaatggtaagcgttaatattttgttaaaattcgcgttaaatttttgttaaatcacctcattttttttaaccataggccaaaatccga

SEQ ID NO: 63586 - DNA, 701 bp, Zea mays
  misc_feature: Ceres CLONE 1531759
  misc_feature: Encodes the peptide sequence at SEQ ID NO. 63587
  misc_feature (384)..(384): n is a, c, t, g, unknown, or other
  misc_feature (385)..(385): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (392)..(392): n is a, c, t, g, unknown, or other
  misc_feature (393)..(393): n is a, c, t, g, unknown, or other
  misc_feature (498)..(498): n is a, c, t, g, unknown, or other
  misc_feature (701)..(701): n is a, c, t, g, unknown, or other
gcggtggcggccgctctagaactagtggatcccccgggctgcaggaattcgtctcacccctagaaaaagtcaccattgttcaggcatgggactgggatggcaggcgaagctgattcttcacggagaggcgatgcgcagagtagggaagtagtagaagctgccatgatcgacctctcttctccatcaccagttaaagtcgataatagtagaaggaatggtaagaaggattgtgaggctggcagcagcagtcagtctccagaacacgagaggaaagcgagggagctcagattgttcctagacagtataagagacgagttgtattaacattcgattggattgtatgtaaaccgatatgtgcaatgatgatgtgtgttctccatttcnnannnnannaaaaaaaaaaaaaaaaaaaaaaaaaaaaaaaaaaaaaaaaaaaaaaaaaaaaaaaaaaaaaaaaaaaaaaataaaaaaaaaaaaaaaggaaaaaaaaaaaaaaanccgaaacccccgggggccccaattccccctaaagggggccgaattacccccgcccccgggccgcttttttaaaaccgcggggcggggaaaacccgggggttacccaatttaatccccttggagccaacccccctttccccccttggggaaaaaagaaaaaggccgcccccgatcgcctttcccacaattgccccccctgaagn

SEQ ID NO: 63587 - protein, 75 aa, Zea mays
  misc_feature: Ceres CLONE 1531759
MAGEADSSRRGDAQSREVVEAAMIDLSSPSPVKVDNSRRNGKKDCEAGSSSQSPEHERKARELRLFLDSIRDELY

SEQ ID NO: 63588 - DNA, 619 bp, Zea mays
  misc_feature: Ceres CLONE 1531775
  misc_feature: Encodes the peptide sequence at SEQ ID NO. 63589
  misc_feature (504)..(504): n is a, c, t, g, unknown, or other
  misc_feature (567)..(567): n is a, c, t, g, unknown, or other
gctctagaactagtggatcccccgggctgcaggaattcgtctcacccctagaaaaactcacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtccccgagagactcctgcggtcgagcangaggcagccgccgaggaagaagctgctgctgctcctcctgctggtgccgaagagcccgccgcngccgaacctgtcgccgaagcagaagctgctgctcccgaagagctcgccgcgg

SEQ ID NO: 63589 - protein, 137 aa, Zea mays
  misc_feature: Ceres CLONE 1531775
  misc_feature (99)..(99): Xaa is any aa, unknown, or other
MATAEVQTPTVVAAEEAPVVETPPPAVVPEESAPAEAEAEAEAAAPADPEELPAAEQQAAAEAEAAAPAGAEEPVAAEPAAEAEAAAPAGPRETPAVEXEAAAEEEAAAAPPAGAEEPAAAEPVAEAEAAAPEELAA

SEQ ID NO: 63590 - DNA, 663 bp, Zea mays
  misc_feature: Ceres CLONE 1531781
  misc_feature: Encodes the peptide sequence at SEQ ID NO. 63591
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (324)..(324): n is a, c, t, g, unknown, or other
  misc_feature (409)..(409): n is a, c, t, g, unknown, or other
nggtttcnnnnngcattagtggagctccccgcggtggcggccgctctagaactagtggatcccccgggctgcaggaattcgtctcacccctagaaaaacccgtccccgtcggcccgggttccctactctccgcgcagctgcggcggcggcgatcgccgcggagccgcaatcgaacgagcagcagaatgtcattatggaaactgaggtgtttgcctgccctgtctgctacgagccattgatgagaaaagggccaccaggcataaacttgccagcaatttataggtcgggattcaagtgttcaaagtgcaacaagtcatttaccancaaagacttcttcctggacctcactgtaactgcagggacaaaagattttttctcccccccccccgctaggggggggggggttctngtatccccttttctcatttctttatgaaagaggggggcgacaaaacctttatcggagggggttccctggccttgacaaaaaatttctaatggctccagacttttttcaaccccttgctggtgggaacctttcttgatgtccgctgaggcaggggccttgttttactaggaaatttgcaaagtccgggaacctacctccacctgtggtcgcctttggtactccctcctgagaaataggcctccccccaatgtctt

SEQ ID NO: 63591 - protein, 80 aa, Zea mays
  misc_feature: Ceres CLONE 1531781
  misc_feature (44)..(44): Xaa is any aa, unknown, or other
METEVFACPVCYEPLMRKGPPGINLPAIYRSGFKCSKCNKSFTXKDFFLDLTVTAGTKDFFSPPPARGGGVLVSPFLISL

SEQ ID NO: 63592 - DNA, 638 bp, Zea mays
  misc_feature: Ceres CLONE 1531788
  misc_feature: Encodes the peptide sequence at SEQ ID NO. 63593
  misc_feature (638)..(638): n is a, c, t, g, unknown, or other
ctggagctccccgcggtggcggccgctctagaactagtggatcccccgggctgcaggaattcgtctcacccctagaaaaaatgctccgcccgccgccgtgcccgccctgccctccaccttctcacggcgcaataaacaacctcaagacgaggcgaggcggcgcccgcggacggcagcattgccgaaatttccgtgattctagccctcgtgacctgcgctgcgtatacttggaccggccggtcgtggttccgtacagttccttctctgttggagtactcggcggcgatgggatatcctcgcgctcttcaccagggaggcgggcgccttcgggttcgggtccgcctcctcggaccaccatgtcacctacggcgacgacgcccgccgcctcaccgtcgctttcacaggaagatctagtgtcattggcctggacacatcaggagccttcgccctgacaggagcccacgtgctcctcgctgctagacaaccagacgctgcgtcagagacttgaatgaccatcctggagaggacccccacggcacgtattgatgatctgatactagacctcaactccctcagatctgtaccggctttttgcggaccgatttcaactcggtgaaactaccctctagacaccctgn

SEQ ID NO: 63593 - protein, 35 aa, Zea mays
  misc_feature: Ceres CLONE 1531788
MTILERTPTARIDDLILDLNSLRSVPAFCGPISTR

SEQ ID NO: 63594 - DNA, 661 bp, Zea mays
  misc_feature: Ceres CLONE 1531795
  misc_feature: Encodes the peptide sequence at SEQ ID NO. 63595
tccccgcggtggcggccgctctagaactagtggatcccccgggctgcaggaattcgtctcacccctagaaaaaatccttcccattccccgttcccaacccaccgtaaaccctagctgcgagctatggcccgcaagcgccaggcgccgccgccgccgccgccgccgccgcaggaggaggaggagtcatcctccgaggaatctggctccgaagaggaggaggagtctcctcgcctcctcgagctccgaaggccctcgcaggccgcggccaacaacgccgactcgtcggacgcggactcggattccgacgccgacgtccaagccttccagatgcgccaggtgccccgcttccccaccaagcagacgcacccagtctctcacccagaatccggtgccgaagaggaggagggcgagtcgtcagagtcggagcacgagaacccggtgcctgtggttcagaagaaggccgtggcggcggcagggatgtccaagacagggcaggagaggaagaggcccgcctcgtatcctgctccaagcgggaaggcaaaaaagaccaaggctgaggctacccctcctgctaaggcgaagaagggagagaagctggcgcctgatgcgactcctgcaggataggcaaagaagggcaagaccgagctagagaaactggcgc

SEQ ID NO: 63595 - protein, 166 aa, Zea mays
  misc_feature: Ceres CLONE 1531795
MARKRQAPPPPPPPPQEEEESSSEESGSEEEEESPRLLELRRPSQAAANNADSSDADSDSDADVQAFQMRQVPRFPTKQTHPVSHPESGAEEEEGESSESEHENPVPVVQKKAVAAAGMSKTGQERKRPASYPAPSGKAKKTKAEATPPAKAKKGEKLAPDATPAG

SEQ ID NO: 63596 - DNA, 662 bp, Zea mays
  misc_feature: Ceres CLONE 1531796
  misc_feature: Encodes the peptide sequence at SEQ ID NO. 63597
tggcggccgctctatcactagtggatcccccgggctgcaggaattcgtctcacccctagaaaaagaggcgagggaaaacaagtgagtgagaaagagagagagaggagggaaaatgctgcgccacgccgcccgccgcctcgtttcccgcgccgtcgctccgcccaccgcgcgccgggcgctcgccacggcggaggtgcccgcggaggccgtcgaggactccacgttcgtcgaggcctggaaaaaggtcgcccccaacatcgagcccccagcgacgcccctctccctcatgcagccgcgcccgcccacgccagctaccatccctaccaagctcaccgtcaacttcttcctcccctacaaggccgagagcgcccacaaggaggttgacatggtaattccaccagctacaactggtccaaagggtgttttgccaggccatgttgcccccattgcaaaactcaagcccggtgttctcctcagacatggaagaaaccattgtgaccaattactttttgagcagaggagtttgctttcgtccctgccaaatcccattggctgaaaagtgagggttgtctgaaggttatccctggtgaaccaataacttaacccccgtcattggttttcgaaaaggggtctccagaggaaaatccacgggcccgagaccc

SEQ ID NO: 63597 - protein, 147 aa, Zea mays
  misc_feature: Ceres CLONE 1531796
  misc_feature: SWISSPROT Homolog: EC 3.6.3.14 H(+)-transporting two-sector ATPase
MLRHAARRLVSRAVAPPTARRALATAEVPAEAVEDSTFVEAWKKVAPNIEPPATPLSLMQPRPPTPATIPTKLTVNFFLPYKAESAHKEVDMVIPPATTGPKGVLPGHVAPIAKLKPGVLLRHGRNHCDQLLFEQRSLLSSLPNPIG

SEQ ID NO: 63598 - DNA, 1397 bp, Zea mays
  misc_feature: Ceres CLONE 1531800
  misc_feature: Encodes the peptide sequence at SEQ ID NO. 63599
aatcgcatccactactggagccaaagccagcttgatcggtgacgatttattagctagccgtcgtctgatagctcaattggttagctgattaacgtggtgcagaagaagaagttgagctagctagcgatggtggtttcaatattgactcacccgttcatggctgcggcggcgtgcgtcgccgtcgcgttggctctgttggccacgaccagcagcgcgcagctggacccgcacttctacgacaaggcgtgcccggcggcgctccccaccatcaagaggctcgtggaggaggctgtggccgcggagccccgcatgggcgcgtcgctgctgcggctgcacttccacgactgcttcgtcaacgggtgcgacgggtccatcctgctggacgacacgcccttcttcaccggcgagacgatggccgcgccgaacgccaactccgtccgcggcttcgacgtgatcgaccgcattaagggcgccgtcaacgccgcctgcaggggcaacgtggtctcctgcgccgacgtcgtcgccatcgcggcacgcgactccgtcgtcgcgctgggagggccgtcgtacgacgtgccgctgggccgccgggacgcgcggacggcgagccaggcggcggcgaacagcagcatcccggcgccgaccttcggcatcgaccgcctggcctccaacttcgcgtcgcacggcctctccctgcaggacctcgtcgcgctctcgggagcgcacacgctggggttctcccgctgcaccaacttccgagaccgcctctacaacgagaccgccaccctggacggctccctcgccgcctcgctccgggccgcgtgccctcgggccgccggcaccggcgacgacagcctcgcgccgctcgaccccacgcccgcgcggttcgacgccgcctacttcgcctcgctgctgcggaaccggggagtgctgcactcggaccagcagctgttcgccggcggccccggcgtcgcggacgccctcgtgaggttgtacgccgccgacaccgacgccttcaggagggacttcgcggacgccatggtgaggatgggcagcctcagcccgctcaccgggagcaacggcgagattcgctacaactgccggaaggtgaactactcttgagtgaatttggttcacatctgatgcaggaaggtctagaaccatgtcagcgtgctgtggaatccacagctgttcttgcgctcgtgtcaaacaaacatagtgttcttgttatttgagttaagttttctacatttatgttgttttgtcaccggtaaagaagagctttattacggctgtttcttattttgctgtattctttcgtttatttaatttgattggcagtttgtgaggtttgcaaggtaaaaaaaaaaaaaaaaaaaaaaaaaaaaaaaaaaaaa

SEQ ID NO: 63599 - protein, 331 aa, Zea mays
  misc_feature: Ceres CLONE 1531800
  misc_feature (48)..(293): Pfam Name: peroxidase Pfam Description: Peroxidase
  misc_feature: SWISSPROT Homolog: EC 1.11.1.7 Peroxidase
MVVSILTHPFMAAAACVAVALALLATTSSAQLDPHFYDKACPAALPTIKRLVEEAVAAEPRMGASLLRLHFHDCFVNGCDGSILLDDTPFFTGETMAAPNANSVRGFDVIDRIKGAVNAACRGNVVSCADVVAIAARDSVVALGGPSYDVPLGRRDARTASQAAANSSIPAPTFGIDRLASNFASHGLSLQDLVALSGAHTLGFSRCTNFRDRLYNETATLDGSLAASLRAACPRAAGTGDDSLAPLDPTPARFDAAYFASLLRNRGVLHSDQQLFAGGPGVADALVRLYAADTDAFRRDFADAMVRMGSLSPLTGSNGEIRYNCRKVNYS

SEQ ID NO: 63600 - DNA, 604 bp, Zea mays
  misc_feature: Ceres CLONE 1531801
  misc_feature: Encodes the peptide sequence at SEQ ID NO. 63601
  misc_feature (582)..(582): n is a, c, t, g, unknown, or other
tccgcggtggcggccgctctagaactagtggatcccccgggctgcaggaattcgtctcacccctagaaaaaatcgggagctcactcgctggtcgttgcctgctgcggattgcccccaagcggccccactcactccgctgttgatatttcgtttggttctcctttccgtcttgtccgtcgccgtaggccttcttcccctcgctccccagctccagcaggcagatcagatccttcctaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcactggtgggacctcttcaccaccaccgtctggttccgcgaccactggtcccgcgagcacgcccacctggacgagatagccgaccagctcgtgttggtcgccctccttgcctacgatgaggatgaggacctcttctacggcgagcaggcccccgccgccgccgcccttaagacagattcggtgctcaaggcgctgaacttgggttccncgaagagcggcgacgccccgcg

SEQ ID NO: 63601 - protein, 106 aa, Zea mays
  misc_feature: Ceres CLONE 1531801
  misc_feature (100)..(100): Xaa is any aa, unknown, or other
MSAVAVSSSLNPNAPLFIPAALLQVEDFSPHWWDLFTTTVWFRDHWSREHAHLDEIADQLVLVALLAYDEDEDLFYGEQAPAAAALKTDSVLKALNLGSXKSGDAP

SEQ ID NO: 63602 - DNA, 651 bp, Zea mays
  misc_feature: Ceres CLONE 1531803
  misc_feature: Encodes the peptide sequence at SEQ ID NO. 63603
  misc_feature (369)..(369): n is a, c, t, g, unknown, or other
ggcggccgctctagaactagtggatcccccgggctgcaggaattcgtctcacccctagaaaaaaactctcgtttcgccggagtatttagcttgcttcagggagcacgtggcggtggaagcttccctaggggtggcggaggcggtggtggtgcttggttgatgtcgatggcgcaggtctgctgtgactcggccgtagcggcgacggcggcaccggtggttggtgcggaggcggaggccagggccagggcgcgcgccgagaggcggagccgggccggagagtctggggcgtggaagcacgcggtggccgctggcacggccgatgctacgaggaatcgtattctccgcgcaggggagctgcggggggcgcgnaaacacggggcggcgtccgtgcccggccgcacgagggagatggaggatgccgtgtccgtgcgcgacgcgttctgcgccgggggcacggccgacggcgggaggcgggacttctaccgagggttccaccgccacggctgctcccacgtggcccaggcatgccgggaccggatgcacgacctggtcccccaaggagcttcgccgccacccccgccaagaagcttctaacttccccggcgggcggccttggaactgagacagatgtaaaaccatccttttcgcgcg

SEQ ID NO: 63603 - protein, 144 aa, Zea mays
  misc_feature: Ceres CLONE 1531803
  misc_feature: SWISSPROT Homolog: EC 3.1.3.16 Phosphoprotein phosphatase
MSMAQVCCDSAVAATAAPVVGAEAEARARARAERRSRAGESGAWKHAVAAGTADATRNRILRAGELRGARKHGAASVPGRTREMEDAVSVRDAFCAGGTADGGRRDFYRGFHRHGCSHVAQACRDRMHDLVPQGASPPPPPRSF

SEQ ID NO: 63604 - DNA, 821 bp, Zea mays
  misc_feature: Ceres CLONE 1531805
  misc_feature (14)..(14): n is a, c, t, g, unknown, or other
  misc_feature (15)..(15): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
tttttttccccccnntcccctccccatttattttnnnagccgcnnnnnncccacctggagctccccgcggtggcggccgctctagaactagtggatcccccgggctgcaggaattcgtctcacccctagaaaataccttctctatctccacccccaactccccaagagccgatcagaccatttgtaccgacccccgagaggcgaccaggcagtccggaagcgcgtccgtccgttggtgctgctggtgccttgtggtcgagcgatgtcgaacgccgccgacgtggaggcgggcgcccaggcgagggcggcgccggcgacgacggggatcaagccgcccccgggggggtacaacaacatgaccagcaacgggccgtacacgccaccgtcgccgatctactacgaccccgtgtcggcccaccgggggggggggggggggcgtgcctggtgctcgctgggtggtcatccaccaacgtgcctcatgttccgtgtctggccatggttcgtacaacaaactgcccccccccaacgggctgggggactgcctttcggccccccgcccttcccttctgggcgcctttctccctttgccatccccctcacgggaggaaacaccccttccgtccggggcccatttggttggctcacccccggccatatcgataccggtcctcccctccctcctggtttttcctgcgctcctcggccccgagggaaaacaagaaatatgcattccagtcttcgaaagttctttggcacccccactcttgacaaccacccgggaccccgcctcccaccccccgttcctaccacctttccggcta

SEQ ID NO: 63605 - DNA, 651 bp, Zea mays
  misc_feature: Ceres CLONE 1531809
  misc_feature: Encodes the peptide sequence at SEQ ID NO. 63606
atagctggagctccccgcggtggcggccgctctagaactagtggatcccccgggctgcaggaattcgtctcacccctagaaaaaaaaccacccacccgcccgaacccaatggcgtccaacctcctctccgccccgtcccgaaccctagctccgtcgccggcgccggcccccgcgggcctccgcgggcgtgtgccggtgcaagcgcgcctcccgcgcggcgggctcggcctcgccccccgccggagcagacgcgcgctccgcgtgcgcgcgtcggtggcaatcgattaggacacgccggagagcgagccgccccccacgttcctccgcgaggacaggcacgagcccgagatccctgcgtcctcgtccccaccccttgggggggggggggggcggccatctctcccccttctccaaggcaacccactgagatgctccccaccatccgctggaactgcgcctcttcccaccccgaggcgtgggcatccttctgggatctgcccgcacgccccctattcctttgatgcctacttgacctgccaaccccgttcgcgggtttggccccactgcccctgcaaaccgcttcaatgatattgccttgcgtatattttcccgtgtcgggccggtccagcttcgccctctcctccctttctt

SEQ ID NO: 63606 - protein, 59 aa, Zea mays
  misc_feature: Ceres CLONE 1531809
MASNLLSAPSRTLAPSPAPAPAGLRGRVPVQARLPRGGLGLAPRRSRRALRVRASVAID

SEQ ID NO: 63607 - DNA, 671 bp, Zea mays
  misc_feature: Ceres CLONE 1531812
  misc_feature: Encodes the peptide sequence at SEQ ID NO. 63608
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (401)..(401): n is a, c, t, g, unknown, or other
  misc_feature (402)..(402): n is a, c, t, g, unknown, or other
  misc_feature (415)..(415): n is a, c, t, g, unknown, or other
  misc_feature (422)..(422): n is a, c, t, g, unknown, or other
aacgctggagctccccgcggtggcggccgctctatttctccctcgcatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcacgtgtggccggcctacggcaacaaaaagttcgagacgctgtcgtacctgccgccgctgtcgacggactattttctcccccccgtggaggagggagcaggggaannnntnnataccctgccccnatttcanaaaggacagaattcaagaacccccaagaactccgccgtcccgtgctactacgaaggccgctactggaccatgtggaaactgcccctgttcggctgcaacaaccccccccagttgtacaaggatcctgctgaagcctccaatcctacccggaaccccttcaccgccttcatccgcttctaaaaaattaaagatacccctggcggcggcccttcccccccacagaccccggggcaggatctaaaacgcccc

SEQ ID NO: 63608 - protein, 151 aa, Zea mays
  misc_feature: Ceres CLONE 1531812
  misc_feature (58)..(144): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
  misc_feature (84)..(84): Xaa is any aa, unknown, or other
  misc_feature (85)..(85): Xaa is any aa, unknown, or other
  misc_feature (86)..(86): Xaa is any aa, unknown, or other
  misc_feature (90)..(90): Xaa is any aa, unknown, or other
  misc_feature (92)..(92): Xaa is any aa, unknown, or other
MAPTVMMASSATAVAPFQGLKSTASLPVARRSSRSLGNVSNGGRIRCMHVWPAYGNKKFETLSYLPPLSTDYFLPPVEEGAGEXXXTLPXFXKGQNSRTPKNSAVPCYYEGRYWTMWKLPLFGCNNPPQLYKDPAEASNPTRNPFTAFIRF

SEQ ID NO: 63609 - DNA, 770 bp, Zea mays
  misc_feature: Ceres CLONE 1531816
  misc_feature: Encodes the peptide sequence at SEQ ID NO. 63610
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (420)..(420): n is a, c, t, g, unknown, or other
  misc_feature (770)..(770): n is a, c, t, g, unknown, or other
ttgtgtccctnnnnannncnnnnnnnnnnnnnnnnnnnggttcttttnnnnngattgctggagctccccgcggtggcggccgctctagaactagtggatcccccgggctgcaggaattcctctcacccctagaaaaatcacaaaccgttatcgtcgccatggcagccgccgcgcctgcaagctccgtgaaggaagtgctgccatctcccctgacctccgcctgcgagccccctcccctcttcgatggcaccactaggctgtacgttgcctatcattgcccgtatccccacggcgcttgcattgccacgaactacaagcggtcgccgcacatgatttttatgcgccgccgccgactgtgctgaccggcccccgtggcttaaaggagaacgattatccggagagaaagggggtttttcttcntcatctccacgggggggggggggccccttttacactttcccactgccccccccacggagctttacaacgcccctcttaatctcgagaggggcccgatcccaacacttcagcctgccgggagcagccgccgaggagggcgtcctgctgtaacctgcgccttgtaccatcgagcggcggacttcggcgcgcggactgcctccaccgggaccttccgtgcgcctccttcctacgacctgcaggcctccccccctgcgcacacccgtggccggacgcccacgggaccctggggggcggggcgttgccccagccctcccacggccagtttgcatatgtctgtccaagcctttgtn

SEQ ID NO: 63610 - protein, 67 aa, Zea mays
  misc_feature: Ceres CLONE 1531816
MAAAAPASSVKEVLPSPLTSACEPPPLFDGTTRLYVAYHCPYPHGACIATNYKRSPHMIFMRRRRLC

SEQ ID NO: 63611 - DNA, 685 bp, Zea mays
  misc_feature: Ceres CLONE 1531818
  misc_feature: Encodes the peptide sequence at SEQ ID NO. 63612
tagctggagctccccgcggtggcggccgctctagaactagtggatcccccgggctgcaggaattcgtctcacccctagaaaaagtgctgtgtctgtctgtctgtcgctctcgctctcagacgactgggccgccgccgcttggtgctgaggctttggttggtctcttcggcggcgacgagcacccaccagcagttctgtagaaatggctgatggtgaggacatccagcctcttgtctgcgacaatggcaccggaatggtcaaggctggttttgctggcgacgatgcaccaagggcggtttttcctagcattgttggccgtcctcgccacactggtgtcatggtagggatgggacagaaggatgcatatgttggcgatgaggcacagtccaagaaaggtattctcacgctcaagtacccgattgagcacggtattgtgagcaactgggatgacatggagaaaatatggcatcatactttctacaacgagcttcgtgttggcccagaggagcaccctgtgttgctcactgaggctcccttggaacccaaaggccaacaggggaaaaaatgaacccaaattaggtttgagaactttcaaggttcctggcccgggtaagttgccaatcccagaccatggctccccccttccatggcaaaggggggcgtactaactgggaattggttccct

SEQ ID NO: 63612 - protein, 121 aa, Zea mays
  misc_feature: Ceres CLONE 1531818
  misc_feature (4)..(121): Pfam Name: Actin Pfam Description: Actin
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMVGMGQKDAYVGDEAQSKKGILTLKYPIEHGIVSNWDDMEKIWHHTFYNELRVGPEEHPVLLTEAPLEPKGQQGKK

SEQ ID NO: 63613 - DNA, 644 bp, Zea mays
  misc_feature: Ceres CLONE 1531819
  misc_feature: Encodes the peptide sequence at SEQ ID NO. 63614
  misc_feature (395)..(395): n is a, c, t, g, unknown, or other
  misc_feature (396)..(396): n is a, c, t, g, unknown, or other
tatgtggagctccccgcggtggcggccgctctagaactagtggatcccccgggctgcaggaattcgtctcacccctagaaaaaatccagccgagaggtcgtgtgcgcgtggatctctgcgtggaagcgatgaagattacggcgctcctggtgctgaagccgtcgacctctggagccgggagctcctcgtccggcggcgagtcgggcccggaggcggtggtgctcgcgaacgcgatagacgtcagccacttcggctacttccagcgcagcgccgcccgcgagttcatcgtcttcgttgcccgcaccgtcgctcagcgcacccagccaggccagcggcagtccgtccagcacgaagaatactacgtccactcccgggggagggaggggctttgtgcnnttgcattcatggatgatcattatccggtacggagtgccttttctcttctgaatcagggtcttgatgaatcccaaaaggcttatggggaactccgggaaacctgtgactgccaatgaaactccaccggggggttttcctgaacgaaccccttgacaaaattttcggaatccgcgggaaagctgacaaattattggaaagttccgaagggtcctgggaatgaacctaacatttttccctcccttcacact

SEQ ID NO: 63614 - protein, 127 aa, Zea mays
  misc_feature: Ceres CLONE 1531819
  misc_feature (90)..(90): Xaa is any aa, unknown, or other
MKITALLVLKPSTSGAGSSSSGGESGPEAVVLANAIDVSHFGYFQRSAAREFIVFVARTVAQRTQPGQRQSVQHEEYYVHSRGREGLCAXAFMDDHYPVRSAFSLLNQGLDESQKAYGELRETCDCQ

SEQ ID NO: 63615 - DNA, 757 bp, Zea mays
  misc_feature: Ceres CLONE 1531820
  misc_feature: Encodes the peptide sequence at SEQ ID NO. 63616
  misc_feature (514)..(514): n is a, c, t, g, unknown, or other
ccccgcggtggcggccgctctagaactagtggatcccccgggctgcaggaattcgtctcacccctagaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccttgacccggaggggatgcgctcctgaccagcagcggtcttatcttcgccgggaagcagctttgaggacgggatgtttttttcgcccccccccggggggggggggggggggctttcccttccaccttttttaccgccccctttatggggaaggaatagaataaatcctttgtcctacgacctttgggcgggggggaggacccctgctcccctttgttgggagtgtaattcctcccgaagcccactgntgttttattgctctctggctagaccaacccctcggaacactatgtatgtgtctcccgccttctgtccctgactcgcctgcctaactccttactgcgcgggaagcggaatattgtgagatcattctataaccttccgctccgctgtactcgactacggtctagttgggatgtttacgcaagcgcatgagtgccgggggggatctagcctgcactcggtagctgagctgagtcgtagtcgatgtg

SEQ ID NO: 63616 - protein, 38 aa, Zea mays
  misc_feature: Ceres CLONE 1531820
MQIFVKTLTGKTITLEVESSDTIDNVKAKILDPEGMRS

SEQ ID NO: 63617 - DNA, 675 bp, Zea mays
  misc_feature: Ceres CLONE 1531823
  misc_feature: Encodes the peptide sequence at SEQ ID NO. 63618
  misc_feature (675)..(675): n is a, c, t, g, unknown, or other
aatctggagctccccgcggtggcggccgctctagaactagtggatcccccgggctgcaggaattcgtctcacccctagaaaaaacgccacacaccaccaccggacgctagctcaccaccaacctcagcacatcgaggagaagaggagtggccaatggcttcgtcggtggccgccgcggcgagcacattcctgggcacccgcctggcggacccggtgccgcagaacgggcgcatcgtggcccggttcgggttcggcggcggaaagcccaaggctgccgtcccgaagaaggtggcgaagacgtcgatctcctctgaccggccgctgtggttccccggcgccgtggcgcccgactacctctactgctcgcccgtcggggagggggggggcgacccgttcgggctcgggatacccgtggagtacctgcagttcgaactggactcgctggaccagaacctggccaataacgaggccggcggcctcttcggcacccggtttcgagtcctccgacgtcaagtccaccccgcctccagcccctacagcggaggtgttccggcctccagccgggttcccgccgagtggcaagctcattccctcggcccaatgggcccatggcctcccccacctctctgggggccctcctacacgtctaaggggggcccctcccggcctttcccn

SEQ ID NO: 63618 - protein, 174 aa, Zea mays
  misc_feature: Ceres CLONE 1531823
MASSVAAAASTFLGTRLADPVPQNGRIVARFGFGGGKPKAAVPKKVAKTSISSDRPLWFPGAVAPDYLYCSPVGEGGGDPFGLGIPVEYLQFELDSLDQNLANNEAGGLFGTRFRVLRRQVHPASSPYSGGVPASSRVPAEWQAHSLGPMGPWPPPPLWGPSYTSKGGPSRPFP

SEQ ID NO: 63619 - DNA, 641 bp, Zea mays
  misc_feature: Ceres CLONE 1531826
  misc_feature: Encodes the peptide sequence at SEQ ID NO. 63620
tccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgagtacggctgggacaccgcggggctgtcggcggacccggagacgttcgccaagaaccgggagctggaggtgatccactcccgctgggccatgctgggcgcgctcggctgcgtctttcccgagctgctcgccccgaacggcgtcaagttcgggcgaggccgtgtggttcaaggcccgcttccaaatcttcagcgagggcgggctggactacctcggggaacccgaccctcttccacgcggaaaagcatccttgctatctgggcctggccagtg

SEQ ID NO: 63620 - protein, 167 aa, Zea mays
  misc_feature: Ceres CLONE 1531826
  misc_feature (65)..(167): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGEYGWDTAGLSADPETFAKNRELEVIHSRWAMLGALGCVFPELLAPNGVKFGRGRVVQGPLPNLQRGRAGLPRGTRPSSTRKSILAIWAWPV

SEQ ID NO: 63621 - DNA, 625 bp, Zea mays
  misc_feature: Ceres CLONE 1531829
  misc_feature: Encodes the peptide sequence at SEQ ID NO. 63622
  misc_feature (625)..(625): n is a, c, t, g, unknown, or other
ggagctccccgcggtggcggccgctctagaactagtggatcccccgggctgcaggaattcgtctcacccctagaaaaaagaaacctcgtctcctccctcttctgtcttctcccgctcaccgcccaccgcccgacctgtgctgccgcccatggcgagacgccttctctcccgcggccgcctcattaagctcgaccggcccatcctacccgccgctctcacccgtctgctttcgcgcggcccgcccactccgacgactagcgaaccggaggacaagggcaaaaaagcggcggctgtcctagtggaggcggtcgccacgaaccacaaaaaggacgcggaggtcgggagagatggatccgaggaggacgacgaggatacgagcccgccctggaggagctggaggccggacgtcgcgtggctctccaaggcactcgagcccgcactggacctgtacaagcaatacagctggtagcctttcgcgtcttctggtcgtgtggaaaacatccctgcaagcactcgtacatttagtgagatcctaagcgacctccagagaagtaagataggcctaaaggactggagcctcagtgatctcaccattggcctctacctcatttacctcagccaagcn

SEQ ID NO: 63622 - protein, 106 aa, Zea mays
  misc_feature: Ceres CLONE 1531829
MARRLLSRGRLIKLDRPILPAALTRLLSRGPPTPTTSEPEDKGKKAAAVLVEAVATNHKKDAEVGRDGSEEDDEDTSPPWRSWRPDVAWLSKALEPALDLYKQYSW

SEQ ID NO: 63623 - DNA, 646 bp, Zea mays
  misc_feature: Ceres CLONE 1531830
  misc_feature: Encodes the peptide sequence at SEQ ID NO. 63624
  misc_feature (405)..(405): n is a, c, t, g, unknown, or other
  misc_feature (458)..(458): n is a, c, t, g, unknown, or other
  misc_feature (646)..(646): n is a, c, t, g, unknown, or other
aaaagctggagctccccgcggtggcggccgctctagaactagtggatcccccgggctgcaggaattcgtctcacccctagaaaaagtcgctgcgtagtgtagtgtcatcttatctcttcctcctaccttcactctcaaaatcttcagggagtcgtagaggagcagcaggtgcaccaaaaggatggcagcgccaggctccctgcgacttctccaggccccgtccttcgctgcggccaagtgccagccggtgggtggccgggcatccgcgcggcgagcgccacggccactgttcgccgtgcgcgcctcggctgctgacgccgccaacagggatgccgtgctcaaggccttccgcgagaacagggctctcaagataatttccggtcttcagaactttgacaggagcantgttgcatctgttgtcacagctgcagataagggaggtgcaacacatgttgacntagcatgtgacaaggacttagtaaagcttgccatggatcttaccaaccttccgatctgggtctcatctgtagatccttcagcgttccattctgcagtacaagcaagaactaaaatggttggaaatgaaaacatgattctttttatgaaatgggcattgaatttctcctctgaacagatactagagccn

SEQ ID NO: 63624 - protein, 155 aa, Zea mays
  misc_feature: Ceres CLONE 1531830
  misc_feature (75)..(75): Xaa is any aa, unknown, or other
  misc_feature (93)..(93): Xaa is any aa, unknown, or other
MAAPGSLRLLQAPSFAAAKCQPVGGRASARRAPRPLFAVRASAADAANRDAVLKAFRENRALKIISGLQNFDRSXVASVVTAADKGGATHVDXACDKDLVKLAMDLTNLPIWVSSVDPSAFHSAVQARTKMVGNENMILFMKWALNFSSEQILEP

SEQ ID NO: 63625 - DNA, 846 bp, Zea mays
  misc_feature: Ceres CLONE 1531837
  misc_feature: Encodes the peptide sequence at SEQ ID NO. 63626
  misc_feature (12)..(12): n is a, c, t, g, unknown, or other
  misc_feature (13)..(13): n is a, c, t, g, unknown, or other
  misc_feature (27)..(27): n is a, c, t, g, unknown, or other
  misc_feature (39)..(39): n is a, c, t, g, unknown, or other
  misc_feature (40)..(40): n is a, c, t, g, unknown, or other
tttttttttctnnttttctcccgcgtncccccccaaggnngggcccccaggagaaagctggcactccccgcggtggcggccgctctagactagtggatcccccgggctgcaggaattcgtctcacccctagaaaaagcaccggagggcggtccgatacaagcaacggcaacgcctcccctctcctccacctccccacctatattgattctgattcatccacccagcaggcagcagctacagcaagatggtgcacccgatcgcggaggccgacgagcggagccccttcggccgcctgacgccggacgagttctacgcgcgccacggcgtgacccactccgcctcgtccttcgtcaacccgcgggggctccgcctcttcccccaccgcttgggtgcccagtgggggacagcccttgtcctgggcccccgtcgagcgggggtgatcggttttcacctggaaaattccacacagcgacaacccaagcttcaccggccgctcacaccctcgaccgagcacggggccttcgcccgctccacctgcgctgtcgtccctaacatgcggcctacgccgcattcccccgtagggcctttcctatggtacctcccctccccccaaacagttcgatgccaccggtgagttaggtatgtaacaaggcggaatagcccgactccttcacacgtccccttttccgtcaccccaaatataataaatgtgcccgccagcgaaccaccagaaattaaaccacgcaaagagccaaaaaataactctgttaaacagtaatctttaataccatactatactaagttcatcaatactattctcgctataaccagctacacccccactg

SEQ ID NO: 63626 - protein, 129 aa, Zea mays
  misc_feature: Ceres CLONE 1531837
MVHPIAEADERSPFGRLTPDEFYARHGVTHSASSFVNPRGLRLFPHRLGAQWGTALVLGPRRAGVIGFHLENSTQRQPKLHRPLTPSTEHGAFARSTCAVVPNMRPTPHSPVGPFLWYLPSPQTVRCHR

SEQ ID NO: 63627 - DNA, 671 bp, Zea mays
  misc_feature: Ceres CLONE 1531841
  misc_feature: Encodes the peptide sequence at SEQ ID NO. 63628
  misc_feature (420)..(420): n is a, c, t, g, unknown, or other
tggcggccgctctagaactagtggatcccccgggctgcaggaattcgtctcacccctagaaaaatccgttcgggcatccgagcattaagaacccgcacagggacatggacgacgcccccaaccaacaggagcccatcgaggacgcgagggagaggaatacccaggaacctgcgcaaggtcaaggcctcgccctctcactctgcaacagcagcgacagcggcttgtctgcaatgttgcctatgtcgaaccctttagctaatcccacacagcttacagttttccttccgggatcaatatgttgatctcacaccgcgcacccgtaaaaggctcaagggatctttttaccccctccacgtggggggaggggggaggaaccaaagctgccactgcttcttacccccctctgcaacatcaacgcanttttccccggggggggggctattccccagtgcttcgaggagttccttcagcgtaaaatactttcggaagccgaaggtctaggaatagggtggttggagaccctacgttcaataacccattgtttgggggtttaattttccccctcgccgtgaaagggactcttccccagccctcccccctcaacacacaactcgcgggaaatggcgcctgtgggaaactaaacacttccgaaaaatcttctctagcactag

SEQ ID NO: 63628 - protein, 65 aa, Zea mays
  misc_feature: Ceres CLONE 1531841
MDDAPNQQEPIEDARERNTQEPAQGQGLALSLCNSSDSGLSAMLPMSNPLANPTQLTVFLPGSIC

SEQ ID NO: 63629 - DNA, 656 bp, Zea mays
  misc_feature: Ceres CLONE 1531847
  misc_feature: Encodes the peptide sequence at SEQ ID NO. 63630
aaagctggagctccccgcggtggcggccgctctataactagtggatcccccgggctgcaggaattcgtctcacccctagaaaaagcacttctccccgattttccattcgaactcgcatcatggcgttccctcagatctcccgcagagccctcggcctcctgctcgtcatcgccgcagcggccgcgatcgtctcgcccgccaccgccgacgaggtggtggccctgacggaagccgacttcgagaaggaggtcggccaggaccgcggcgccctcgtcgagttctacgcgccatggtgtggccactgcaaaaagcttgcccccgagtatgaaaaacttggcgccagcttcaagaaggctaaatctgtactgatagcaaaggttgactgtgatgagcacaagagtgtatgcagcaagtatggagtttctgggtaccccacaattcaatggtttcccaaaggttccctggagccaaagaagtatgagggtcaacgttctgtggaagcccttgcagaatttgttaacagcgaagcaggtaccaatgtcaagatagctgccattccttcaagcgtcgtggttctgacttcagagacctttgactcaattgtccttgatgaaaccaaagatgtccttgttgagttttatgccccatggtgtggt

SEQ ID NO: 63630 - protein, 179 aa, Zea mays
  misc_feature: Ceres CLONE 1531847
  misc_feature (31)..(136): Pfam Name: Thioredoxin Pfam Description: Thioredoxin
  misc_feature: SWISSPROT Homolog: EC 5.3.4.1 Protein disulfide-isomerase
MAFPQISRRALGLLLVIAAAAAIVSPATADEVVALTEADFEKEVGQDRGALVEFYAPWCGHCKKLAPEYEKLGASFKKAKSVLIAKVDCDEHKSVCSKYGVSGYPTIQWFPKGSLEPKKYEGQRSVEALAEFVNSEAGTNVKIAAIPSSVVVLTSETFDSIVLDETKDVLVEFYAPWCG

SEQ ID NO: 63631 - DNA, 732 bp, Zea mays
  misc_feature: Ceres CLONE 1531848
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ggtatcgttctttgaggatttttcgctttgtcccnnnccccaaaannnncatagctggagctccccgcggtggcggccgctctatactagtgaatcccccgggctgcaggaattcgtctcaaccctagaaaaagtcttctctccgcctcgcgcacccggttccgcgtgcctttccccacctactctcacggctctcgccagccagtctagggtttcggtcccagcgtgcttatccgcccccgccgagccatgtagaagcaaggagggaaggccaagccgctgaaagcgcccaaggccgacaagaaggagtacgacgagacggatcttgcatatctgcagaagaagaaagatgaggaaaaagcactgaaggagctaaaggccaaggcacagaagggcgcgattgggggctcgggtctgaagaaaagtggaaagaaatgagactggtcacccgtctccaataccaccacgatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataattgaatccgcaatgcctgtggacccgagtggagttgaacaccaccccgtattggtcccaaccccgaaccgaatcctcgcttgctggagtcccgggcgaccg

SEQ ID NO: 63632 - DNA, 639 bp, Zea mays
  misc_feature: Ceres CLONE 1531854
  misc_feature: Encodes the peptide sequence at SEQ ID NO. 63633
aaagctggagctccccgcggtggcggccgctctataactagtggatcccccgggctgcaggaattcgtctcacccctagaaaaattccccctccggtgccgcctcccccagacacttcgccgccggcaagatgggacgcgtgattcgcgctcaacgcaagggtgcggggtccgtgttcaagtcccataatcatcacagcaagggccctgatcggttgcggtacctctacttctgcgagtgcaacaggtacctgaagggcgttgtcatcgacctcatcaagatccggtccgcgaagcctcgctgtacaaggtcaccttccgccatccatccggtacaagaacctaatgacctgttcgtgattgcttaggccatgtaaaccggccaattactttactgggaacccccccccacccctccattggcaaggccagcccgttcgggggtacccgaaaaggggccttttccccacctttaaaccccccgccgggaaaacggggtttttcccccggtcccccgggaaataacccaatattttttcgggctttacccccaaaaaaagggaaatcttgggaaaaaaacccccccccctggggggataaaaaaaaaaaagccccccaaataactaccccccgggccttg

SEQ ID NO: 63633 - protein, 78 aa, Zea mays
  misc_feature: Ceres CLONE 1531854
MGRVIRAQRKGAGSVFKSHNHHSKGPDRLRYLYFCECNRYLKGVVIDLIKIRSAKPRCTRSPSAIHPVQEPNDLFVIA

SEQ ID NO: 63634 - DNA, 645 bp, Zea mays
  misc_feature: Ceres CLONE 1531860
  misc_feature: Encodes the peptide sequence at SEQ ID NO. 63635
  misc_feature (448)..(448): n is a, c, t, g, unknown, or other
  misc_feature (645)..(645): n is a, c, t, g, unknown, or other
aaagctggagctccccgcggtggcggccgctctagaatagtggatcccccgggctgcaggaattcgtctcacccctagaaaaataaaaaaagacgggatacggatgagctaggttgttaattgccattggactgcgcgcgcgaacttcaaatccgaaagacagcaggtgccaccgcacatctctgatataactcgctatcactctctctctatctctgctctctctcaagaaaaacgggattgtgatcacgccatgaagacgatacccaggatagatctgctgaagaagatcatgatggtgcagccggacgtaaagacgatcaacatccccatgctcgcgctgcatgctgcatcacgcaacaaaaaggtggagactgacgcgaccgtgaaggacgtgctggggcttctcttatacacgcacgctgaagacgtccgatccttcattgangacacagtggtcgcgttaggtcgcgacatcatccaacacaaccagcgactacaggggccacatctgactcttatgactcgcgacctcaacgtcatcggcgatggagctgccactacagacttctacgagacatatcacctgcacctgcacctgaacgtgatgcgagtgaagcatatctgccacttgggcaaccagtn

SEQ ID NO: 63635 - protein, 130 aa, Zea mays
  misc_feature: Ceres CLONE 1531860
  misc_feature (65)..(65): Xaa is any aa, unknown, or other
MKTIPRIDLLKKIMMVQPDVKTINIPMLALHAASRNKKVETDATVKDVLGLLLYTHAEDVRSFIXDTVVALGRDIIQHNQRLQGPHLTLMTRDLNVIGDGAATTDFYETYHLHLHLNVMRVKHICHLGNQ

SEQ ID NO: 63636 - DNA, 713 bp, Zea mays
  misc_feature: Ceres CLONE 1531865
  misc_feature: Encodes the peptide sequence at SEQ ID NO. 63637
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
gtgttgggcgcggtggccttttttttgggtaanannnccccccannnnnaccaagctggagctccccgcggtggcggccgctctagaactagtggatcccccgggctgcaggaattcgtctcacccctagaaaaaaaacagacccccgcccacgaccacacgcaggcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacatatggcagcgcagtccatgctcatgtcgaccagcgtcaacggcggccgcgcgctgccgtctcttcaggccgtccggccggctccatacccgcggctaccgctgccgtcgtcgtcatcctcgtcaggctacaggcactccccctccgtctccgtgaagacgctcgccctgttcggcaaatccaaggtcaagaccgcgccggcgaagaaggctgctgcgcccaagcccaagccgaaggttgaggatggtatcttcggcacgtccggcgggatcggtttcaccaaggagaacaagctgttcgtcggccgccgtgccttgcttggctttgccgcatcgctacttggataggccattacccggtaaaggcatccttggcccacctgaacctct

SEQ ID NO: 63637 - protein, 114 aa, Zea mays
  misc_feature: Ceres CLONE 1531865
MAAQSMLMSTSVNGGRALPSLQAVRPAPYPRLPLPSSSSSSGYRHSPSVSVKTLALFGKSKVKTAPAKKAAAPKPKPKVEDGIFGTSGGIGFTKENKLFVGRRALLGFAASLLG

SEQ ID NO: 63638 - DNA, 845 bp, Zea mays
  misc_feature: Ceres CLONE 1531883
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (16)..(16): n is a, c, t, g, unknown, or other
  misc_feature (17)..(17): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ttttttnnnnttgggnntttttctttccccccnnnngggcttnnnnnnncaaactggtgctccccgcggtggcggccgctctagactagtggatcccccgggctgcaggaattcgtctcacccctagaaaaaatcccagaagagccgccctacctattccttctcccagccgtcgagctgcccaacccagagcaccagcagccctcaccttcttcctctcgggcggtccttcaaacgagcccgctcgtcttggagccgccgccggtctcgttctggacgaacgttcaaggagattgcatttgtggatgctctaatggagtcgaaaggtggctagaaaccctaggaggagcaggaggaagttccggttctatgctcccccttgggtacaaggatggaggaactttttttttttcccccccaccccggaggggggggggggggggggcttatttccctactggcctccccctccatccggtgttgaaaacaaaccctatacaaggctaacatcgccagtcaggaagcatgggttttttttaatacactaatgtataccctccctggtgggacccgtaaattcttctcccgttcggggggacggcggcgtctcatctcctttcgggcttcctgatgagcttctcctccttggtgctttggtgctatttcttctcccctttttcgccgccctttattgaaccactcctgtccgtggccaggatagactcactgacgataaggcgggcggcgcccccgatgactcaaattgtatcttagccctacccactccccgtcaatcaacccggtggagggcactgggggggagggcgcggcagagtaagcgtatg

SEQ ID NO: 63639 - DNA, 899 bp, Zea mays
  misc_feature: Ceres CLONE 1531885-R
ttgagtcctcgagcgtcgcgcgttttttttttttttttgccataattttgcggctccctattttttattattgtattaatttaccgagcgaaatagcaaaaatacacataatccctcggtacaggacaaacactctagcccaattcctgaccaacgcttgcagcaccttgaaatgggcgctccacacttacacaaggggaaaaggaactggtgaaaaattagacaccctaatccaaaaccaaaatgcaaacacagaacgaaggcctttatagtgagagattcttcttatgttccgcgatggccacacacacacaaactatagcgcgcggccaccggtacggtgcgcggtgggggaaggccagagcaccggatcacgcggccgagggcgcggtgacgtacttgaccccccccgcctccgccagggccgcgcgaagcggcttcttggccaccgcctccacctcgtcgtcgtcgttcgggcgagagcgagggcaggcccttcaagtccagcgtctcgtcgttgtagatggtcccaccacttcttcaccaaggcggtttgatgtcctccctgtccatgttcgcctcccttgcccgtgaaacttcacggcttggaccccgcccgcccgtgagtggcacgacattcaccttctccagacgggcaacttcctcggggaggccttccaaacaatggtcaagcaccaagttggtaccccgttgggggaatcgcccttttcctgatatcctcgaaaaaaactgggtcagggaaagtcctcgcccttgctaaaggggggtgggggcggggaatttacgcaagaagggcggttataaagcgcggcctattatgggatgatgacatgcctccgagtaccggcgggaatatataaaccgccccggcggttaac

SEQ ID NO: 63640 - DNA, 654 bp, Zea mays
  misc_feature: Ceres CLONE 1531885
  misc_feature: Encodes the peptide sequence at SEQ ID NO. 63641
ggagctccccgcggtggcggccgctctagaactagtggatcccccgggctgcaggaattcgtctcacccctagaaaaaaccgtccacgttccatatggcttcctgcaggatggcactcctccttggcttgctgctgctactagtagcttcgcccgcaatcgctgatgacaactccggtatctactaacaactggatcttatgtgatcagtaccatactgagaacagaccagagctgggtgctgaaagccgaccaccggcgtctcgccggcgcgcgacttctacataacgggcttcaccgtccttaacgcgaccaccgacgctgcagagactggatgcagcaacaaagttccttacaaccctaagctgattaccggcttccaatgcctgaatcagtactggagcaacatcaagtgccccaactacaacgggcagagcagctggaagaacgcctggaagaaggccggagcctgctccggcctcagcgagaaagactaattcgagactgccctctccttccgtagccggatcaacccactcgttcgcctcaaaaccaaaggtatcgagccagacttctggctctacagcctcaaggcgatcaccaaggtcttctagagcggcatctacacgacgccggtgatccagtgcagcaaggg

SEQ ID NO: 63641 - protein, 30 aa, Zea mays
  misc_feature: Ceres CLONE 1531885
MASCRMALLLGLLLLLVASPAIADDNSGIY

SEQ ID NO: 63642 - DNA, 871 bp, Zea mays
  misc_feature: Ceres CLONE 1531886
  misc_feature (44)..(44): n is a, c, t, g, unknown, or other
  misc_feature (45)..(45): n is a, c, t, g, unknown, or other
  misc_feature (50)..(50): n is a, c, t, g, unknown, or other
gggggggcccccccgggcgtgggtgttatttctcggggcgggcnnggggnaaaaatggcaatccccgcggtggcggccgctctttactaatggatcccccgggctgcatgaattcgtctcacccctagaaaaagtgctgatctttccaccgtcccatacacgcagcaggatgctctttattcccctgtgtctgcttcagcgaaagctaatcccattccagtgcccgtaccgcgccgtccctatcgtgccggatcgacacgcgctcgctgcgcccccacctctccctctcgccggttcgccacttctccccacctccccgcctcacatacaacccccaacacggcaaacactggggacaagaataacacgatccacaaaacacccacccccaccaacctcatagattagatacaaagagcataccaagcatcaaaaaactatattctccgcaacgacccaaaacaaatcagaccaggaaaaggcgacccccccccccaatgaaggccgtatcgatcctccaaacccccccaaaaacgaccctaccacgacatcctcaatctaataaaattaatactactcccctgtgtatacctctcacacatccaatatcgcagcctatgacgatgtgcggcaccacatcccaactatgcaacaaaccagtaatagccaatgcaaaacacccaacttttcgactatataaccaatcctaatcttatactgtcccataacttcgcgctgtccgcttcccagctccaatcactacattgatatatacctgtacagatactctctctccgctcctctcggctccgggtcgcgctgggcgcgactccccgcctccaccatacctccctctctatcacaccatccc

SEQ ID NO: 63643 - DNA, 676 bp, Zea mays
  misc_feature: Ceres CLONE 1531889
  misc_feature: Encodes the peptide sequence at SEQ ID NO. 63644
  misc_feature (206)..(206): n is a, c, t, g, unknown, or other
ctctcgactagtggatcccccgggctgcaggaattcctctccccctagaaaagtctcgtcgctcggtccaccacctcagctccgccgcttgcccgcttttgctctctccctcccggctctcggcttcttctacacgctaggcgggtcacagccgtaaacgcccctcccggatcccgctagttcgccaccgccgcccgcccgcccgncgtttgcctcatcatggccgcctcgtccaccgccacctccgtcctcttttcccccgaggaggagagggaacgacaaaaacgtttttcttccccacccaccaggggaaaggggcttcctcattttttttctcccccccccccggggggaaagaaaggggggttttttattatactcctcctcttccccccccccctccctaaaaaaaaaataaaacccccccctttttctaaacccgggggttttcccccggcaacacacggcagaggtggagggagcaacacccgccccccacctcagtgcgccccggccccccgagacgcggcgccccgctgtccaaagacgggagcaacccccaccactacgcctagaagatcctgcgcgaaccaatttcctcagtacaagagaacggcgtcgcctcaccccccccccttcgcagacatagagggcttctgttaattacaccacaccc

SEQ ID NO: 63644 - protein, 147 aa, Zea mays
  misc_feature: Ceres CLONE 1531889
MAASSTATSVLFSPEEERERQKRFSSPPTRGKGLPHFFSPPPPGGKKGGFFIILLLFPPPLPKKKIKPPPFSKPGGFPPATHGRGGGSNTRPPPQCAPAPRDAAPRCPKTGATPTTTPRRSCANQFPQYKRTASPHPPPFADIEGFC

SEQ ID NO: 63645 - DNA, 707 bp, Zea mays
  misc_feature: Ceres CLONE 1531890
  misc_feature: Encodes the peptide sequence at SEQ ID NO. 63646
ccccgcggtggcggccgctctagaactagtggatcccccgggctgcaggaattcgtctcacccctagaaaaactctctctcctcccaccacacccggtcgtcgttgtcgcggcgtgagcgagcgagaggggaaaacccaaaaccctagcaccccccgccccgtcgccgacggccgccggagtagagagatggcggtggacgaggtgaactcggtctacgtcggcggccttccctacgaggccaacgaggagatgcttcgcgacgccttcgggtactacggcaccatcgtctccgtcaaggtgattaatgatcttgctgtcaaaggcaagtgttatggttttgttactttttctcaccccataggtggggggggggggattgccgtcatgaaccgccataaatttacgccaccggatttgttcgagtaaatggaggggcgtgggttgagggcccccgccgattttgggccgcacaaggtttttcgtacgtatatcctatgaagggtatggtttaaaattccgtactcgtgttcctaagggaattgggtacccggcgccttctggtcgttgtttatgagaatattttttacgtggttggtgggatttgtgtaaatggcctgccttttgaacaatgtattgattgtatattgtgtattatctccctgtgtttcgcgttttaactgtacgtctactctgtatctttttgtc

SEQ ID NO: 63646 - protein, 79 aa, Zea mays
  misc_feature: Ceres CLONE 1531890
  misc_feature (9)..(77): Pfam Name: RRM_1 Pfam Description: RNA recognition motif. (a.k.a. RRM, RBD, or RNP domain)
MAVDEVNSVYVGGLPYEANEEMLRDAFGYYGTIVSVKVINDLAVKGKCYGFVTFSHPIGGGGGIAVMNRHKFTPPDLFE

SEQ ID NO: 63647 - DNA, 726 bp, Zea mays
  misc_feature: Ceres CLONE 1531895
  misc_feature: SWISSPROT Homolog: EC 3.2.1.23 Beta-galactosidase
  misc_feature (726)..(726): n is a, c, t, g, unknown, or other
aaagctggagctccccgcggtggcggccgctctagaactagtggatcccccgggctgcaggaattcgtctcacccctagaaaataacggtgagcccgcgccagcttcaactccattgcctgccttgcactagctttagctccatcattttaccgcgttttggtttggattctacttatgtttgtatgatgatgatgatgatgatgctcgtgagattgaactatgtctgtaacgactgatcccgctgctgccctgctacctcagcttaaggagcagcaacaatgctggttttgtgttttactgcattgcggtgctgttaatgatggagtaagtgctttgggtgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttagccaataggccgaaatcggcaaaatcccttataaatcacaagaatagaccgagatacggttgagtgttgttccagtttggaacaagagn

SEQ ID NO: 63648 - DNA, 891 bp, Zea mays
  misc_feature: Ceres CLONE 1531901
  misc_feature (1)..(1): n is a, c, t, g, unknown, or other
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
ntggtggtgtttcaatctgcnnccccnnnnggtcacnnnnnnaaaaactggactccccccggtggcggccgctctagaactagtggatcccccgggctgcaggaattcgtctcacccctagaaaaaaggagagcatggggaaagccttgcctattgccatcgtcgtcgggatcattgccttggctggcctgtacttctacctcaacaatgtctacagctaaacgacgaatagatccgtttggtgcggcgaacaggattcatgccgttttgcagtctttttccctttgttaatcgttgcaatgtgctgtcttggtgcatgtactactaggggctccaagactgtatacaagttttgctggtcatcttggaataccccacattacataaaaaaaaaaaaaaattctacaccctcccaggaacggggggtgggccctatttggagtctctattaccccccccccccgtgggtcgtgccgttttcccccgtctctcgactggggaaaaacccctggcggttcccccgacgttgaatgcgacggtagtcctactatccccccttttgcgacctgtcgtgcggtagaacccccaagaaaggcgcccccaccgcagtccgccctttccccgcagtggtctcccccccgcgcacgtacgggggtcaactgctcatcatgggtctggcccggtggtgctctgatgtccaagacgctccggcactaaatcgtctatgcgggaactggagccgtcattcttttctttggacacagtgggatgcagactggctcgacaggactcgtcctcgtgagtcccgatgagtccgcgtccactcggtcttgcggaccgcgcccttggctgatggcggggagcgatggcgacgctgaccgtctcgttctc

SEQ ID NO: 63649 - DNA, 895 bp, Zea mays
  misc_feature: Ceres CLONE 1531906
  misc_feature: Encodes the peptide sequence at SEQ ID NO. 63650
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (21)..(21): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
nnnnnaaacaatcttttcccnccnnnnnnnnnnnnnnnnnccagagctgtgactccccgcggtggcggccgctctagaatagtggatcccccgggctgcaggaattcgtctcacccctagaaaaaagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcttgtaccacgttcggcggaggggggcgggggcgaacgtcgaacggatacagcccccccctcacaacggaggatggactggggccccccacccgggctaccgtcctacggccgggggggaactcactggggctttgctggatcctggggcccggccaccccttcggttgaggagatccctccggccgggggggcgcgcccctctcctcggttcgaccgactgcggcagacgcgccgtcctcccggggctaagagggaaatatcatggggcgatgggcgacttcccgtggccgagtcgagctcactggatgaataatccgcgggggcggggctgcgcgccagaggtccgcacgccccgcacggggatagggcgcgaaccgaggtccggcgaggcgggagcgaagtacaccggtgggccacctccctcgccgcaacgcgaccgttgtggcagggctaggtcgtgcgagccgcaaccctcgccctatggagcagggctgg

SEQ ID NO: 63650 - protein, 229 aa, Zea mays
  misc_feature: Ceres CLONE 1531906
  misc_feature (32)..(127): Pfam Name: PsbR Pfam Description: Photosystem II 10 kDa polypeptide PsbR
MAASMISSSALAVAPQGLPPLGRRASSFAVVCSKKKIKTDKPYGIGGGLTVDVDANGRKGKGKGLYHVRRRGAGANVERIQPPPHNGGWTGAPHPGYRPTAGGELTGALLDPGARPPLRLRRSLRPGGRAPLLGSTDCGRRAVLPGLRGKYHGAMGDFPWPSRAHWMNNPRGRGCAPEVRTPRTGIGREPRSGEAGAKYTGGPPPSPQRDRCGRARSCEPQPSPYGAGL

SEQ ID NO: 63651 - DNA, 938 bp, Zea mays
  misc_feature: Ceres CLONE 1531915
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (455)..(455): n is a, c, t, g, unknown, or other
ccacttacattgttgcccccnncccnnnnnnnnnnnnnnnnnnccaaagtggggctccccgcggtggcggccgctctagaactagtggatccccccggctgcaggaattcgtctcacccctagaaaaaactattattatatccaaaactatagttgtcctggctgaattgaactcaaaagggtttgtttgagaaaaaattgtcccaagattggattgcttgttaaagctcaatattgttattgaagtgttattgctctcccaaaaaacaacccatacgtcattccaccatacgtcctttacttccagagtatatgaaaaccacaaactctgcctagccctctcgagggaacccaattcgcccctaagatgagtccttattaacgcggggttcgcttggcgcggccgatagaagtatctttttgacccgcgaaaaacccgggggggggggccgctntttaatgctgcttttgcaaatactggcccgccccccccgtctagttggggtgttaaatgacataaaaaaaggggcctgtgcgtgggttggtctcctttcccctccacttttgtcctctgcatcttcgcgactccgatactactggtcatttttcttaccaccgcttctcattagtcgttcgcacaacaatgctccacctccgcgctagtctctctcgttcacgtacgctcatcgtcacactattgacctttgctcatttaatgtggccgttgtttggctagccaacgcccgctgcacacggacttcgagatatgtttgctcgcgttaaacacgcgaggtcgtcgaatcggacgcgccccgagcgctactagacagacaggactccccggcctactacggacaatcgcgtcgctagcgccgtcccgcggtcggttccatgatcccctcgcattcatctggtctatccgtggtcctgacgttcgc

SEQ ID NO: 63652 - DNA, 806 bp, Zea mays
  misc_feature: Ceres CLONE 1531917
ttgtttgtcctccccccttttttttggtttttggaggagaccttcttccataaaagttggtactccccgcggtggcggccgctctataactagtggatcccccgggctgcaggaattcgtctcacccctagaaaaaagcttgccaattgccattgcactgcgcgcgcgcacctcacatccgccgccagcaggtgccaccgccatctctgctttctctctctctctctctctctctctctctctctctctcaagcaacgcccgcctgcccgcccgccatggcgaccatagccacgatggccctgctgaagcccgccaagatctgtggcgcggtcggcgccgccgtccaccaacggcagcctctcgctgcccgtcctcctacacgggccaagaaggccgtctgagtcccgcgtacatgttcatcagctatggcggggagcctttccatcccagagctggagtcatcagacgcggccgctggcggactcataacgttggcgagaaattacacgtccatactgccagacaacctggcagctaaccaacccccaagctaacttggcagcctccttcgaggccgagccccccaactctccagtgggagtgcctacaagcaaaattccctgtcatctaggcgacttagatcccaactacaacccgccaggtcccaatacactaacccctagtgtttactctggcccatgtgtccctccgaacctaccttcccaacctaccccgggaaatggtgaaggctctttgtcccatgaaaagtctatcccggcccgctctgtcctcacggttaggctag

SEQ ID NO: 63653 - DNA, 721 bp, Zea mays
  misc_feature: Ceres CLONE 1531919
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaagttcctattcctactacccgccccgctcttccagaagtttctggaagccaacccaagccatggacgccgccggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttgtttgctcccgctatgaaacgagacgagagaagaatgagcaaggtttttgttcgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtg

SEQ ID NO: 63654 - DNA, 827 bp, Zea mays
  misc_feature: Ceres CLONE 1531921
  misc_feature: Encodes the peptide sequence at SEQ ID NO. 63655
ctagctggagctccccgcggtggcggccgctctagaactagtggatcccccgggctgcaggaattcgtctcacccctagaaaaaaagatggggatggggactgggctggcagtgggcgcggcggcgggcgtgctcggagggctggcgctggccggcggggcgagctacctggaggacaagttcgaggagcgcgtgtcggatcgggtggaggacaacctggagagggaggagtcgtacggaggcggcggttacgggggtggctactactactatggcggcaacgactactatggcggcgacgacgactactggatgggtcctgatcctccgatcgtttgcccggctgcaacgcatgccatccgcctttcaccttcgacttgctggcccggatgtctcctgtatcaatcggcgccccccccaggaagagggaagcctgctcgttcccttcgcagtacccccgaattcccccctattgtggagttgtattacgccgggcgcccgcagggtcccagtggtttaccagggcccctggatgaggaaataacccttgcggtgtctctcaacatgtcgttctcgcgttgccggctacaatcgcccattttacgcgcggtgaggcgtctaccgctggaatgaggcgccctcctcctgtgtctgccccgtctccatactcgcttgacagaatgagttgcttggcctgttaggagtacctcttctcgccgactctctaccgtgagttctatccggcgtaccgaatatcgcctgctagtgcttagggagtgtcccctactctcctgtcttcgcctccagctctcactcagtggcaccgg

SEQ ID NO: 63655 - protein, 210 aa, Zea mays
  misc_feature: Ceres CLONE 1531921
LAGAPRGGGRSRTSGSPGLQEFVSPLEKKMGMGTGLAVGAAAGVLGGLALAGGASYLEDKFEERVSDRVEDNLEREESYGGGGYGGGYYYYGGNDYYGGDDDYWMGPDPPIVCPAATHAIRLSPSTCWPGCLLYQSAPPPGRGKPARSLRSTPEFPPIVELYYAGRPQGPSGLPGPLDEEITLAVSLNMSFSRCRLQSPILRAVRRLPLE

SEQ ID NO: 63656 - DNA, 666 bp, Zea mays
  misc_feature: Ceres CLONE 1531935
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaaaatatgatggacgggatgtgtataaataaacccagcatgctgttttttttcgtcgtcgttgtgtgcgtttgagagctcgcctagtgttttggaacaataatttttcgacagactatgtgttctgtatgttttggtcgtcagacatatctatcctcagtccatggctttgcttgctacagaaaaaaaaactgaataacatattgagtatacctaaaaaaaaaaaaaaaaaaggaaacactcaaagaaacccgagacgctcgaggtacccaattccccctatagggagccgtattacgcgcgctcactggccgtctttttacaacgtcgtgactgggaaaaccctggcgttacccaacttaatccccttgcagcacatccccctttcgccaactggcgtaataacgaagaggcccgccccgatcgcccttcccaacagttgcgcagcctgtatgccgaatggaaattgtaagcgtcaatattttgttaaaattcgcgttaaatttttgttaaatcagctcattttttttagccaataggccgaaatcggcaaattcccttaatgattcaaaagaaaatagcccc

SEQ ID NO: 63657 - DNA, 877 bp, Zea mays
  misc_feature: Ceres CLONE 1531936
  misc_feature: Encodes the peptide sequence at SEQ ID NO. 63658
  misc_feature (9)..(9): n is a, c, t, g, unknown, or other
  misc_feature (10)..(10): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
ttttttttnnttttttnntntttgctttttattctacccnnnngggtttnnnnntagggttggtgctccccgcggtggcggccgctctagaactagtggatcccccgggctgcaggaattcgtctcacccctagaaaaagacgactgacgagagggggagagagagaggcgaggaaggagggagagagcacgggggcttgatcgaagatggatgccggagcaaaggtggtgaaaaaggccgcggccgggcgccccggcgcgggcggccccaaaaaaaacccggtctctcgctccgtgaagggggggcttcagttccccgtcaggccgcccccgccccccgctccccgcaggggtgggggggtgccggccgtgccgggcccgcccccgtcccccctgtaagctggtgtgcacgtcctacgtaattcttttttcccccccccccccgcggggggggggggggggggggacccctctcctcctcccctctctccttcctcgtccttcgcgacgggagcaatgctagacagcacatcgggctggctcgtctcctggttttttttgttgtcttcggtttttcgtgaggaagcggccacttctagggcgtcccttctgcctctatcagccgccctattacgattcttccaccgtaacggacggccttgcataagccgcagcgcgcgatgacgtttgcctcttcatcacaagaccctgcactccgcgcttcccgcctcctttctgtgcacgttccaccgggcgccactctagctgcctgctctgctactcgtgtaccctcaccccgcccttgcacaccgttgcacggcacaggaggttataatgagctgggagtgttagatgagtagcgcctcgttcatggcat

SEQ ID NO: 63658 - protein, 63 aa, Zea mays
  misc_feature: Ceres CLONE 1531936
MDAGAKVVKKAAAGRPGAGGPKKNPVSRSVKGGLQFPVRPPPPPAPRRGGGVPAVPGPPPSPL

SEQ ID NO: 63659 - DNA, 843 bp, Zea mays
  misc_feature: Ceres CLONE 1531940
  misc_feature (350)..(350): n is a, c, t, g, unknown, or other
  misc_feature (791)..(791): n is a, c, t, g, unknown, or other
aaatctggagctccccgcggtggcggccgctctagaactagtggatcccccgggctgcaggaattcgtctcacccctagaaaaactccgctatccgtaagtgtgctcgtgttcagcttgttaagaatggcaagaagattgctgccttcgtgccaaatgacggttgtttgaactacattgaggaaaatgatgaggtcttgattgctggatttggtcgtaaggggcacgctgtgggagatattcctggtgtccggttcaaggtcgtcaaggtttccggtgtgtctctgcttgcccttttcaggagaagaaagagaagcctaggtcttagattgctcttgctacccaaatccnccatcttggacctcacccgggaggggggggggaggattaacaagaatggttccttcccccccccttgcgtggcattcctagcaaattgctaaccctaagatttttgttgggtgaaaaccaatttcctttttccaaccttgctttccttgttaagtgccattcgttcccatgaccaacggaccttcccccctcgccaaaactttgttggcttgccctcccaaagttccttttgggacacacgacaattcacgagtctgcagaacgctccagaaggtaccccagatgtcggcccccctgtcaggagtgggtctattacaccccagccctgactaggtcctgtcgttcattcgccgcgtgcctggctatcactggcgaaaacccctgttgcgttctacccaatctccgactctcctgtcgttgggcgcaccgtgtctgcttgtncttccgcgcctggtggggtaaaaaggttctagaaggacgccctcgcgtgttg

SEQ ID NO: 63660 - DNA, 714 bp, Zea mays
  misc_feature: Ceres CLONE 1531945
  misc_feature: SWISSPROT Homolog: EC 3.2.1.23 Beta-galactosidase
  misc_feature (714)..(714): n is a, c, t, g, unknown, or other
atagctggagctccccgcggtggcggccgctctagaactagtggatcccccgggctgcaggaattcgtctcacccctagaaaaaacgagcaagtgaccgaggaacccgaagtagcccaagttggagattctgagcaggagctcgcagaaggtcaagaacaggtactgcaagatgaagactactacgacgagtttgatgagatctaggcgtcgtctcctagtcaactagggcttgtggaggatcatcgtcgtcatatggtgtaatatatttagttattttgtaaagaaactccgattatttaataaagatatgacattggtttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaattttttgtaaatcacctcatttttttaaccaatgggccgaaatcggcaaaatcccttataaatcaaacaattaacccgagatagggtttgagtgttgttccagtttggaaacaagaggccccn

SEQ ID NO: 63661 - DNA, 762 bp, Zea mays
  misc_feature: Ceres CLONE 1531948
  misc_feature: SWISSPROT Homolog: EC 3.2.1.23 Beta-galactosidase
atagctggagctccccgcggtggcggccgctctagaactagtggatcccccgggctgcaggaattcgtctcacccctagaaaaacatatcaaaaccggacggttcggcctcgataagaacaccatcttctctgctattcctccgatgttcccaacacccccgccgccgccatcagcatggaaaccatagaggcgatacctctgagtgtttttccaaagcatccaacagggaagtggagcaaacgtgtgataatttggtacagccaagggcagagacaggaatgctgacagcataagtttatagagcttctatttctgtaccaatatgacagatcagtataagatcctctgtcagacggagaaaaaaaaaaaaacgagacgctcgcggtacccgattcaccctatagtgacccccattactctcgttcactggtcgtcatattacaacgacgtgaatgggaaaaccctggcgttacgcaactaaatcgccttgtagcacatcacccttaccacagctggtgctataaggaagagggcccgatcgaatcgcccttttcgaagagttgcgtaaacctgaatggggaatgggaaatcggcaagcgttaatagttctgtgtaaaattccaccgttaaaatctgggttaaaacctggtttttttcttcttaaccaattaaggccgaaaattcggcccacttctctttataaattggaaataaattggccctggaatcccggtttcatttgtcccctcccaaattgaga

SEQ ID NO: 63662 - DNA, 720 bp, Zea mays
  misc_feature: Ceres CLONE 1531954
  misc_feature: Translation starting site: 173
  misc_feature: SWISSPROT Homolog: EC 3.2.1.23 Beta-galactosidase
catagctggagctccccgcggtggcggccgctctagaactagtggatcccccgggctgcaggaattcgtctcacccctagaaaaaatatatatccaacaaccagcagtgcaacaagcaagatttacctgcccatcgatcatatcgtcaactggtccggcagttcgcgacaccatgagctccaccgagtgcggcggcggcggcggcggcaccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgagtccgcatcttcgtcgacatcgtcgcccagacgccccacatcggctgataatatataagctaacccctatttcctttccttgccccagaacttgaaataaatatatatacgatgaaataacgcgggcatgcctaataatggatgtgtgaattctcactctcgaagaacccaattcgccctataaagaaaaaaaaaacgagacgctcgaggtacccaattcgccctatagtgagtcgtattacgcgcgctcactggccgtcgttttacaacgtcgtgactgggaaaaccctggctttaccaacttaatcgccttgcagcacatccccctttcgccagctggcgtaataccgaagaggcctgcaccgatcgccctt

SEQ ID NO: 63663 - DNA, 680 bp, Zea mays
  misc_feature: Ceres CLONE 1531955
ggcggccgctctagaactagtggatcccccgggctgcaggaattcgtctcacccctagaaaaagcccgctgtccacttccctctcatcctctcgacctcgcttcctccctcccaccgtgccctgccttttcctcacgacctcgccgccacgctcgcgtctcgccgctgattgcggtcccccatggaaccgtcgtcctctcaatccgtccgccgctccatcgtcttcctgtatttgtgctgctgatatgtgtaacttgtgtttctccaggtgaaggcggccgagcacgcggccgagatggaggcgacggtggccgtcgcggctgccgtggaggcctatgaggacgaggctgctgcgtgggggggcttctaccccccaacggtcctgggaccaaacggccccgcgcgaatggcagtgggcgggaccgctcggggtccaggtgtttctcccaatctcccctgctttcctcatcctgctgccgcttttgctttttatccgctgcgaccgccatagccctcgccctcgtctcgctgaccggcgtgccgctgggggatcccggctcccctggggctgttagggccttaattctttcaggggcagggtggtccgggccccgcgaccgggattgggattgtaaaacttattggattgggtaatcccgctactctctcttaaccctgtt

SEQ ID NO: 63664 - DNA, 889 bp, Zea mays
  misc_feature: Ceres CLONE 1531956
  misc_feature (1)..(1): n is a, c, t, g, unknown, or other
  misc_feature (7)..(7): n is a, c, t, g, unknown, or other
  misc_feature (39)..(39): n is a, c, t, g, unknown, or other
  misc_feature (40)..(40): n is a, c, t, g, unknown, or other
nttgggnccccccccgcgccccccttccctttttttttnnagcctcttctgcagacagctggagctccccgcggtggcggccgctctagaactagtggatcccccgggctgcaggaattcgtctcacccctagaaaaagctggacaccccgctccgcctccactcctcgcgccgctgccgcatctcctctacaggtaagaaggagagaaagagggcgaaatggtgaagcacatcaacgtcatcccctacgggtacttcaagaagcactggcagaactatgtcaagacatggttcaaccagcccgcccgccagccgaggcgctccatctctccgtctctagattgttccgaatatgttaccccccaccaccgctgtccccctcttctactctttgatcatttgtgtaattatgaaggcattaactcgcaacccccggggcccgggagagcgctctttcccccattaacaatgtttaaagcgacaaaagatccatctccccatcgtggctcttgttttccacccccaaatggcctaattcctgttccttcctccacacacccgcgatcgtaattataaatttcttcttctccttgacccctattctctctgtccgacccccccccccccctgcccctaaactctctcctacctctcttccttaccggctcgccgcctctatcctttccgtagtacgacctcccacttctacacgcagcgcagacaggtggcccgcgccctcttcgccctcctccctccacccatcagacgtggtgcactggccgcctcattcgctaaccaatttccgtgcgcgtgctcgcgcttttatccgatccttggtcctactcacattatgtccatatatctatcacttcgaccaaccacctctctg

SEQ ID NO: 63665 - DNA, 711 bp, Zea mays
  misc_feature: Ceres CLONE 1531961
  misc_feature: Encodes the peptide sequence at SEQ ID NO. 63666
  misc_feature (391)..(391): n is a, c, t, g, unknown, or other
  misc_feature (392)..(392): n is a, c, t, g, unknown, or other
  misc_feature (408)..(408): n is a, c, t, g, unknown, or other
  misc_feature (409)..(409): n is a, c, t, g, unknown, or other
tccccgcggtggcggccgctctaagactagtggatcccccgggctgcaggaattcgtctcacccctagaaaaaagagcagcgtcatcgcaccgctcgccggcgagccagatcatcagtgaggaaggcagcgatggcggtggtggagctgtgggagacgctgaagcaggcgatcgttgcgtacacgggcctgtctccggcggccttcttcacggctgtggcggtggcggccgctctgtaccacgttgtgtcggggctcttcgcggccccgcccccgccgccgccgcggccacgggaggagcccgagacagagcctctccctcctcccgggcagatggggggaggtctcttattttccccccccccccgggggaacagaaaagggggcctaannaatccccctcctcatnnccccccacgggcccatatcataaaacttctccccccaagcgggggggggccgttggaacctcggccgacccttacgcccctccttccccggggaaaaatggcacagctggaagttcgtagccaaacaagttccttccaggccccagggaacctccccggggggaattcctgggggcgtccgtccccgcttcgacctcccacgcccctttccactctgtgtattaccaaccttcgcgaccctctccgcggtggagtggcggtctcctgctccataactagaccctcccctcgtcgtacagacg

SEQ ID NO: 63666 - protein, 193 aa, Zea mays
  misc_feature: Ceres CLONE 1531961
  misc_feature (87)..(87): Xaa is any aa, unknown, or other
  misc_feature (93)..(93): Xaa is any aa, unknown, or other
MAVVELWETLKQAIVAYTGLSPAAFFTAVAVAAALYHVVSGLFAAPPPPPPRPREEPETEPLPPPGQMGGGLLFSPPPRGNRKGGLXNPPPHXPPRAHIIKLLPPSGGGPLEPRPTLTPLLPRGKMAQLEVRSQTSSFQAPGNLPGGNSWGRPSPLRPPTPLSTLCITNLRDPLRGGVAVSCSITRPSPRRTD

SEQ ID NO: 63667 - DNA, 756 bp, Zea mays
  misc_feature: Ceres CLONE 1531962
  misc_feature: Encodes the peptide sequence at SEQ ID NO. 63668
ctcgaactagtcgatcccccgggctgcacgaattcgtctcacccctagaaaaaaaattgacagggcaggccaactaccagcaagccggggacgcgataggcgaggacctggtgaacgacccggacctggtgtcctcggacgcggtggtctccttcaagacggccatctggttctggatgacggcgcagtcgcccaagccgtcgtgccacgacgtgatcctcggcaactggacgccgtcgagcgccgacgctgcggcggggcgggttcccggctacggcgccatcacccacatagtcaacggcgccaaagactgcggcgtggggcaaaacgccgccaacgtcgaccgcatcggcctatcactagcgctactgccacccccccccgcgtcggctacggggaaaaacctcgactggttcctcccagcggcacttcttgatgaactgattgttccacttgacctgctatccactggtggtacatgaatgagagtctgtgtcccagacgtgtttcctttccctactgttattcttcttcacactcgtagcgaatctaagaaaaaaagaaatatgattcgcctccgaggctcccccatttcccccttgttgcgagtccgcagttgcttacccgtcccctggctctggcgtttgattatctccccgtcccttagtaaagtccctgttctctttccccctccttaatcccctcttgtggttcctattcctcttttcttatctaggtggttgttatacgacgtta

SEQ ID NO: 63668 - protein, 159 aa, Zea mays
  misc_feature: Ceres CLONE 1531962
  misc_feature (1)..(137): Pfam Name: Glyco_hydro_19 Pfam Description: Chitinase class I
  misc_feature: SWISSPROT Homolog: EC 3.2.1.14 Chitinase
RTSRSPGLHEFVSPLEKKLTGQANYQQAGDAIGEDLVNDPDLVSSDAVVSFKTAIWFWMTAQSPKPSCHDVILGNWTPSSADAAAGRVPGYGAITHIVNGAKDCGVGQNAANVDRIGLSLALLPPPPASATGKNLDWFLPAALLDELIVPLDLLSTGGT

SEQ ID NO: 63669 - DNA, 727 bp, Zea mays
  misc_feature: Ceres CLONE 1531963
  misc_feature: SWISSPROT Homolog: EC 3.2.1.23 Beta-galactosidase
atagctggagctccccgcggtggcggccgctctagaactagtggatcccccgggctgcaggaattcgtctcacccctagaaaaaagggaagacgtcgcagatctacgccatccgccaggccgtcgccaaggggctcgtcgcctactaccagaagtacgtcgacgaggccgccaagaaggaggtcaaggacatcttcacccggtacgaccgcacccttctcgtcgccgaccccaggcgctgcgagccgaagaagttcggtggtcgtggcgcccgcgccaggttccagaagtcctaccgttgagcgctcggctgcccgcgcttgccggaccgttgcctgtgttgtcccaacctgccagttcgatgcctgtacccgtggcttaattttctatcatcggagctacttatgtggttctataactagatgctgttttaccttcaacttatgctgttgtaccttcatatttggacttcttaagccttgtgtcggacgcctttggcattgtgatatgaaacatgagagattttgaagactatctctgaagttatgtggttctaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgcagctggcgtaatagc

SEQ ID NO: 63670 - DNA, 635 bp, Zea mays
  misc_feature: Ceres CLONE 1531966
  misc_feature: Pfam Name: RMMBL Pfam Description: RNA-metabolising metallo-beta-lactamase
  misc_feature: The sequence is a functional homolog of SEQ ID NO 994 in the 10/374,780 US patent application
ggatcccccgggctgcaggaattcgtctcacccctagaaaaaatattattggagttcttctaggatctgagagcaatacccaaaagagactacatgaagtatgatttattcatggatatatatatatatgggtaaagattctggcctgcatacctctaggcatgcctactgagaggagctggaggaagttcttcggattgttaaaccacaacatttcttgcctgttcatggagaactcctatttctcaaagaacatgaatcacttggaagatcaactggcatacgacacacaactgtaataaaaaatggagaaatgcttggtgtatcgcatctaagaaacagaagacttttgtccaatgggtttgtttcattagggaaggaggatcttcagctcatgtatagtgatggtgataaggcttttggtacatccactgatctttgcattgatgagagactaagaatcgcatctgatggcattatttttgtcagcatggagatctttcgacctcagaaggaacatggtttagcgtagactgggttgaaaggaaaatttaagattactaccagatgtctatggcttgataatggaagattgttggacgcactctacaaagcagctcatgctgcatttgcaa

SEQ ID NO: 63671 - DNA, 751 bp, Zea mays
  misc_feature: Ceres CLONE 1531968
  misc_feature: Encodes the peptide sequence at SEQ ID NO. 63672
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (48)..(48): n is a, c, t, g, unknown, or other
tttttttttttnnnnnnnnccttctatccccttcccccaccccatttnttaaaagctggaactccccgcggtggcggccgctctagaatagtggatcccccgggctgcaggaattcgtctcacccctagaaaaagtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttctccgtcaggtacggcaagagctacgagagcgcggcggaggtccataagcgggtcaggatctcctccgagagcctccagctggtccgctccaccaaccgcaaaggcctctcctaccgcctcggcatcaaacgcttcgcggacatgagctgggaagagttcccgtgcgacccggctcggcgcaaccccagaactgcttcccccacgcttaccgggcaccaccgtaatgcggtcccgccgtcctttggagcctgcctggatacgaaaaaaactggaaagtaagaaagggcaattgtaaacccaccgtggaaaaaacccaggggcccaccggtgggaatccatggcctgggaccc

SEQ ID NO: 63672 - protein, 154 aa, Zea mays
  misc_feature: Ceres CLONE 1531968
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
MAPRRLLVLAVLALAATAAAANSGFADSNPIRPVTDRAASALESTVFAALGRTRDALRFARFSVRYGKSYESAAEVHKRVRISSESLQLVRSTNRKGLSYRLGIKRFADMSWEEFPCDPARRNPRTASPTLTGHHRNAVPPSFGACLDTKKTGK

SEQ ID NO: 63673 - DNA, 911 bp, Zea mays
  misc_feature: Ceres CLONE 1531974
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tttttttttttnntnnnttcgtttttcttctcttnnnaagtggnnnnnnnaaatctggtgctccccgcggtggcggccgctctagaactagtggatcccccgggctgcaggaattcgtctcacccctagaaaaagtccgcacaataatctgcgctgcgcggaagaagggaaggggaaaagcagttaagcttgagcgcgcgcgacagggtcaagccgaggggcggggaatcgccggacaatggaggtgggcagggctccgcgacgacgggtgtccccagcagcggcggtggcggttgtgccttcgctgcttctgatcaccggtctatttcgcgggccgggcggcgggggttcggaccacccggcaggcccccggcgaccgggcgattctgtgctcgataatgcatgttcttcttttctttccaccccccacctgtcgagggggggggggggcgttcttcttccttaaatcttatcttatgccgattctcatagtgaaccttgattttattcgtcctgtccgtctctaggtaacataggagtcgagcggagttgcgtgcactcttcacatagtgaccagccgtcctcttggtatttccaggagggtgtggataaaatccccataataattgttcttatccccacactatccacaacattacgtatataattcctaacttacttcgcagtgagtctcgacacgttactcaggcactagttctcaatgcctactcaggacctgttgagggtttcaaagcagacgcgcatacgtgttgggtgaaagcagctcgctacacgtgacgacgtgatgacccctcggccgcgcaatatcgcgccacgccgcgtctccccgcggtaacgagtcccgactgaaaacctcaacattgagctagacagcacgttttactctcccg

SEQ ID NO: 63674 - DNA, 633 bp, Zea mays
  misc_feature: Ceres CLONE 1531975
  misc_feature: Encodes the peptide sequence at SEQ ID NO. 63675
atgtggatcccccgggctgcaggaattcgtctcacccctagaaaaaggtggagtcgaccgatcgagctagatctccaggactcacctccccaaccgtttgcctccgtctcgcgtgacttcattcccagcggccggcggcgacctccacgtggtgccattcgccggcaacgagcacccgcccaccaggatccaggtttgtgctgcgagagcgcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccttcatttcgtcgagatactggaccgctattttggcagtgtatgtgagttggatttgatattccattttcaaaaggcctacttaatactggatgaaattctcatcgctggtgaactttcagaatcctacccagaaaaatgttccaagacttattgg

SEQ ID NO: 63675 - protein, 136 aa, Zea mays
  misc_feature: Ceres CLONE 1531975
  misc_feature (1)..(135): Pfam Name: Clat_adaptor_s Pfam Description: Clathrin adaptor complex small chain
MINFVLLISRQGKVRLTKWYSPYTQKERTKVIRELSGLILTRGPKLCNFVEWRGYKVVYRRYASLYFCMCIDAEDNELEVLEIILHFVEILDRYFGSVCELDLIFHFQKAYLILDEILIAGELSESYPEKCSKTYW

SEQ ID NO: 63676 - DNA, 743 bp, Zea mays
  misc_feature: Ceres CLONE 1531979
  misc_feature: SWISSPROT Homolog: EC 3.2.1.23 Beta-galactosidase
catagctggagctccccgcggtggcggccgctctagaactagtggatcccccgggctgcaggaattcgtctcacccctagaaaaaaagaaagaacgaaagttgggggctcgaagacgatcagataccgtcctagtctcaaccataaacgatgccgaccagggatcagcgggtgttactaataggaccccgctggcaccttatgagaaatcaaagtctttgggttccggggggagtatggtcgcaaggctgaaacttctagaaaaacttggttttaactttgcgacatcaaaggagaaagactagaaagggaatatatagaactagaacctttttaaagcgtatcagccgacctggcttacgaatttatgccaactatcaaggaattcctaaggttttgggcggaatgggaattgctattctttctacttctcgaggtataatgacagatcgagaagctcgactaaacagaattgggggagaagttttatgttatatatggtaatggccccacctatagtacccaaattctatctcgaacttcctattttgaaaataaaaatagaaaaataggagaaaaatatatgacagaaaaaaaaaaaaaaaaaacgagacgctcgaggtacccaattcgccctatagggagtcgtataacgcgcgctcactggccgtcgttttacaacgtcgtgactgggaaaaccctggcgttacccaactaaatcgcctggaagcacattcccctttt

SEQ ID NO: 63677 - DNA, 817 bp, Zea mays
  misc_feature: Ceres CLONE 1531982
  misc_feature (408)..(408): n is a, c, t, g, unknown, or other
  misc_feature (817)..(817): n is a, c, t, g, unknown, or other
atagctggagctccccgcggtggcggccgctctagaactagtggatcccccgggctgcaggaattcgtctcacccctagaaaaatagaatagattgcagagaactcttatgatgccatttccatgtccgtgaacaacccataattttccggcgccctgaattggggggtttccatagcatgtgcactgggtttgggtggagagcctccacaatcgactgagtcaagctttcttgattccgtagaaacatgttttgtttgacctcatcatagcggatctccgcttttatctatacagattgtgatatgtccttacctcctctctccctgactaacaggatttctgcagaccctttgctaaaacccagaataaccccgagggggtcgggggacccaattcccccctttcncccccctggtataacagcgaacacaggcccgcaccgttcaacccgtccgggacgggtgaaaaccctggactgtccccaatgtaaaattggcctccggcaaagatgtccgctttttatccccgcctggagatttctttcctgagaacggcccccatcccaattcacccattccccacagattgtccggccccctggactgtgtcaaatgggaaactggcacacccgctaatattctcttgtacagattgcccgcttaatgctcatctacaacccccctctctaaaaactcaacgcaacaactccacggtattatggcgcaaacatcctgtcgatagagtaggcactcggcctacctgttacggggcgccatcatctcgttatgatgtgtgtaacgacggacttgcagttn

SEQ ID NO: 63678 - DNA, 743 bp, Zea mays
  misc_feature: Ceres CLONE 1531983
  misc_feature: Encodes the peptide sequence at SEQ ID NO. 63679
aagctggagctccccgcggtggcggccgctctagtaactagtggatcccccgggctgcaggaattcgtctcacccctagaaaagacgctttggccgagtggttaaggcgtgtgcctgctaagtacatggggtttccccgcgagagttcgaatctctcaggcgtcgtctttttttttcctttttttttctattttgcctacccacatggacacatggttcccttcttcacaagctctggtactgtaacattcagaaatgcaaatggttatcatatcgtgagaattctccggttacaacgtgagtgcaagctgtaacccaagggaatcgctgctgtattatacatttgtacaaggttcaccaaaccgattggtgcccaaaaactggccgagattcatgttcgatttatcggtgtaaaccgatagaaaccggccagatctgaatgcaaaccatttttttgattaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcggtaaatttttgttaaatcag

SEQ ID NO: 63679 - protein, 85 aa, Zea mays
  misc_feature: Ceres CLONE 1531983
  misc_feature: SWISSPROT Homolog: EC 3.2.1.23 Beta-galactosidase
MQTIFLIKKKKKNETLEVPNSPYSESYYARSLAVVLQRRDWENPGVTQLNRLAAHPPFASWRNSEEARTDRPSQQLRSLNGEWKL

SEQ ID NO: 63680 - DNA, 733 bp, Zea mays
  misc_feature: Ceres CLONE 1531990
  misc_feature: Encodes the peptide sequence at SEQ ID NO. 63681
aaagctggagctccccgcggtggcggccgctctataactagtggatcccccgggctgcaggaattcgtctcacccctagaaaaatatagatccctcgtatacatgcggcctcttgccatttgggcgatccagtatgcagtttctcctcccaaggctattcttgaggcccccaaagttaacctaatggaccgaatacatatctcccctcacatggtccgagcaattagcgagataagcattagaaaggtagcacccgacaatagatgtttccctagctctgccttccactgtgaatgctgatccgaaggtaaacatgcagctgctgagcaacttgcaaccttttttttggcttttttcggtttctccttgccccccccccccctttcaaggtccaggtgggggggctcacgagttcttttcttggatcagagggcttatccaaaccaccaccaaactcgtgactcaagagagttcatgttgtataattgtacagcaaactgttagtcacataatctttttttttcacttgaaaaaaaaaaaaaaaaacgagacgctcgaggtacccaattcgccctatagtgagtcatattacgcgcgctcactggccgtcgttttacaacgtcgggactggaaaaaccctgggcgtacccaattaaatcgctttgagacaatccccctttcccagctggggtaatagcgaggaggcccgcaccgatcgccctttccaacagtt

SEQ ID NO: 63681 - protein, 99 aa, Zea mays
  misc_feature: Ceres CLONE 1531990
KAGAPRGGGRSITSGSPGLQEFVSPLEKYRSLVYMRPLAIWAIQYAVSPPKAILEAPKVNLMDRIHISPHMVRAISEISIRKVAPDNRCFPSSAFHCEC

SEQ ID NO: 63682 - DNA, 905 bp, Zea mays
  misc_feature: Ceres CLONE 1531991
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
ggggcggagggccgtggggggcggctgtcctttaataaannnncacagctggggctccccgcggtggcgcccgctctagaactagtggatcccccgcggctgcaggaattcgtctcacccctagaaaaaaagcttctagggttttcccgccgccgccgccgcttcgtcgtctccggtgtggggatggcgtcgcctagagatccttccggatggagaagaagctggggaacaagatgcgccagaaccgcccccgtcccctactggatcccgcatgcgcacggacaaccccttccggtgcagcgcccaggtcgggctctggggccgcaccagtctcggattccgtggccggggggatttgccgcctccccgactgggaattccctggggtttgccaatcttagcggctttgtgggtccctcccctcgttcgcgcgcggggggggggcgtggcggtatagggtccccttcgtggctccgctttccccacggcgtcgcggtgccgctcagtgcgcgacatgtggtgcctcttcctcccctctcctgctttctgtgtgtggtgcagtgccgtcgcgctaaggctctggtggtagcgcctcccgccctcggtttagcgcgcacactgtgggccgcgcgttcctgcgcgtttcgtcggtgatttgaggcactctgatcctttcgcccccctcattaggtagctgcgggcggtcgcttcccccgctttgcatagcgggcgagtccttccccgcctccgttcgtcgcgggcggtcgtgccctgtttcgtgtggcggcgcgtcgttcccctccttattctctgtgcggattgtccgcactctccactgtctgcctactcccccccctcaccgccggactcatgttcggtcgggccaggacgtgtgacgcgtcata

SEQ ID NO: 63683 - DNA, 650 bp, Zea mays
  misc_feature: Ceres CLONE 1531999
tccccgcggtggcggccgctctagaactagtggatcccccgggctgcaggaattcgtctcacccctagaaaaaaccggggcagtaattttgtatagttttccattggttcgtgagtgtaacaaagttgccccctagacttacctaccaccttggagtcatattgatgaacttgtgatggtcacatgtgtagaaccgttatctacgccctatagtagatcagaataaacacgcgccttcccctagggtccggttcgtttttacaaacgtcgggaactggttgaaaacctagggtgttttccccgggaccctgtttctggggggtaccccaaattttcccccccttttttgggccgcgatttttcccgccccccccaaaggggcccccccgcttttttaccacctttcccacccaggggaaaaaacccctcggggggttttccccccacatatgaaaaacccccccggggcccatattaagcgtctccacccccccccctctctttctccgccctcccaggcgggggggggtattttagaaaagaaaaagagaccccccccacacgttgtctcccccccccccccacaaaaaatgggctcgccccctataggtgaggggtggagaagagaaagaataaatatccagccccct

SEQ ID NO: 63684 - DNA, 799 bp, Zea mays
  misc_feature: Ceres CLONE 1532001
  misc_feature: Encodes the peptide sequence at SEQ ID NO. 63685
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
  misc_feature (39)..(39): n is a, c, t, g, unknown, or other
ccttacttttgatttctttttttttannnnnagatnttnggtcataactggaactccccgcggtggcggccgctctagaactagtggatcccccgggctgcaggaattcgtctcacccctagaaaaagcccgcactaccacgcccccgctcctctcgtctctatcttcgcctcttccatcgcaggattcagcggccatgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactagtaagcagcagaagcatatgctctgctcacctgaaagacaagtactacatatatatatatatacgctgtgtgtcaattaatgggttctaggctgctgctgatgcggctgcttcgttcgggtagccccgtctgattatgtactggaacccttggctggtagcctgctgtagcaaaaaccattggttcctgtggggttaaaaaaaaaaaaaaaaacggagacgctccggggtaccaatttcgccccttatagtgaggtcgttttaagacgcccttaacggggacagtgctttataaacgtagatgacctgggaaaaaccctgggcgtcgcactactctcaaatcggcctggcggcaggaacccccttttacc

SEQ ID NO: 63685 - protein, 77 aa, Zea mays
  misc_feature: Ceres CLONE 1532001
  misc_feature (4)..(73): Pfam Name: DUF1909 Pfam Description: Domain of unknown function (DUF1909)
MGGGNAQKSKMARERNAEKNKGGKGSQLEANKKAMNIQCKICMQTFICTTSEAKCKEHAEARHPKNDLYQCFPHLKN

SEQ ID NO: 63686 - DNA, 939 bp, Zea mays
  misc_feature: Ceres CLONE 1532008
  misc_feature: Encodes the peptide sequence at SEQ ID NO. 63687
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (38)..(38): n is a, c, t, g, unknown, or other
  misc_feature (39)..(39): n is a, c, t, g, unknown, or other
tgtgttgttggtttttctaacctatannnnttctttcnntttatactggagctccccgcggtggcggccgctctatttctagtggatcccccgggctgcaggaattcgtctcacccctagaaaaagaagattagattgcactacgcttatattttagtattgaactcgttgcattttgatacctgtacccgtagtttcgcaaatgtcccatgttatggtgtggtatggttaatttgaagaatccttatgtactgaatctctgcaaaaagctatgttgtggacagaagtgtaacgtgccggatttcttgcatttcttagggctattttgagaaccctattttcttaatacacaattacaggagtacacaatagaaataaaataattataaaaaatcgagacgctcttaggtacccaatttcgcccctatggtgaggtcgttattacccggccgctcacatggctcgtcaccccccacaatgtgcgggacttgggtaaaaccccctggggttttccctcagcttatagtcggcctttgcaggaacaatccccccttttcgaccagtttgaggggtatttatgcggaaagaaggcctcagcatccagtttctgcctctttcccacaagcagttgtgccgcaactccttgatatgggccagatatgtgaataattggtacagccggttcaataaattctttggtgtaaatattcccgcggtttagaatttttggtggatgaaaatacatgcctcaacttctcttcaaagacgtagcaggggccccgaaatacgggtgaagaattccccttccttaataatgataaaatgtattacacccctttaagtggcgtttttgagagagatttgctctcctggatataggttaacactaccatgttccctttacttgtttatggaacatggtggatatttgtcagtagt

SEQ ID NO: 63687 - protein, 39 aa, Zea mays
  misc_feature: Ceres CLONE 1532008
  misc_feature (9)..(9): Xaa is any aa, unknown, or other
  misc_feature (10)..(10): Xaa is any aa, unknown, or other
  misc_feature (13)..(13): Xaa is any aa, unknown, or other
CVVGFSNLXXFFXFILELPAVAAALFLVDPPGCRNSSHP

SEQ ID NO: 63688 - DNA, 808 bp, Zea mays
  misc_feature: Ceres CLONE 1532017
  misc_feature: Encodes the peptide sequence at SEQ ID NO. 63689
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
tttttttgttaccccctctccactttatccagccgtacnnncctcaaaagctggactccccgcggtggcggccgctctataactagtggatcccccgggctgcaggaattcgtctcacccctagaaaaaatacctttctcggccttttggctaagatcaagtgtagtatctgttcttatcagtttaatatctgatatgtggaccatgtgtccacttcgatattaaatttattttttgtgggggatggaccaccactagtggcttgccattgggttcctcgagcgtcgctcggccgttgcactacaggctgatccagcaattaaaaaaaaaaaaacgagacgctcgaggtacccaatttcgccctatagtgagtcgtattacgctcactcaatggccttctatttacatcgtcgtgattggaacaaccctggtgtttcccatcttaatcgtcttgtcgcacatccccctttcgccagctggcgtaactaaaaagaggtccgcaattatcgcccttaccctaacatttgcgtgtcctgaatggttaatgcaaattgtaacccgttattttttgttaaaatttcgcctcaaatttttggttcatcagtctcattttttctatccattgtgctcaatattagtcagaacctctccacttagtctacaaatcttcaccgttatatagcgcttcagttggttgttgccccttttggtaaaccaccattttccactaatttacaagcaccttggaacctcccgaccgctccagatgtgaggaaaacatcctgtcagtcatatagggagcaggatt

SEQ ID NO: 63689 - protein, 32 aa, Zea mays
  misc_feature: Ceres CLONE 1532017
  misc_feature: SWISSPROT Homolog: EC 3.2.1.23 Beta-galactosidase
MAFYLHRRDWNNPGVSHLNRLVAHPPFASWRN

SEQ ID NO: 63690 - DNA, 793 bp, Zea mays
  misc_feature: Ceres CLONE 1532022
  misc_feature (793)..(793): n is a, c, t, g, unknown, or other
ccccgcggtggcggccgctctagaactagtggatcccccgggctgcaggaattcgtctcacccctagaaaaattcctcgattggcgtcactgaaggggcaccaccagagctcacgtccccaaatccagcccaatgaacctctgtttctgttttctctttggcgccttaatcattttctgttggacagtgctggatcgttgatcggggtactgttccatgacactggtggtttatgtttacttttcctccccaataatcttggatcgagcgatgttataaagctggccatgcacttcttccagattctgtattcggtatgtttaagatgtgctccctttcataacctctgaagagtagtttttaggcacctgttccaatttttcgtcattgaaattctgtaccatggctttcctaggcccgttattgtttgaaacctcttttattaaaaatcctttaatggacacctttttccccctattaaaatggattggaatcctgggattggacacacaaaagggtttttcccctatgggggaaaaaaaataaaaaataaaaccagtaccctctcgtaaggtcccccaatttcccccgcctaaatgggaacccttaatatgccgggctgcttatattggggcgcgccacttttttcaaacactacgttataatgtggaaaaaaacccttggggtgtttctcaacttatatctcccctcttttgtatacaattccctccttgttctcacattgggggtataaatataaaaaaagaagctctccccactaagctcccctctn

SEQ ID NO: 63691 - DNA, 867 bp, Zea mays
  misc_feature: Ceres CLONE 1532023
  misc_feature: Encodes the peptide sequence at SEQ ID NO. 63692
  misc_feature (1)..(1): n is a, c, t, g, unknown, or other
ncgtcggagtgcgggggcgcatcgcggtggggggttcccctaaaactggcactccccgcggtggcggccgctctagaataatggatcccccgggctgcaggaattcgtctcacccctagaaaaaagcttcgacccgctcggcctcgccgacgaccctgaggccttcgcggagctcaaggtgaaggagctcaagaacggccgcctcgccatgttctccatgttcgggttcttcgcccaggccatcgtcaccggcaagggcccgctcgagaacctcgccgaccaccttcgccgaccccgtcaacaacaacgcatgggcctatgccaccaactttgtgcccggcaagtgagggggtggaggcgccaccgcccaccggcccatcgctgcggatatctatgtgttcggatgcccggcgagcgcgctctggattccggatggtgcccggttgtaaattgccccccccggacaagtgggttccacccctgcaaggtagtaattgttggggcctgtgcaaagaacttaacaacgggggtccctttaggcgtccctggttttacgccttgagagggattccgccatttacccgtcgcgctccgccggccacactccgcttccgccatctctgctcgaccacgggtcccacccctcggatttataccatccaactttatgacgctgttgtcctgcgtattgcctctttttctcccgtcgacgggcctcatgcgcccacaccggccccctccatccattcgccccttggcccatacaacttagcgacactcctgtaatgtcgcaaatgaatcaagtgcctgatgcctaaatggattcggtgtccctactgcacgctttgtactatcatgtagcatacc

SEQ ID NO: 63692 - protein, 117 aa, Zea mays
  misc_feature: Ceres CLONE 1532023
MFSMFGFFAQAIVTGKGPLENLADHLRRPRQQQRMGLCHQLCARQVRGWRRHRPPAHRCGYLCVRMPGERALDSGWCPVVNCPPRTSGFHPCKVVIVGACAKNLTTGVPLGVPGFTP

SEQ ID NO: 63693 - DNA, 723 bp, Zea mays
  misc_feature: Ceres CLONE 1532028
  misc_feature: Encodes the peptide sequence at SEQ ID NO. 63694
  misc_feature (637)..(637): n is a, c, t, g, unknown, or other
atagctggagctccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctggncgtgccaggtggtgctcatgggcgccgtcgaggggtaccgcatcgcccgtggcccgctcggggaggtggtcgacccgctgtacccc

SEQ ID NO: 63694 - protein, 184 aa, Zea mays
  misc_feature: Ceres CLONE 1532028
  misc_feature (58)..(183): Pfam Name: Chloroa_b-bind Pfam Description: Chlorophyll A-B binding protein
  misc_feature (156)..(156): Xaa is any aa, unknown, or other
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWXCQVVLMGAVEGYRIARGPLGEVVDPLYP

SEQ ID NO: 63695 - DNA, 774 bp, Zea mays
  misc_feature: Ceres CLONE 1532034
  misc_feature: Encodes the peptide sequence at SEQ ID NO. 63696
  misc_feature (298)..(298): n is a, c, t, g, unknown, or other
ccgctctagaactagtggatcccccgggctgcaggaattcgtctcacccctagaaaaagcctgatctccctcccaataagcacgtctgtttctccccagctccaagccggacgacgcagcgtagcagcagagagccagagaccagagatggccgccctcgccgccgcctccagggtcgccttcgccgcgaagccgcgcgcgcgcctctccgtggcctgctccgccgccaccggcgacggctgttgcgtgtcgctcgcggtctttcggaagaggtgcgtcggccgcgctggttctgtcncttggcttgctgaactccggcggccaattccccttcttttttttccccccccccccggcggggtagaaggggggttctttctcttccctacccttctctctcacccccccccaccagctcgtcttagcgcctcacggggggcggcgggggatcctccctttcggggggggcccccgccggccgctcgttaggcgcacgtcgtttcgtggcgcggccccccccgccccggcgacctccttcctggctcccgccgtcaccgcgctctctctcatccgcctcgtcttcagccgccgcccctagcggcccccctcccttcattctccggtgcttcgcgcgttcgctccacttcgccctcgcccttcctcccccccgcgctccttctctccgcccccatacctccgtacctccgcccccgccagcctgtcctgcttctctctcttccgactcggtctggtgtgtgctcgcctcgtcctctg

SEQ ID NO: 63696 - protein, 113 aa, Zea mays
  misc_feature: Ceres CLONE 1532034
  misc_feature (51)..(51): Xaa is any aa, unknown, or other
MAALAAASRVAFAAKPRARLSVACSAATGDGCCVSLAVFRKRCVGRAGSVXWLAELRRPIPLLFFPPPPGGVEGGFFLFPTLLSHPPPPARLSASRGAAGDPPFRGGPPPAAR

SEQ ID NO: 63697 - DNA, 780 bp, Zea mays
  misc_feature: Ceres CLONE 1532035
  misc_feature: Encodes the peptide sequence at SEQ ID NO. 63698
  misc_feature (13)..(13): n is a, c, t, g, unknown, or other
  misc_feature (756)..(756): n is a, c, t, g, unknown, or other
acaatggataganaaaagattctcgggtcttccttagacaccaatttataatcttatatataaaattggtactcaccgcggtggcggccgctctataatagtggatcccccgggctgcaggaattcgtctcacccctagaaaaatgctatccccgcccattcgtcaccagccaggtcccggaaccttatcaccaaatcctcacgtcatggcggccgcgctcttctccacctcgctctcgccccgcttccacgccctatcctccccgaagccggccgcgcccgcggcctcggccttcctccccttcacgctgccgctgcgctctgtgtcggcgccggcgccagcgaggcgaggctttccaacccgtttgacaccacggatgtcttccgaaataagggaacgaaagggcccgggaaacagcagggaagggggatttcccccaaaggacccccaagactgttcctccggaaaaccctgcccattcaagcgtcaaaaccccgacccaactaggcccgggcctcttttaaagcatgggagggtctccacccaaaaatgggtccaagggttttttatatacaaacacaaacaatttgggccagaaaaccccatggaaatatttgaaatctctgggaaaactcgtgctcttccaccctgaaaaaaaaacaccggggatgtggtgctcatgccaaaaccaatcctataaagggtgttatgatgaggggaaaggaaccccttgaatacgtgttttggaagaaaanaacaaacgtagttccttacattgg

SEQ ID NO: 63698 - protein, 148 aa, Zea mays
  misc_feature: Ceres CLONE 1532035
MAAALFSTSLSPRFHALSSPKPAAPAASAFLPFTLPLRSVSAPAPARRGFPTRLTPRMSSEIRERKGPGNSREGGFPPKDPQDCSSGKPCPFKRQNPDPTRPGPLLKHGRVSTQKWVQGFFIYKHKQFGPENPMEIFEISGKTRALPP

SEQ ID NO: 63699 - DNA, 750 bp, Zea mays
  misc_feature: Ceres CLONE 1532037
  misc_feature: Encodes the peptide sequence at SEQ ID NO. 63700
  misc_feature (39)..(39): n is a, c, t, g, unknown, or other
  misc_feature (52)..(52): n is a, c, t, g, unknown, or other
gaaaaacaaaatgtggtgcgtgtgacgtacttgccccanccccaccctaacnaaaaaacaggaactccccgcggtggcggccgctctagactagtggatcccccgggctgcaggaattcgtctcacccctagaaaaaagacgcaccccttcctcgtttcgccgcctccgccgacaccgactgcctacctcagctgccgtcgccatgggcagaaggcctgctagatgctatcgccagatcaagaacaagccataccctaagtccaggtactgccgtggtgtccctgaccccaagatcaggatctacgatgtcgggatgaagaggaagggtgttgatgagttcccctactgtgtgcaccttgtctcttgggagaaggagaatgtctccagtgaggcgctcgaggctgcccgcattgcctgcaacaagtacatgaccaagtctgcaagaaaggatgccttccaccttacgctccgggttcacccgttccatgtcctccgtatcaacaagatgctttcgtgtgctggggctgataggctccatactggaatgaggggtgcctttggccagccctcagggcaccctgtgctaagggtggacattgggccggggccctccttttcccgtggcaaagccaaggaacaaaccaatgcctgctacattgccccacccaaaaacctcctggcggttccccgcttaaaggtttccaacgttttccccttgggcccggcccacaaaaaaaatcctttttgga

SEQ ID NO: 63700 - protein, 182 aa, Zea mays
  misc_feature: Ceres CLONE 1532037
  misc_feature (5)..(151): Pfam Name: Ribosomal_L16 Pfam Description: Ribosomal protein L16
MGRRPARCYRQIKNKPYPKSRYCRGVPDPKIRIYDVGMKRKGVDEFPYCVHLVSWEKENVSSEALEAARIACNKYMTKSARKDAFHLTLRVHPFHVLRINKMLSCAGADRLHTGMRGAFGQPSGHPVLRVDIGPGPSFSRGKAKEQTNACYIAPPKNLLAVPRLKVSNVFPLGPAHKKNPFW

SEQ ID NO: 63701 - DNA, 615 bp, Zea mays
  misc_feature: Ceres CLONE 1532046
  misc_feature: Encodes the peptide sequence at SEQ ID NO. 63702
tggagctcaccgcggtggcggccgctctagaactagtggatcccccgggctgcaggaattcgtctcacccctagaaaaaaccataccgggatgggcgccatgggcatcgtcgtcagagcgtgggcgcctcccgctcttgccgccgcggccgcgccggcaccctccggctccagggacaccggtcaggcccagcggaggagcaagccctcgaggaccggccgcgtgcgcgtgctcggcggcactggccgtgtcggaggatccacggccaccgcactctccaaactccgccccaagcttggcatcctcgtcggtggcaggaaccgggagaaaggcgagtccattgcagccaagcttgggggccagtctgagttcgtccaggtcgacacccgcaacacaggcatgttggaggaagcgctgcagggtcagtatcatactagcagtcatgtggtagctgttcgcggagttgccaaaccggaggcagctgcgacgccggcgaggcgctcgcgccccatccctctggcttccgtggccgtgtggagtctggttgccactggcgccgcaaatgctgccgagctatgggaccccttggccctgcacggatcatcaggactcgtc

SEQ ID NO: 63702 - protein, 172 aa, Zea mays
  misc_feature: Ceres CLONE 1532046
MGIVVRAWAPPALAAAAAPAPSGSRDTGQAQRRSKPSRTGRVRVLGGTGRVGGSTATALSKLRPKLGILVGGRNREKGESIAAKLGGQSEFVQVDTRNTGMLEEALQGQYHTSSHVVAVRGVAKPEAAATPARRSRPIPLASVAVWSLVATGAANAAELWDPLALHGSSGLV

SEQ ID NO: 63703 - DNA, 772 bp, Zea mays
  misc_feature: Ceres CLONE 1532047
  misc_feature: Translation starting site: 223
  misc_feature (11)..(11): n is a, c, t, g, unknown, or other
  misc_feature (16)..(16): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
  misc_feature (51)..(51): n is a, c, t, g, unknown, or other
ttttttttttnttttnctcccccccacttnnnnnggangggggatnnntnntacacacgggactccccgcggtggcggccgctctagaactagtggatcccccgggctgcaggaattcgtctcacccctagaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccaaggacgtcttcggcgaggggcgcatcaccatgcgcaagactgctggcaagcccaagccagcggcgtccggcagcccctggtacggggccgaccgcgtcctgtacctgggcccgctgtccggccagcccccctcctaccctgaacggagagttccccggcgactacagctgggacaccgccggggctgtccgccgacccgcaaacttttgaccaagaaccgccgagctggaagggatccactgccccagggccccatctgggagcctctcgggagcatggacccaggaacagttccccccgcaaaggccaaacaatccccgaatcaagccctactggatataaggggccggggaccccaaattattcacaccaagggccggcgccttgaacccccttccgattaaaccccgacagcccaggaatccgcagctcctacaaatataaacctggtcccacatcttcgggcctcctcccccctcagcctgcgtctcctctaattgg

SEQ ID NO: 63704 - DNA, 646 bp, Zea mays
  misc_feature: Ceres CLONE 1532048
  misc_feature: Encodes the peptide sequence at SEQ ID NO. 63705
  misc_feature (284)..(284): n is a, c, t, g, unknown, or other
tggagctcaccgcggtggcggccgctctagaactagtggatcccccgggctgcaggaattcgtctcacccctagaaaaagtctgtatacctgtcactcacgctaccgccgtgaccgatcatctcccactctctcgtcagatcctctcggctagctagctagctaggacagaggagggaggggaaggcgctggctatggcgactgcggcggcggcggcggcggcggccatggaggagccgaacgtcgtcaacggccgcgacgtggtgagctgggtggcgtccggngtggtgctgtggtcgaccgccttcttgctggtgcgggcgctgttccccaagcgctcctacgacttctgcaaccgcgccgtctccaccatgcacgccgtcgccgccgtgtgcctcgcctgcctctccccccaccactggtcgtgccccgtctgcccgctcgccgccgcattctcccctcgccagatgaaggcgctggcggttacgctggcgtacatggtgtacgacgcggcgtgctgccccctcaaccgcgacacgcggctggaccacgcgtgcaccacctggtcagcatcgtcggcatccgcgcggggctcccctaccagaggtgccggacggaaaatgtggccagcatgctcgtgacggaa

SEQ ID NO: 63705 - protein, 148 aa, Zea mays
  misc_feature: Ceres CLONE 1532048
MATAAAAAAAAMEEPNVVNGRDVVSWVASGVVLWSTAFLLVRALFPKRSYDFCNRAVSTMHAVAAVCLACLSPHHWSCPVCPLAAAFSPRQMKALAVTLAYMVYDAACCPLNRDTRLDHACTTWSASSASARGSPTRGAGRKMWPACS

SEQ ID NO: 63706 - DNA, 652 bp, Zea mays
  misc_feature: Ceres CLONE 1532052
  misc_feature: Translation starting site: 139
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaattttcttttccaaaggaaaggtcttgcatattttctttgcaaggccactacactagaatcatgagttctgacgaaaagccctctgcagattgtatcctgttccgcgtgccatttgtagatgccccaccctttaccattcttttttcagacactgccattgttggagtgacagaaatcaatagcaattcgggagattactttgctccagaatacatttatgcgtaatgcgtgtcttcagacctgttgccatggttgtgattttttgacacatacataatgatgccctcttgaagtgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaataggcccgcaccgatcgcccttcccaacagttgcgcagcctgaatggcgaatggaaattgtaagcgttattattttgttaaaattcccgttaaatttttgttaat

SEQ ID NO: 63707 - DNA, 773 bp, Zea mays
  misc_feature: Ceres CLONE 1532059
  misc_feature: SWISSPROT Homolog: EC 2.7.1.20 Adenosine kinase
  misc_feature (1)..(1): n is a, c, t, g, unknown, or other
  misc_feature (2)..(2): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (34)..(34): n is a, c, t, g, unknown, or other
  misc_feature (50)..(50): n is a, c, t, g, unknown, or other
  misc_feature (230)..(230): n is a, c, t, g, unknown, or other
  misc_feature (291)..(291): n is a, c, t, g, unknown, or other
  misc_feature (362)..(362): n is a, c, t, g, unknown, or other
  misc_feature (363)..(363): n is a, c, t, g, unknown, or other
  misc_feature (366)..(366): n is a, c, t, g, unknown, or other
  misc_feature (403)..(403): n is a, c, t, g, unknown, or other
  misc_feature (410)..(410): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (434)..(434): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (522)..(522): n is a, c, t, g, unknown, or other
  misc_feature (637)..(637): n is a, c, t, g, unknown, or other
  misc_feature (773)..(773): n is a, c, t, g, unknown, or other
nnaaaatctnnnnctaaaaaaagaaaacaccccngtggcggccgctctanaacaaatggatccccccggctgcaggaattcgtctcacccctagaaaaaaattgccggaggagccacccaaaactctatcagggttgcccaatggatgcttcaaactcctggtgcaacaagttacatgggagggaggggaaaggacaagtttggtgaggaaatgaaaaaaaacgctcaanctgcacgaattactgctcattactacgaggatgagactgctcctactggcacatgtgctgnatgtgtttttggcggagaaagggcaataatttcaaatctgtcattttttactgttacaaatctaaacatcnncanattccttctccccccccacggggagaaggaagggggnttttttnttttttnnntttttccctaccccnaaaaaaaaaaaaatacccctcaccccccaaacatttctcnnncaaaaaaaaacataatcctcaaaaaacacaccactcccctcttctntaatatcaaacaaaaatccccaaaaaaattcccctcccctttctaacaaatttccttcaaaataattataaccaaacatattttctacctacttaaccaccacaacctcctcctnttcctacaacacactcttataatccccatcccccttctccccctttccccctacacacatataccactttcctttaaccccactccccttatccacacaaactctctcactaaaaaaaaaaatacaacataatacn

SEQ ID NO: 63708 - DNA, 631 bp, Zea mays
  misc_feature: Ceres CLONE 1532061
  misc_feature: Encodes the peptide sequence at SEQ ID NO. 63709
tggagctccccgcggtggcggccgctctagaactagtggatcccccgggctgcaggaattcgtctcacccctagaaaaagcaccccccattcgaacgccggatctcgacgatgacgaccgacgacccacgctgagatccggagtactgcaaattttgaaaaatgaactgtacgatggcgtcagcagcagctttcccgtgaggaaaatgtgtacatggcaaaactcgccgagcaggcggaaaggtacgaggagatggttgacttcatggacaaagtagccaagactgttgactcggatgagctcactgtggaggagcgaaacctcctgtctgttgcatacaagaacgtcattggagcccgccgcgcctcatggcgcatcatctcctccctccagcagaatgaggagggccgaggcaatgaggaccgagtaacactcatcaaggattatcgtggcaagattgagactgagctgaccaagatctgtgatggcatcctctagctgcttgagacccatcttgtgccgtcttccactgcccccgagtccaaggtcttctatctctcgatgaagggtgattactacagatacctcgctgagttcacgactggagctgagacaaaggactctgctgaga

SEQ ID NO: 63709 - protein, 94 aa, Zea mays
  misc_feature: Ceres CLONE 1532061
MAKLAEQAERYEEMVDFMDKVAKTVDSDELTVEERNLLSVAYKNVIGARRASWRIISSLQQNEEGRGNEDRVTLIKDYRGKIETELTKICDGIL

SEQ ID NO: 63710 - DNA, 687 bp, Zea mays
  misc_feature: Ceres CLONE 1532063
  misc_feature (53)..(53): n is a, c, t, g, unknown, or other
  misc_feature (183)..(183): n is a, c, t, g, unknown, or other
tcccgcggtggcggccgctctatactagtggatccccgggctgcaagaattcntctcacccctagaaaaataccaccgggtttctgtccgcgccccgcccttcaaagcaggtccgcacgccgggcggcgagaagagacgacacctccacgccgggacgggaggcacaggtgcggtctgcgtcnagagttggtccactggcacgcccgaatgaagaagtgcgcgtcggagctggagctggaggcgttcatcccggagagcggcgaggacgccccgcgccgccgccggaggtagcagtccggggtgcggtggatcaagcgatccccgaggggagcggcgtcttctcacccggcttccgtttccccgactcggagggcatggatggaaagcatttggtggtaccccccccctccggaaggcgaaacccattcttgtccgcaggcggggtcccttttccgctaaaccccgggttaacccccttcgtccgttcatgcttcttgaaaaggagtcaaaactccaaaagcgaaattcctgttttgagggtagaggggagttctttttttgagcgcgggttaccagactccctttggggacgcaacccaatataagaaagggaggggtggcccaaataaggggaagtcctggcccgcggcggtttttagggaggggaggaaaaccaggggctctat

SEQ ID NO: 63711 - DNA, 769 bp, Zea mays
  misc_feature: Ceres CLONE 1532068
  misc_feature: Encodes the peptide sequence at SEQ ID NO. 63712
aagctggagctccccgcggtggcggccgctctagaactagtggatcccccgggctgcaggaattcgtctcacccctagaaaaaactccaaccgccgagccagaagcacccggagcagcgcacagcatcagagcacacgccgcacaccgccgcctccgcagcatcagcaatggcgcgcgccggcactctctgcctggatgctgctctgcctcgtggccgcgcactcatccgctgcgcaaaagtccaccacagcctcggccgccgcgtcagccgctaccaccaccccgtcggggacaccaaccaagaagacgcccacacccacagccgcgccggctaccactccggccactctgcccccggcgaccccatgcccaaccacatcggccacatgagcggccatgagttggacgcccactacatcagccacaatgatgcccactgcggcgccgcccaagtcagcccccagagcgtgcccttctcgtggcccagcaaagggcaagtccagccatcgccggggccatgatggtctcggccgcttaacttctgccgccgccccctactttctgcccatgaagctccggtaaggtcccccggcccttaacgtccaaagaaaaaaaaaaaagccctttcctggaatccaaaagcaaattgaagaaaattaaaggtgccgggctccaacccccccaaattataattttcccctcaccccgcctggtgtccccaaagctaaaaaggcctttatctttcatgggaagcctcaaggttgctcg

SEQ ID NO: 63712 - protein, 64 aa, Zea mays
  misc_feature: Ceres CLONE 1532068
MLLCLVAAHSSAAQKSTTASAAASAATTTPSGTPTKKTPTPTAAPATTPATLPPATPCPTTSAT

SEQ ID NO: 63713 - DNA, 659 bp, Zea mays
  misc_feature: Ceres CLONE 1532071
  misc_feature: Encodes the peptide sequence at SEQ ID NO. 63714
acccgcggtggcggccgctctagaactagtggatcccccgggctgcaggaattcgtctcacccctagaaaaactctcgtccaaaaccctagcccttgcgccgccgcctcctccgccacccagcgctcgagctcctcgcgtcctgcgagcgcgcgccgcaacgccaccatgaagttcaacatcgcgaacccttccaccgggtgccaaaagaagctggaaatcgatgacgaccagaagctgcgtgccttttatgaccgaaggatatcccaggaggtcagtggtgatgctctgggtgaggagttcaagggttatgtcttcaagatcatgggtggatgtgacaagcaaggcttcccaatgaagcaaggagttttgacttctggtcgtgttcgtcttctgctccataagggcactccctgcttccgtggttatggccagcgtaatggtgagcgcacgaagaagtctgtccgtggttgcatcgtgagccaagacctatctgttatccacttggtgaattgtgaaaaaagggtgagaatgatctgcctgggtctgactgaaacctgaaaaagcccaaggaagaagggggccccaagaggggcctcccaagatccagaaaagctggtccaacccttaaacaaaggatgaaagaaaggacccccaagt

SEQ ID NO: 63714 - protein, 130 aa, Zea mays
  misc_feature: Ceres CLONE 1532071
  misc_feature (1)..(130): Pfam Name: Ribosomal_S6e Pfam Description: Ribosomal protein S6e
MKFNIANPSTGCQKKLEIDDDQKLRAFYDRRISQEVSGDALGEEFKGYVFKIMGGCDKQGFPMKQGVLTSGRVRLLLHKGTPCFRGYGQRNGERTKKSVRGCIVSQDLSVIHLVNCEKRVRMICLGLTET

SEQ ID NO: 63715 - DNA, 625 bp, Zea mays
  misc_feature: Ceres CLONE 1532089
  misc_feature (213)..(213): n is a, c, t, g, unknown, or other
  misc_feature (214)..(214): n is a, c, t, g, unknown, or other
  misc_feature (252)..(252): n is a, c, t, g, unknown, or other
  misc_feature (253)..(253): n is a, c, t, g, unknown, or other
  misc_feature (270)..(270): n is a, c, t, g, unknown, or other
  misc_feature (271)..(271): n is a, c, t, g, unknown, or other
  misc_feature (389)..(389): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (424)..(424): n is a, c, t, g, unknown, or other
  misc_feature (427)..(427): n is a, c, t, g, unknown, or other
  misc_feature (428)..(428): n is a, c, t, g, unknown, or other
  misc_feature (469)..(469): n is a, c, t, g, unknown, or other
  misc_feature (494)..(494): n is a, c, t, g, unknown, or other
aaagctggagctccccgcggtggcggccgctctagaactagtggatcccccgggctgcaggaattcgtctcacccctagaaaaaaccgtagcccccgaagacacactccaagataccaagaacaccggccacacgcacgcgcgcgcgcaccgacgcacggcaggcgaggccgaggacgaacacacgataaaggaagcaatggctccgtcgctnncgcgtcagacgagcggggtctttcccgaagctgcgcgnngccgccgggcccggccnnggggcgggccgggtgcgtggccccgcccgccccgtccgcgggttgcgggcttccgggcgaacgggcgaccggcgaaaacgggggggagaaaaaaaaaaaaaaaaaccccccccccccnactttccaannnnnnnannnnnnnnnnannnnngnaannaaaaaaaaaaaaaagaggtgctccccccccccgcggggggnttttttctctcccccgggcgggggncggggccggccgcccttttcgactacactccttgtcctaccttcccgcgccgccgcgggatgggccgcggcggcgaggcgcccgtctcgcgggcgccgcgcggcgcggtttaccgccgcggcgttcctcga

SEQ ID NO: 63716 - DNA, 627 bp, Zea mays
  misc_feature: Ceres CLONE 1532095
  misc_feature: Translation starting site: 235
cgcggtggcggccgctctataactagtggatcccccgggctgcaggaattcgtctcacccctagaaaaatttctccgattaggctatggcgtcttcttcgccgctcgcggactgcggactggttctgcggaccgaagggtttctgtttcttcgcccccggcgacggcagggatgacctattcctccgctgttcctccgtcaggtcctacggctaccgcactcttagcgacggcgatgccgtcgaatacaccgtcggttgcgctaatgactgccgcgccaaggccctccttgtcaccgcgccccgccgcggcccgcttggcggcgcgcaacgtgccgaccgtggtgaccgcggtagtcgatgcggatcccgcggcggagaccgcggattcttgtggcggcagtgacctctcctgacgggagaccaggcgaccgtgtctacatcactggcgaccgtggctcctgagaaggagacaaccgcatctcggtcggtgactgtgaatcctatggacccgttggattttacgctgcccaccgaggatctggtgatgaagacgatgcgtgttcttttgagccttccctggcaggacccggattcctggactattgaccaggacgtggtatgcggag

SEQ ID NO: 63717 - DNA, 604 bp, Zea mays
  misc_feature: Ceres CLONE 1532097
  misc_feature: Encodes the peptide sequence at SEQ ID NO. 63718
tggcggccgctctacaactagtggatcccccgggctgcaggaattcgtctcacccctagaaaaaaccccatcgcacgcactcctcatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtccgccaagatcctggagctcggggacgccatcgccgggctcacgctcgaggaggcccgcagcctcgtcgaccacctccaggagcggctcggcgtcaccgccgcggccttcgcgccggccgccgacttcgcggcgcccggagcgggcggtggggccgcgcccgaggaggatgcccccgtcgaaaacacggatgtccacgtgatgatagaaaaggtggccagcagcgcgccggaccggccctattgaagtggtgcgcgcggtttacaagcccctcatctcagaga

SEQ ID NO: 63718 - protein, 132 aa, Zea mays
  misc_feature: Ceres CLONE 1532097
MASTTLSSAFTLLSRPSTSPCPAASLPRSSHAAPHIRRGRRAVAVACTATESAKILELGDAIAGLTLEEARSLVDHLQERLGVTAAAFAPAADFAAPGAGGGAAPEEDAPVENTDVHVMIEKVASSAPDRPY

SEQ ID NO: 63719 - DNA, 723 bp, Zea mays
  misc_feature: Ceres CLONE 1532098
  misc_feature: Encodes the peptide sequence at SEQ ID NO. 63720
  misc_feature (5)..(5): n is a, c, t, g, unknown, or other
  misc_feature (18)..(18): n is a, c, t, g, unknown, or other
  misc_feature (42)..(42): n is a, c, t, g, unknown, or other
  misc_feature (50)..(50): n is a, c, t, g, unknown, or other
cttgnaaattttcggtcnccacccaccaccacctatttaaanggtgagtnttttaaaaactggagctccccgcggtggcggccgctctattaatagtggatcccccgggctgcaggaattcgtctcacccctagaaaaagtgtcaacgagctcaagcacagcaaatatctcccgtcgtccgggtcgctcagcaaaaaccccatccaattccaaacaactcctctcgccatttcaccaccgcggcaccgcctcgccccatcctctccccctcccgtcgcgccagtcaacagcctgtctgcctcttccctcgccacccatggccaccgtagcgcgcaccctcgtcgccgcatgcccggcacggtctctcctccgcctccggtctcggcgcctcccgtcctcctcttccatccgtcccgcggcggaacgtgccggcgtcgggtctgtccgctgcatggctcggcgaccggattcctcctattccccgctgcgttcaggggcatggcggtgaccgagcaccgactgaaatggcgccgcctgttccctgaatgcaaataccaaaaattggcaaatcgtcatgagacaaccccgggggggcgaagggcccccaaccaaacaagaaaaaagaaatgaaattgactaaacctccaaaaaccccttggcccccagatttcgcttaggggaagttggaaagaagggaagcgccccaaacaaaaataaaattat

SEQ ID NO: 63720 - protein, 63 aa, Zea mays
  misc_feature: Ceres CLONE 1532098
MATVARTLVAACPARSLLRLRSRRLPSSSSIRPAAERAGVGSVRCMARRPDSSYSPLRSGAWR

SEQ ID NO: 63721 - DNA, 717 bp, Zea mays
  misc_feature: Ceres CLONE 1532105
  misc_feature: Encodes the peptide sequence at SEQ ID NO. 63722
ggagctccccgcggtggcggccgctctagaactagtggatcccccgggctgcaggaattcgtctcacccctagaaaaaaaccggccacatccttcaccggtggcggcggccatttctggcggccaggcctcgtcggcccctgcgcgggtgcggcctcgacgggcacgcggccccggcgctgacggcgcggcggctccgatggcgcggccatggcggcgcgagcacagggccacacgctcccggctcctggcggcgcgtggtggccaggctcgacgcgggcgctcggcctggtgcggccccaggccccgacggctcgggtgtggcccctgtagcacgacgcggcagcctcctgtcgcggcgcgggcgctcagtcccctcgggcgcgcggtggcgggcgggcgcgccccccggtggcgtttcggccaggccctcggccagggcgcgccttccccgaccccgacagtatgggcgcgcgaccccgacggcatgggtgtagccgcggcggccctagcgacgccatccccggtgcgggccccatgggcggctcgggcgcggccccggtgggcacaagccccagcgcttggccgcgcgggcacgcgggcgtgaatcccggcggcgcacggctatggcagcatgggcgcggcccatgcccaggcgcacagccccggcagcggcgacagatttgccgcatgcgtggcccgcggtgtgcatttcgct

SEQ ID NO: 63722 - protein, 135 aa, Zea mays
  misc_feature: Ceres CLONE 1532105
MARPWRREHRATRSRLLAARGGQARRGRSAWCGPRPRRLGCGPCSTTRQPPVAARALSPLGRAVAGGRAPRWRFGQALGQGAPSPTPTVWARDPDGMGVAAAALATPSPVRAPWAARARPRWAQAPALGRAGTRA

SEQ ID NO: 63723 - DNA, 649 bp, Zea mays
  misc_feature: Ceres CLONE 1532107
  misc_feature: Encodes the peptide sequence at SEQ ID NO. 63724
  misc_feature (649)..(649): n is a, c, t, g, unknown, or other
cgggctgcaggaattcgtctcacccctagaaaaaaagcctaatccccacgaaaaccctaaaccctcgctacccggcggcggctacaagctcttcgtcggctcagcaccatgaggccaccggctagaggaggacgtggtgggaggggaggcaggttcgatggcggcggccgtgggggcggcggcggcggccgtgggtttggcggtggtagaggcgggagaggggacaggctcgggagaggtggcatgacccccagacgcggccgtggcggcggtggcaagggtggacgcttcggtggcatgagaggcgcggacaaggcccgtcttggtggcacaccagcacgcccggtgtcttcctctccaagctccccccacgatgcgcctctgaaacaagaacattgggtccccgggaaaatcccttgctaccgccgagcaaccgggctccccgggtcttaaatgagggcatggtaccccgcggtccaaatactcgggtggtggaaacccctttcccgtatccaaccttgggctgcctgcctggtgctttgctgggggtttcacccccttcctgggatttgtcccctgtggacccccgggggtctgtgatcttgggagcctgcctccttggcgccccccgcccctcctccccttcttn

SEQ ID NO: 63724 - protein, 114 aa, Zea mays
  misc_feature: Ceres CLONE 1532107
MRPPARGGRGGRGGRFDGGGRGGGGGGRGFGGGRGGRGDRLGRGGMTPRRGRGGGGKGGRFGGMRGADKARLGGTPARPVSSSPSSPHDAPLKQEHWVPGKIPCYRRATGLPGS

SEQ ID NO: 63725 - DNA, 618 bp, Zea mays
  misc_feature: Ceres CLONE 1532116
  misc_feature: Encodes the peptide sequence at SEQ ID NO. 63726
tggagctccccgcggtggcggccgctctataactagtggatcccccgggctgcaggaattcgtctcacccctagaaaaaaacgtgctcgatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacgccggcaagtcggagtacttcgcgtcgtcgtcgacgctgttcgtgatcgagttcatcctgtttcactacgtggagatccggcggtggcaggaca

SEQ ID NO: 63726 - protein, 160 aa, Zea mays
  misc_feature: Ceres CLONE 1532116
  misc_feature (62)..(160): Pfam Name: Chloroa_b-bind Pfam Description: Chlorophyll A-B binding protein
MASVTARAPVAALRPSASLKSSSSSAAAFLGHSSRLGRTATASPTRRSLKAEAKGEWLPGLPSPAYLDGSLPGDNGFDPLGLAEDPENLRWYVQAELVNGRWAMLGVAGMLIPEVLTKAGLINAPQWYDAGKSEYFASSSTLFVIEFILFHYVEIRRWQD

SEQ ID NO: 63727 - DNA, 724 bp, Zea mays
  misc_feature: Ceres CLONE 1532120
  misc_feature: Encodes the peptide sequence at SEQ ID NO. 63728
  misc_feature (486)..(486): n is a, c, t, g, unknown, or other
  misc_feature (609)..(609): n is a, c, t, g, unknown, or other
  misc_feature (670)..(670): n is a, c, t, g, unknown, or other
  misc_feature (671)..(671): n is a, c, t, g, unknown, or other
  misc_feature (673)..(673): n is a, c, t, g, unknown, or other
  misc_feature (674)..(674): n is a, c, t, g, unknown, or other
ggagctccccgcggtggcggccgctctagaactagtggatcccccgggctgcaggaattcgtctcacccctagaaaaaatgcaatcgcggagctacctcagctgccgtgtcctgctcagcaagcaatcaagatcgatggggcggtcgccctgctgcgagaaggcgcacaccaacaggggcgcgtggaccaaggaggaggacgagcgcctggtggcctacatccgcgcgcacggcgaagggtgctggcggtcgctacccaaggcggcgggcctgctgcggtgcggcaagagctgccggctgcggtggatcaactacctccggcccgacctgaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacgtccggcggaagctgctnggcaggggcatcgaccccgtcacgcaccgccccatcgccgccgacgccgtgaccgtgaccaccgtctcgttccagcccagccccagcgcccgccgcgcagcagcagcagaagcggaagcgacngccgccaaggcgccagatgccccgacctcaacctcgacctctggatcagcccgcgtgccannannaggaaggagaagaggtggacctcagccctcgcccccgtcgcaagggggag

SEQ ID NO: 63728 - protein, 196 aa, Zea mays
  misc_feature: Ceres CLONE 1532120
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature (179)..(179): Xaa is any aa, unknown, or other
  misc_feature (180)..(180): Xaa is any aa, unknown, or other
MGRSPCCEKAHTNRGAWTKEEDERLVAYIRAHGEGCWRSLPKAAGLLRCGKSCRLRWINYLRPDLKRGNFTADEDDLIVKLHSLLGNKWSLIAARLPGRTDNEIKNYWNTHVRRKLLGRGIDPVTHRPIAADAVTVTTVSFQPSPSARRAAAAEAEATAAKAPDAPTSTSTSGSARVPXXGRRRGGPQPSPPSQGG

SEQ ID NO: 63729 - DNA, 807 bp, Zea mays
  misc_feature: Ceres CLONE 1532124
  misc_feature: Encodes the peptide sequence at SEQ ID NO. 63730
  misc_feature (47)..(47): n is a, c, t, g, unknown, or other
  misc_feature (807)..(807): n is a, c, t, g, unknown, or other
ttttttggatgaattttaatatctacacctttccatactcaaaccanccgaaaaacggagctccccgcggtggcggccgctctattactagtggatcccccgggctgcaggaattcgtctcacccctagaaaaaaccctagccgcactgcgctcatttctgcatccccctcccgccgcgccgcctcaccgccgccggagaagatgggtcgcgtgatccgcgcgcagcgtaagggtgcggggtccgtgttcaagtcccacacccaccaccgcaagggccccgcccgcttccgctccctcgacttcggcgagcgcaacgggtacctcaagggcgtcgtcaccgacgtcatccacaaccctggacgtggcgcgccgctcgtcaaaggtcacttttcgccacccatttcggtacaagcttccaaaaggagcttctttgtcccagctcgagtacattgtacaatggcacaattccatctaacttgaggactacacgttcccccttcctccattcggaaaacatagcttgccccatccccgcggtaattcccttgaaggggggcctgatcatctttgtgactccacaaacatccacaactaagatataaaattcgtatgttttcctcctcacaagcccatttatgaggaaatttacccccccttcgcggacctacaacccccaaacccccttgaaaaacatgttattactcccatagaaataaaatttctgtccccatccgggcgaccctcaaaataataattggtcaccccctaccccacgtcaccaggtcgccacatcgcattataagtan

SEQ ID NO: 63730 - protein, 92 aa, Zea mays
  misc_feature: Ceres CLONE 1532124
  misc_feature (11)..(84): Pfam Name: Ribosomal_L2 Pfam Description: Ribosomal Proteins L2, RNA binding domain
MGRVIRAQRKGAGSVFKSHTHHRKGPARFRSLDFGERNGYLKGVVTDVIHNPGRGAPLVKGHFSPPISVQASKRSFFVPARVHCTMAQFHLT

SEQ ID NO: 63731 - DNA, 709 bp, Zea mays
  misc_feature: Ceres CLONE 1532126
  misc_feature: Encodes the peptide sequence at SEQ ID NO. 63732
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (15)..(15): n is a, c, t, g, unknown, or other
  misc_feature (39)..(39): n is a, c, t, g, unknown, or other
nnnnnnnaaattttnaaataaaagcgtgaaaagaccaanatatctctcctctttttttttaaaactgggagctcccgcggtggcggccgctctacaatagtggatcccccgggctgcaggaattcgtctcacccctagaaaaatttttccccttcgcgtatcttcgtccgccgcaacccttcacgtatcgtctctctctcacacggtcacaccctgacctcccccatccccctcccagaaaagacccctcgaaaaacggcggcgctgcgacatggcggaggtcgaggctccagctactgcggtcgaggctccagctgctgcggtcgcgacgacgacccctgaggtggcggcgcccgaggccggagccgctacggaggcgaagggtccgcacaagcttcaccggcagtggaccttctggtacgacatccagacgaagaccaagtccggggctgcgtggggcacctccctcaaaaaggcctacaccttcgacaccgttgaggagttctggagcatgtatgatcagatttttcgtccaagcaagttgtctgggagagctgattttcatctattcaaagcctggagtagagccaaaatggggaagacccagaagtgcgcaaaatgggggagcaaatgagactgttccccatggcaaacagaaaaaggcaaacccttttgaagaaccatggtgggccttggaaaacggttgaaa

SEQ ID NO: 63732 - protein, 120 aa, Zea mays
  misc_feature: Ceres CLONE 1532126
  misc_feature (14)..(115): Pfam Name: IF4E Pfam Description: Eukaryotic initiation factor 4E
MAEVEAPATAVEAPAAAVATTTPEVAAPEAGAATEAKGPHKLHRQWTFWYDIQTKTKSGAAWGTSLKKAYTFDTVEEFWSMYDQIFRPSKLSGRADFHLFKAWSRAKMGKTQKCAKWGSK

SEQ ID NO: 63733 - DNA, 728 bp, Zea mays
  misc_feature: Ceres CLONE 1532129
  misc_feature: Encodes the peptide sequence at SEQ ID NO. 63734
  misc_feature (50)..(50): n is a, c, t, g, unknown, or other
ggaaagccggtgtattacggccaaatcagaaaccaccaacaaccccaacntttaaaaatggtactccccgcggtggcggccgctctagaactagtggatcccccgggctgcaggaattcgtctcacccctagaaaaactactaacccactgatgggaacgtcaagagaaagctggctattgctgcgaagggtttaacttttgacagtggtggctacaacattaagaccgggccaagctgcatcatccagctgatgaaatttgacatgggaggctctgctgctgtatttggtgcagctaaagctttggcacacatcaagcctcctggagtacaggttcactttaaagacgctgcctgtgaagatatgatcaatggaacacgcctcacgcccggtgaccttgtaactgcttccaatgtgaagaccattgaggatcataacactgacactaaaggaaggataacacttgcccatgctttggtctatgcctgcaaccacggtggatgaacagattattgatttgggaaagcaagaccggacacttgcgattgtcccacctcaaaccctaacaattaccgagaattgtcacggcacaaccgattaccttgcgcaaccctggtgccccctgtctccccgagttatcgcctgatccccttctagccacactgtccctttggaacatacaagctaccgccaacctctttataaaatctggccttggactaaaattt

SEQ ID NO: 63734 - protein, 83 aa, Zea mays
  misc_feature: Ceres CLONE 1532129
  misc_feature: SWISSPROT Homolog: EC 3.4.11.1 Leucyl aminopeptidase
MKFDMGGSAAVFGAAKALAHIKPPGVQVHFKDAACEDMINGTRLTPGDLVTASNVKTIEDHNTDTKGRITLAHALVYACNHGG

SEQ ID NO: 63735 - DNA, 690 bp, Zea mays
  misc_feature: Ceres CLONE 1532130
  misc_feature: Encodes the peptide sequence at SEQ ID NO. 63736
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (42)..(42): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nnncccccttgttgtgctttaattatatctttccttccaacnccaccaaannntaaaactggagctccccgcggtggcggccgctctattactagtggatcccccgggctgcaggaattcgtctcacccctagaaaaagagacgagatccattcccaacttcagctgcgcctcgactcgtagcccgaaccctagccaccaagccggaggcgagagagcagccatggcgcggtgcctcgcgctcgtcgccctcctcgtactcggcctcgccgccgccgccgcctccgcggccgacgcgcccttcgtcgtcgcgcacaagaagatttcgctctcccgccccaagccgggcgtcgagcgcgtcgccgtctccctcgacctctacaaccagggatccgcgactgcctatgatgtgtccattaatgacgactcttggccaacagaagtgtttgagcttgtcactggagagacccccaatatattggaaaggcttgaccctggtgccactgcttcacacacatatgtcctggaaaccaaaacacagggcaggttccagggttcaccagctatcattacataccgtgttcccacgaagacagctcttcaggaggcatactctactcccatcttgccactggaaattctcgctgagagaccctccgagaagaagtttgaatgggctaagaggcttgtg

SEQ ID NO: 63736 - protein, 156 aa, Zea mays
  misc_feature: Ceres CLONE 1532130
  misc_feature (10)..(155): Pfam Name: TRAP_beta Pfam Description: Translocon-associated protein beta (TRAPB)
MARCLALVALLVLGLAAAAASAADAPFVVAHKKISLSRPKPGVERVAVSLDLYNQGSATAYDVSINDDSWPTEVFELVTGETPNILERLDPGATASHTYVLETKTQGRFQGSPAIITYRVPTKTALQEAYSTPILPLEILAERPSEKKFEWAKRLV

SEQ ID NO: 63737 - DNA, 745 bp, Zea mays
  misc_feature: Ceres CLONE 1532134
  misc_feature: Encodes the peptide sequence at SEQ ID NO. 63738
  misc_feature (17)..(17): n is a, c, t, g, unknown, or other
  misc_feature (745)..(745): n is a, c, t, g, unknown, or other
gatggtgccgggcgggngctccgggcgcgcaccccccatcacaataataaaactggaactccccgcggtggcggccgctctagaactagtggatcccccgggctgcaggaattcgtctcacccctagaaaaatagctagtccttgcccagatactagggcaaagaaggctttggggttccccggagaagtcattaacagcaatcaacttgtgaggcgaacaatagacagtaatttgatccttaaagtcttcattgccaactctgctcgtgttgtggaagacattggttcggagtttgtagccttgagccgttacgggcttaatatagtgattggtaaccaaataattagaggtgtacgaggattgtcacaggatccatatccgtgttactagttttaagatgtttcatttcaagttctctagattactgatcgatttttttttctctcctaatgacgctaggaacaggcagtagttcctttctgtcagttgaatgcacacttctctgtgttgaatatcaacttggaaggatgtgtcagccctgcttgagaaccccgaaattatcttatatttcgaattcttatttatcattcataaaaaaaaacaaaacgaagatgctcggagggtacccaaattccccccctataataaaagtcgtaatttaccccgccgcctctctggcttcgtcggttttcaacccacgctccttgtacttggccaaaaaacccctgggccgtctaccccan

SEQ ID NO: 63738 - protein, 41 aa, Zea mays
  misc_feature: Ceres CLONE 1532134
  misc_feature (6)..(6): Xaa is any aa, unknown, or other
MVPGGXSGRAPPITIIKLELPAVAAALELVDPPGCRNSSHP

SEQ ID NO: 63739 - DNA, 646 bp, Zea mays
  misc_feature: Ceres CLONE 1532135
  misc_feature: Encodes the peptide sequence at SEQ ID NO. 63740
ggatcccccgggctgcatgaattcgtctcacccctagaaaaaacgcggcgtctttgggtgagcacacctcgtggtttctggaggggcaaacaagcttgctactgtgatttctcgcccgagaatggggagaggaaaaagacagagcgtgggcgagcacctggaggagcctgtgccggagtctgtgatggacaagatcaccgagaagttccacggcggggactcgtcgtcgtcgtcgtctgactcggaggaccagaagaaggggtcctcgttggcgttggcggctgaagccatgaaggccaagatctaccgccttttcggccgggataggccattcttctccgtgctcggcgggggcgtgcctgccgatcttatcccatggagggacttgaagaagtctgggggggaacttgctgttgcaacagtcatctggctccttttaaaggccatgggataccatctcctcacctttggggtgccaattgtcccgtccctctcggatgggcatccccctttctgcgggccaaaggaggcccgctttcggtcattaaagttttccctctgtacacttgtcgagaaggtccaaaagcccccccaataaataatggcctgcctaattccctcaacctcgtggacaagagaagcattg

SEQ ID NO: 63740 - protein, 158 aa, Zea mays
  misc_feature: Ceres CLONE 1532135
MGRGKRQSVGEHLEEPVPESVMDKITEKFHGGDSSSSSSDSEDQKKGSSLALAAEAMKAKIYRLFGRDRPFFSVLGGGVPADLIPWRDLKKSGGELAVATVIWLLLKAMGYHLLTFGVPIVPSLSDGHPPFCGPKEARFRSLKFSLCTLVEKVQKPPQ

SEQ ID NO: 63741 - DNA, 749 bp, Zea mays
  misc_feature: Ceres CLONE 1532136
  misc_feature: Encodes the peptide sequence at SEQ ID NO. 63742
  misc_feature (518)..(518): n is a, c, t, g, unknown, or other
  misc_feature (519)..(519): n is a, c, t, g, unknown, or other
  misc_feature (527)..(527): n is a, c, t, g, unknown, or other
  misc_feature (577)..(577): n is a, c, t, g, unknown, or other
  misc_feature (608)..(608): n is a, c, t, g, unknown, or other
  misc_feature (702)..(702): n is a, c, t, g, unknown, or other
  misc_feature (749)..(749): n is a, c, t, g, unknown, or other
ctggagctccccgcggtggcggccgctctagaactagtggatcccccgggctgcaggaattcgtctcacccctagaaaaagtcagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaagcgaccggnngagccatncagcactcgctggggcagtcccacccggtgcgcctggtgccctacacccnggacttcctggacgagtcggtgctgtggacngagagccgcgacgtcggcaacggcttccgctgcgtccgcatggtcaacaacatctacctcaacttcgatgccctcccacgcgacaagtggcacnggcgcgtccgtgaacgcccaacgtcgtgctctggaagtggtgcaagn

SEQ ID NO: 63742 - protein, 192 aa, Zea mays
  misc_feature: Ceres CLONE 1532136
  misc_feature (116)..(116): Xaa is any aa, unknown, or other
  misc_feature (119)..(119): Xaa is any aa, unknown, or other
  misc_feature (136)..(136): Xaa is any aa, unknown, or other
  misc_feature (146)..(146): Xaa is any aa, unknown, or other
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNKRPXEPXSTRWGSPTRCAWCPTPXTSWTSRCCGXRAATSATASAASAWSTTSTSTSMPSHATSGTGASVNAQRRALEVVQ

SEQ ID NO: 63743 - DNA, 868 bp, Zea mays
  misc_feature: Ceres CLONE 1532138
  misc_feature: Encodes the peptide sequence at SEQ ID NO. 63744
  misc_feature (1)..(1): n is a, c, t, g, unknown, or other
  misc_feature (17)..(17): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (59)..(59): n is a, c, t, g, unknown, or other
  misc_feature (349)..(349): n is a, c, t, g, unknown, or other
  misc_feature (438)..(438): n is a, c, t, g, unknown, or other
  misc_feature (868)..(868): n is a, c, t, g, unknown, or other
ntggtggatatcctccnccgnnnnnnnaaggcataannnnggaaaacaggaactcaccncggtggcggccgctctagactagtggatcccccgggctgcaggaattcgtctcacccctagaaaaaatccaagctcaaagcaagcagatctaagctccaggcagcgtcgcgacagagtgagctagtgagtagcacgacaacaacaatgggtgcggtgaaggccgcgaagcccagcggagttgcggcgcagggcaaggagccggcgcccaagctcaccgagacggcgacgaagccgtcagccgctaagagcggcggcgttaaaaatgtgacccgagggggcggggaaccanaaggaaggtgatttattaccaacaggcggagggtgtcaaaattttttttttttccccccccccggggggagagaagggggggaatattntatttatttcctttcccccccccccttaatttaacaaaaaaaaaaacatattatcttttcccggggggggggcgggtgagcgcatccccggccagcggccgcgaggatccgcccggatgaggcccctaccgaaacaacagctcggctggacgaccgccgttgggccctagctgtctacgaccaccgagcgccagtagggtactaactcctagcccgcccttgaggcgcgacgtgatacatggccggctacggcaccccgctggatggggtgtctactctggtggagtatccctcccacgccttactaaggctccgtcaaccccctcctcgccgctccggcccccgagtgcccgcgagtacctaccagtatcgccccgtctgggcgcgtcgccgtcccgatccgcacgtgtcatctgaatccgcctgcccn

SEQ ID NO: 63744 - protein, 51 aa, Zea mays
  misc_feature: Ceres CLONE 1532138
  misc_feature (49)..(49): Xaa is any aa, unknown, or other
MGAVKAAKPSGVAAQGKEPAPKLTETATKPSAAKSGGVKNVTRGGGEPXGR

SEQ ID NO: 63745 - DNA, 685 bp, Zea mays
  misc_feature: Ceres CLONE 1532140
ggatcccccgggctgcaggaattcgtctcacccctagaaaaacaatagttgtcatgtggtatgaaacgatcgctttgtggtggtcatcacaccatgctggtgatcatcacaacatatgctgatactgttccggacaatcggctagaatttgttgtgtggcaggtataaacgtcagcatgctcgatagtgagagcactcggttacttctacagatggtatttaaggggtgatagtcacgcctctttgctggataatttcaattggattctggactcctgttctgttacatcccgttggggattttgtttgcctgcccaaacttttaaacatttccgcattaaacccgaaaaaggggttaccttggaaaaaaaaaaaataataaaaaccccaaaacgcctccgatgggtaaccccaattttccgccccccatattaactcgcgggggtccccccatatatttttaaaatcgcgcccgcccccctaaccctggggcacccaccccctttttttttttataacaaacctttccctggtaaaccgggggtaaaaaaacaccccccctctggggggggtttttccccccccctctagctttttttaattatcccccccctcttatggaccacgatacccacactcttcccctccccccctcatctttttctcctcccctccccccccctct

SEQ ID NO: 63746 - DNA, 653 bp, Zea mays
  misc_feature: Ceres CLONE 1532141
  misc_feature: Encodes the peptide sequence at SEQ ID NO. 63747
  misc_feature (570)..(570): n is a, c, t, g, unknown, or other
  misc_feature (592)..(592): n is a, c, t, g, unknown, or other
atagctggagctccccgcggtggcggccgctctagaactagtggatcccccgggctgcaggaattcgtctcacccctagaaaaaaattcgggcctggcaaggctggcatgccgtcggcctccctagctcgccgcctcctctctactattatatcatctccaccgatctcttcacgcagtaccagcaccagcgccagcaacagcaacagctgtggttttagcacaagaaggacgaggaagaagcgcagctgcgtttcttggacggtgagcgcggctactccggcggacatggcgaccaacagtgccctggcgaagctggcgccgctggaagccatcctgttcgacatcgacggcacgctctgcgactccgaccccatccacttctgcgccttccgagagctcctgcagcaggccggcttcaacggcggtgtccccatcacggaggagttctacagcgccaacatcagcgggggccacaacgacgacctcgccaggtcgctgttcccgggcatggatcaccagaaggcgatgcggttcatggatgataaagaagcccgtggatgggctgcangagctgtgcggatggatggaanggcgcgacatgaagcgcgcggcggtgacgaacgcccgagggcgaacgccgagctgatgctg

SEQ ID NO: 63747 - protein, 122 aa, Zea mays
  misc_feature: Ceres CLONE 1532141
  misc_feature (95)..(95): Xaa is any aa, unknown, or other
  misc_feature (102)..(102): Xaa is any aa, unknown, or other
MATNSALAKLAPLEAILFDIDGTLCDSDPIHFCAFRELLQQAGFNGGVPITEEFYSANISGGHNDDLARSLFPGMDHQKAMRFMDDKEARGWAAXAVRMDGXARHEARGGDERPRANAELML

SEQ ID NO: 63748 - DNA, 633 bp, Zea mays
  misc_feature: Ceres CLONE 1532144
  misc_feature: Translation starting site: 378
  misc_feature: SWISSPROT Homolog: EC 3.2.1.23 Beta-galactosidase
  misc_feature (409)..(409): n is a, c, t, g, unknown, or other
  misc_feature (410)..(410): n is a, c, t, g, unknown, or other
ggagctccccgcggtggcggccgctctagaactagtggatcccccgggctgcaggaattcgtctcacccctagaaaaacaaaagaggaaaggcttgcggtggatacctaggcacccagagacgaggaagggtcagatgggcagtgggaggaggcgatgaaggttgaaccataggatgaccggcaaggtttctgaatttcttgtagatccatgtttcgacaaagacaaagcttgctactgttttactagtgtttcgacaaagtttaagtttgccattgtgttttactagtgtttcctgcggatccatgtttcgataaagacaaagcttgacattgtgtttccatagacactcaaattcacatattttagtaattcctgatgagcaattatgctcttggatggaaaaaaannaaaaaaaaaaaaaaaaaaaaaaaaaaaaaaaaaaaaaaaaaaaaaaaaaaaaaaaaaccgagacgctcgaggtacccaattccccctatagtgagtcgtattacgcgcgctcactggccgtcgttttacaacgtcgggactggaaaaaccctggcgttacccaacttaatcgccttgcagcacatccccctttcgccagctggggtaataccgaaaaagcccg

SEQ ID NO: 63749 - DNA, 715 bp, Zea mays
  misc_feature: Ceres CLONE 1532153
  misc_feature: Encodes the peptide sequence at SEQ ID NO. 63750
  misc_feature (379)..(379): n is a, c, t, g, unknown, or other
  misc_feature (381)..(381): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (693)..(693): n is a, c, t, g, unknown, or other
tccccgcggtggcggccgctctagaactagtggatcccccgggctgcaggaattcgtctcacccctagaaaaaatcagctaagatagctgcaaaacaagcgagttacttacaaccaaacagaagggtagaaaccacctgaagccatgtgcattgctgcatggatttggcaggctcaccctgtgcaccaactcctcctgcttctcaacagagatgagttccacagcaggcctacaaaagcagtaggatggtggggtgaaggctcaaagaagatccttggtggcagggatgtgcttggtggaggaacatggatggggtgcaccaaggatggaaggcttgccttccttattatcccctccaaccggaggaagaagggggtgnancgactannnnatatctccctctcaaattcctgcaaaacaacaagagcccactcaaagttgcaactgaattggcaaataaaactcaaaaaatacactggcttcaaacccctactacctgatccaacaacaaatatccgggcttatggggcaaaccgcgcctacggccaccctccacaattcacccccggtcacccgaacccttgcactttccaatacaggccaaaaatcacccttcaaaaagcaattccccccccgacaacctccggcgccttccagccgactggtgacttattcgtcaaatcaccacattantcgcaatttattactttccccg

SEQ ID NO: 63750 - protein, 190 aa, Zea mays
  misc_feature: Ceres CLONE 1532153
  misc_feature (1)..(170): Pfam Name: DUF833 Pfam Description: Protein of unknown function (DUF833)
  misc_feature (79)..(79): Xaa is any aa, unknown, or other
  misc_feature (82)..(82): Xaa is any aa, unknown, or other
  misc_feature (83)..(83): Xaa is any aa, unknown, or other
  misc_feature (183)..(183): Xaa is any aa, unknown, or other
MCIAAWIWQAHPVHQLLLLLNRDEFHSRPTKAVGWWGEGSKKILGGRDVLGGGTWMGCTKDGRLAFLIIPSNRRKKGVXRLXXISLSNSCKTTRAHSKLQLNWQIKLKKYTGFKPLLPDPTTNIRAYGANRAYGHPPQFTPGHPNPCTFQYRPKITLQKAIPPPTTSGAFQPTGDLFVKSPHXSQFITFP

SEQ ID NO: 63751 - DNA, 735 bp, Zea mays
  misc_feature: Ceres CLONE 1532154
  misc_feature: Pfam Name: Carotene_hydrox Pfam Description: Carotene hydroxylase
aaagctggagctccccgcggtggcggccgctctagaactagtggatcccccgggctgcaggaattcgtctcacccctagaaaaaatccggagcgttccattccattccatcccatcaccggaaagtgcaaggacgggagggagagcgggcggcgcgtcacgaataccaccagcccaaggaggcatggtgcagccgctatgacacacccttcttccccaaaagcccactgctcgctgccgccgcgcgccgcatggcgcctccacttctgggactcgccctgccgttctctccgttcgccagacatggggtgccacgccgcaagcggctcaggctgaggaccatcacctgcttcgagcctcaagacacaggtgccccggacgctcacgagcccgcactggatcaccaagccaaggccgctcaggaacgcccgcgtacgtgcacaacgaagcgcgacatgcccctcgagggcatacctacctggtggccccgtcggtgctcagtctacctagtaagtgcctggcagtcgtcgccgtgtactatcgtctcacgtttctactggagggcgcccaccttgctgtgatccagacactgggtactctcccgctgtccgtacgccgagcagtccgtatacacctctggccacgccgtgctcatgagcctgtacgacacgcctcactgatgcacatgcaccaaatcgcaccaacggcgacgcaaagtccccttagagctaaattc

SEQ ID NO: 63752 - DNA, 723 bp, Zea mays
  misc_feature: Ceres CLONE 1532155
atatggtgggtcggggccgccccctccccccccccccccgtgctttttaaagctggtgctccccgcggtggcggccgctctagactagtggatcccccgggctgcaggaattcgtctcacccctagaaaaactccgtgttgccgagctgtggcgggcgttgcgcctccctcgcctcgccagtcccctcgcctctttctcgtttgcggcggcgtccacagcatctgcggctcctggcaccacgtttcggctgcgaccccttcgcccgaaatccgattgatgagagcaggatccgataagcaaagcaaattatgcgctgcagaagtcctttgcattgcagttttccactggaaggttgtgatgcttggtactaagataaacttgtagactgaaaccataatgcctgaccctgcttattcgatctcacttatggtcaactagagtaattgtcgtggttcaacgcactgtacttgttataagttcatatggtgcaattcgtgtacaaataataaaaaaacgagacgctcgtggtacccaattcgccctatagtgagtcgtattacgcgcgctcactggccgtcgtttttcaaccgtcgtgactggggaaacccctggcccttaccccaccttaatcgcccttgcggcaccatcccccctttcgcgcagctggagttaattaccccaagaaggcccccgcaccggatcgaccctttccctaccagttt

SEQ ID NO: 63753 - DNA, 653 bp, Zea mays
  misc_feature: Ceres CLONE 1532156
  misc_feature: Encodes the peptide sequence at SEQ ID NO. 63754
atagctggagctccccgcggtggcggccgctctagaactagtggatcccccgggctgcaggaattcgtctcacccctagaaaaaaagctgataattctctggattatgcggcaaatttatcacatatgcttggttttgacgaccccaggatgctggagctgatgcggctccatgtaacaattcacgctgatcatgaaggcgggaatatcagttctcatactggtcatctggttggaagtgctctgtcagatccttatctttctttcgcatcatctgtgaatgggttagctgggccactacatggccttgcaaatcaagaagcgcttctatggctcaagtctataattcaggaaacagggagcgacgttacgacagaccaactcaaagactatgtctggaagacactgaagagtggaaaggttgttcatggatttggtcatggagttctgcgtaggacggacccacggtatctatgccaaagggagtttgccctgaagtatttgccagaggatccgcttttccaactgctgtccaagttatatgaggtcgtgcctccgatcctcactgagctgggaaaggtcaagaacccatggcccaatgttgacgctcacagtggactcttgctgaaccactttggactatctgaaacacgg

SEQ ID NO: 63754 - protein, 176 aa, Zea mays
  misc_feature: Ceres CLONE 1532156
  misc_feature (1)..(175): Pfam Name: Citrate_synt Pfam Description: Citrate synthase
  misc_feature: SWISSPROT Homolog: EC 2.3.3.1 Citrate (Si)-synthase
MLGFDDPRMLELMRLHVTIHADHEGGNISSHTGHLVGSALSDPYLSFASSVNGLAGPLHGLANQEALLWLKSIIQETGSDVTTDQLKDYVWKTLKSGKVVHGFGHGVLRRTDPRYLCQREFALKYLPEDPLFQLLSKLYEVVPPILTELGKVKNPWPNVDAHSGLLLNHFGLSETR

SEQ ID NO: 63755 - DNA, 799 bp, Zea mays
  misc_feature: Ceres CLONE 1532157
  misc_feature: Encodes the peptide sequence at SEQ ID NO. 63756
  misc_feature (638)..(638): n is a, c, t, g, unknown, or other
  misc_feature (766)..(766): n is a, c, t, g, unknown, or other
cacatcccgatcccccccccccactccacccaccgcaaacatcaccaccctacacccccaaaactggagctccccgcggtggcggccgctctagactcgtggatcccccgggctgcaagaattcgtctcacccctagaaaaactattcttggattggcactggacttccacaatgtacaacaaactctcagtaccggtgggacggcttcagctgtgaggacacgatgcgagatggaaatcgaccggattgagaagcaatttgatgagtgtgtcatatttctcctgaggatcctatctttcaagctcaatgtgggtcatttcccccatcttgccgatctaattaccaggatcaattacaatcactatttcatgctctgatagtggcgagccttcctctgtctattacattggacgtccccgtgcccaccccttaataatactctactagattggaaccaagcaaatgcatacaccaactctttttgctgctctaccacccctccccccgcaattttttttctcttccccccccattttcttcttcaccctaaaaacaaaccccactaccagacctcctcatcgctactcatcctccttacactactccctctctacacgacaccacaacccaactcctncgccgtccctcgtcggtccacacccgccctatcacatgtatcccatcccccattccccccccttacacgctaacattagatccgaacaacggtctaactcgaaaaaaaacaactcctccctcctgttnaatagctccaaactctcaattatatccttgttg

SEQ ID NO: 63756 - protein, 125 aa, Zea mays
  misc_feature: Ceres CLONE 1532157
HIPIPPPHSTHRKHHHPTPPKLELPAVAAALDSWIPRAARIRLTPRKTILGLALDFHNVQQTLSTGGTASAVRTRCEMEIDRIEKQFDECVIFLLRILSFKLNVGHFPHLADLITRINYNHYFML

SEQ ID NO: 63757 - DNA, 769 bp, Zea mays
  misc_feature: Ceres CLONE 1532160
  misc_feature: Encodes the peptide sequence at SEQ ID NO. 63758
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (190)..(190): n is a, c, t, g, unknown, or other
  misc_feature (402)..(402): n is a, c, t, g, unknown, or other
  misc_feature (476)..(476): n is a, c, t, g, unknown, or other
  misc_feature (680)..(680): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggnnngggngggccaaagctggaactccaccgacggtgggcggccgctctagaactagtggatcccccgggctgcaggaattcgtctcacccctagaaagaaagaagccaaagccaatggcgactctacctctgctcctgcacctgctatgggaggcctctccgtgggcccgtgcaggcgcggcgacggccgccgtggtgctggtgtggctagcggcctgnacgcttgagtgggcgtggtggacgccacggcggctagacagagccctacgggcccagggccctcagggtaccangtaccgcctccctcaccgcgacgtgagggagaacgcccggctcaaccgagtagcccgcacgaagccactggcgcttggggagtcacgacatcatcccacgcgtgctacccatgttcccacaacgcggtgaaggaagattgggacaaattctttcccttggtttgggcccgattccccagggtgatatttccagaccccgaattnattgaaaaaaaatttttgtcctaccaaggttgggcccctttgggcaaaacccctggtttaacccgggttttggaaatttcctaaccaaa

SEQ ID NO: 63758 - protein, 102 aa, Zea mays
  misc_feature: Ceres CLONE 1532160
  misc_feature (35)..(35): Xaa is any aa, unknown, or other
  misc_feature (60)..(60): Xaa is any aa, unknown, or other
MATLPLLLHLLWEASPWARAGAATAAVVLVWLAAXTLEWAWWTPRRLDRALRAQGPQGTXYRLPHRDVRENARLNRVARTKPLALGESRHHPTRATHVPTTR

SEQ ID NO: 63759 - DNA, 706 bp, Zea mays
  misc_feature: Ceres CLONE 1532168
  misc_feature: Encodes the peptide sequence at SEQ ID NO. 63760
  misc_feature (706)..(706): n is a, c, t, g, unknown, or other
ggagctccccgcggtggcggccgctctagaactagtggatcccccgggctgcaggaattcgtctcacccctagaaaaaaacggaggtcgagcaccagacctcatctcactccgctaccccctcatcctgccatccaccagaagcagtgcaagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaaccgggttccagatccggcgggtacacgggaccccatggggattcaccacggcgccccatccgaggaacattctccttttcttcgcccgcctcacgacccccggtattccgggggggggggttcaactacacttccaggggcaaaaaaccgcctccccccccctgacttattgtggtatttatcccggccccctcggtttttttaaacctcggggtgcttccccccctattacgtaagtggtgcctcttttctggagcggccctttgccccgcgtttggcggggaggcaagttttgctcgcccttggcggggcctggtctaaacagataaactcgcactatttaccgccccctcgcccgcttactgtttgtattgcttacccacagcagtttttagctgcccgccccctccttgctatctctaccgttcn

SEQ ID NO: 63760 - protein, 108 aa, Zea mays
  misc_feature: Ceres CLONE 1532168
MARRASLLLAAALLVAVAAAAVPPTCERIECPAYEVVDSANRVPDPAGTRDPMGIHHGAPSEEHSPFLRPPHDPRYSGGGGSTTLPGAKNRLPPPDLLWYLSRPPRFF

SEQ ID NO: 63761 - DNA, 744 bp, Zea mays
  misc_feature: Ceres CLONE 1532177
  misc_feature: Translation starting site: 165
  misc_feature: SWISSPROT Homolog: EC 2.5.1.31 Di-trans,poly-cis-decaprenylcistransferase
  misc_feature (509)..(509): n is a, c, t, g, unknown, or other
ctggagctccccgcggtggcggccgctctagaactagtggatcccccgggctgcaggaattcgtctcacccctagaaaaaactcgacgatattaatggagctgctttgctcgggcggcagacagccgtagacagagcagtgacggtcgtcgtacacagatcacgatgctgctcccacactcttcgtcagcctctgcaactgctaccactcgtgggctaccactatcagcaccggagacggcaccgccgcgtccgaccgctcgcccccggtgcgcgcgcctcctgcctccacgctcacaggccgagacgcatgcgacgggcgttggcgccgaccgcgcggccaaggcgcttctccaaagcgagctgcgccatgagtcgctgccgagtcacgtcacggtggtgatggaccgaaactcgcgttgcgcacacgtacggcggctgacacccgcggacggcctcgaggccagcggccacaacctgtaacggtcgttgcgctataccgatcatggntcatcatcgcgctcactgccttcgtctgctcccgggagaacttgagtcgcctcaaggccgatgtcgactacatgatgggttcgtcccagaggctgataagcaacacttcgaccagatctcgaggctggggatccggctgactgtgatcggcaacgccgcaacgatgcctacctctctgccgatcgcatcgagaacgccccacgagccctgagcacaattcccatctgcaactgat

SEQ ID NO: 63762 - DNA, 738 bp, Zea mays
  misc_feature: Ceres CLONE 1532179
  misc_feature: Encodes the peptide sequence at SEQ ID NO. 63763
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (23)..(23): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (492)..(492): n is a, c, t, g, unknown, or other
nnnnnnnnnggggtggaggaggngatataaatnnnnnnntgccnnnnnnnccattactggagctccccgcggtggcggccgctctacactagtggatcccccgggctgcaggaattcgtctcacccctagaaaaagtagcatttcccgtccggtctttccgttacccggcggcttaaaccctagttcccattccatcttcgtttccgctccgccgccgtcgatggagttctggggtctcgaggtcaaacctggatccactgtcaagtgtgagcctggacatggctttatcctgcacgtttcccaggctgcccttggggaatcaaagaaaagtgacagtgccttaatgtatgtcaaagttgatgacaagaagcttgccattggaacgctctctatcgacaaatacccacagatacaattcgatttggttttcaataaagagtttgagctgtcacacacatcgaaaactaccagtgtatttttctctggttacnaagttgagcagccaattgagggagatgaatatcctttttaacgctgaaatacttatattagttatttttttccagccaaagtgattaaagcaatttttggggttgaagatttttgtttccttggacttttctttttggcccccttccccaaagggatccttgatttcctgaaaggatgaaaagaggaagggagcctaaaacctcttcccagcgtaagcccaaggggaaataatgggcggaattggg

SEQ ID NO: 63763 - protein, 103 aa, Zea mays
  misc_feature: Ceres CLONE 1532179
  misc_feature: SWISSPROT Homolog: EC 5.2.1.8 Peptidylprolyl isomerase
  misc_feature (91)..(91): Xaa is any aa, unknown, or other
MEFWGLEVKPGSTVKCEPGHGFILHVSQAALGESKKSDSALMYVKVDDKKLAIGTLSIDKYPQIQFDLVFNKEFELSHTSKTTSVFFSGYXVEQPIEGDEYPF

SEQ ID NO: 63764 - DNA, 752 bp, Zea mays
  misc_feature: Ceres CLONE 1532183
  misc_feature: Encodes the peptide sequence at SEQ ID NO. 63765
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (36)..(36): n is a, c, t, g, unknown, or other
  misc_feature (43)..(43): n is a, c, t, g, unknown, or other
nnnnnttggtatggtgcgatgagggtttaaggaaanaaggaanccctcccttattaaaactggaactccacgcggtggcggccgctctataatagtggatcccccgggctgcaggaattcgtctcacccctagaaaaatcacaaacacaaagacagccagccagagccagccagagccagccatcactgatcatagcatcagcagcttagtataccgtaccgctccacatccgagctagaagaagaagcccacgcggccagtacctgcctagcggcgcgagcgaagcagagatggcgagagcgctgccgctggtgctcgcggcgtccgtcctgctggcggccgccgcgctgctgctggccgcggcgccagcaccggcggccgcggtcgacttcggcgcggaggacctgccgtcggaggaggcgctgtgggccctgtacgaccgctggcgcgggcaccacgcgggggccccccacctgggcgaacaagggcgccgcttccaagtcttcaaggcaaacaggcccctcacccacaagttcaacccccgggacgagcccctacaagtccccccttcaaacgctttcgggaaaaagggacccgcccaaaaaaattcccgaaagcgccctaagccgggggtttccaaggggggggggcgcaccaaccctccagggggttccccgggggggaacacggggccgaggggtactccccggagggggcgccggggaggttgatataagaagaggtgcacccg

SEQ ID NO: 63765 - protein, 146 aa, Zea mays
  misc_feature: Ceres CLONE 1532183
MARALPLVLAASVLLAAAALLLAAAPAPAAAVDFGAEDLPSEEALWALYDRWRGHHAGAPHLGEQGRRFQVFKANRPLTHKFNPRDEPLQVPPSNAFGKKGPAQKNSRKRPKPGVSKGGGRTNPPGGSPGGNTGPRGTPRRGRRGG

SEQ ID NO: 63766 - DNA, 729 bp, Zea mays
  misc_feature: Ceres CLONE 1532189
  misc_feature: Translation starting site: 142
ggagctccccgcggtggcggccgctctagaactagtggatcccccgggctgcaggaattcgtctcacccctagaaaaaagccatcacacgcatactgcatacacaacacagagcatcagaaggagctacgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcctccggcagcccctggtacggtgccgaccgcgtcctgtacctgggcccgctgtccggctcacctccgagctacctgaccggcgagttccccggcgactacgggtgggacaccgcggggctgtcggcggacccggagaccttcgccaaagaaccgcgagctggaggtgatccactgccgctgggccatgctcggcgcgctcgggtgcgtgttcccggagctgctcgcccgcaacggcgtcaagttcggcgaggcggtgtggttcaaggcgggctcccagatcttcagcgagggcgggctcgactacttcgggcacccgagccttgtccacgcgcagagcatcctggctatctgggcgtgcaagtggtgctcaatggcgccgtcgaggggtaccgcgtcgccggcgggccgctcggggaggtggtccaccccctgtaacctgggcgcagcttcgacccgctc

SEQ ID NO: 63767 - DNA, 735 bp, Zea mays
  misc_feature: Ceres CLONE 1532190
  misc_feature: Encodes the peptide sequence at SEQ ID NO. 63768
aaaaaattgaaattttatcggataatcacgaatattcaaaaacaacactatctttctcaacagctgcgaactccaccgcggtggcggccgctctattactagtggatcccccgggctgcaggaattcgtctcacccctagaaaaaaagccggctacggccagtccccagtcagcctagcttcgctcgctgttcgttcgtcctgatagcttgaaaccgccatggccatggggctccccggccaccgctgctgccgccttcccgctctcgggtcggtcactccactctgtcccgccctcgctcgcaggcccctcccgcggacctcggatctccgctactcctccctcgaagcccaagctggggacactattgaggaggaggtcctgcgcatgttccttgaggagaggcaactgcacggcgatttcgtcaccaagatctctgacatggtctggaggaggaatggcggcaatgttgacccccctgaggcgaccacagaccaaggcaatgctgtagatgttgctcaacctgaagacgtgcgggaaaatgttgtggaccacggaatgttgaaactaccggcaaccagaagtttggttgccccggtgaccagcgcccctccttttggaacaagaagcctttcagcctaagggattgggccagaaatgaagaaaaggacccaacgggaaagggagcctgaaatctctttttggcaaataatggaaagccaccttctcaagggg

SEQ ID NO: 63768 - protein, 140 aa, Zea mays
  misc_feature: Ceres CLONE 1532190
MAMGLPGHRCCRLPALGSVTPLCPALARRPLPRTSDLRYSSLEAQAGDTIEEEVLRMFLEERQLHGDFVTKISDMVWRRNGGNVDPPEATTDQGNAVDVAQPEDVRENVVDHGMLKLPATRSLVAPVTSAPPFGTRSLSA

SEQ ID NO: 63769 - DNA, 633 bp, Zea mays
  misc_feature: Ceres CLONE 1532196
cgcggtggcggccgctctagaactagtggatcccccgggctgcaggaattcgtctcacccctagaaaaaaggaaactggaaagagtacaaatcgcgcggcgacaccaccgctgcgcagcctcccgccgcgatggtgatgcgttcgctcgccaggctgcaccgccaactctcgcccttctcgcctccaccgccatagcacacggcgtgggtggactcccgcttctgacgagttctttctctggcgcgggctcgcctgctcatcaacttctgcggccggtcaggcagaatagctcgagacggactttggggtaccttctcggcgttgcaggtcgcccatgaatccggggcctggggaacccccccccataccaaaaaataaaaggggggttttataaagggtttttggggcttatgggggcgccaccccccccccccggggggggggaactcttccccggaggaaaattcatcaattagggggggccccccaaaaaaaataaaaccctgtgaagaaatattggaaaagagtttccctcccccccctccgagaaaaaaaaaaaattattggggtgcccttttgggggggggatcttatatatattggggagaaaaaaaatattttttttttttttt

SEQ ID NO: 63770 - DNA, 810 bp, Zea mays
  misc_feature: Ceres CLONE 1532197
  misc_feature: Encodes the peptide sequence at SEQ ID NO. 63771
  misc_feature (810)..(810): n is a, c, t, g, unknown, or other
tcttccctagtggatcccccgggctgcaggaattcgtctcacccctagaaaaaccgtccagccgtctcggggcagccaagaggtcgtgtgcgcgtggatctctccgtagaagggatgaagatcacggcgctccttgtgctgaagccgtcgacctccggagccggtagctcctcgtccggcggccagtcgggcccggaggcggtcgtgctcgcgaacgcgacggacgtcagccacttcggctacttccagcgcagcgccgcccgcgagttcatcgtcttcgttgcccgcaccgtcgctcagcgcacccagccaggccagcggaatttttgtccccccaccccgggtggggggggggggggcgcacaacccaaaattgggctttgccgccccggctttcttttggatgatcacctttcctggcacgaagtgccagtgtgtccggtctgcaatccggcccctctgaatacaaaccggaaacggctttcttggggcactcccgcgcacattccggctagttgcagcagtggaccctcatcctggggcgccttgtcccttgaacaaccccccgtcgggcggtcacatgctccgggaccttcgcggcaatctctgcttgagcttaatgcgaacattctagagcgccccttttccgtaagaaaaacaaataatctctcctatccgttaaggcgcctccgtacggaacgccccgcgtctcctgcgcgaatactgagactatgcatatcttttctcatgtaagaacaatatgattcgcccttatcaggagtttcgcccccacaagatctctctacattn

SEQ ID NO: 63771 - protein, 212 aa, Zea mays
  misc_feature: Ceres CLONE 1532197
MKITALLVLKPSTSGAGSSSSGGQSGPEAVVLANATDVSHFGYFQRSAAREFIVFVARTVAQRTQPGQRNFCPPTPGGGGGGAQPKIGLCRPGFLLDDHLSWHEVPVCPVCNPAPLNTNRKRLSWGTPAHIPASCSSGPSSWGALSLEQPPVGRSHAPGPSRQSLLELNANILERPFSVRKTNNLSYPLRRLRTERPASPARILRLCISFLM

SEQ ID NO: 63772 - DNA, 660 bp, Zea mays
  misc_feature: Ceres CLONE 1532199
  misc_feature: Translation starting site: 367
  misc_feature (660)..(660): n is a, c, t, g, unknown, or other
atagctggagctccccgcggtggcggccgctctagaatagtggatcccccgggctgcaggaattcgtctcacccctagagttgatatgagtgcctcctgcacgtggccgacacgattcccgactggcaagcggacggtgagctcacgacgttcatagtgatggagagcttgccgagatatcctacgccggagactacatgcgaattgctcatctgtcgtgagtaactgctctttgatgagagtatgcctcctgatagatcgcatgaccgcgagtactcgtagcgcggaattctccctcacgaaacggtaaaagaagatgtacccttctagctgtccaagaaggtgatagatctcgatgaactgaggatgctggcggctcagggagtcccagacgcggcgggcgtccgagcaactgtatggaagctgctactgggctatctgcccaatgaccgctcgctgtgggagcaggagctggcaaagaagagagggcagtacgctgctttcaaagatgagttccttacaaaccctaaagagcgcaacaggtgccaacagaaggccaccacaacgtaagtgcagagcatgttgacaatggcttcctgcacaggtcagaggtaacccgagaggagcacccttttagccttgggaagaccagtgcttggn

SEQ ID NO: 63773 - DNA, 524 bp, Zea mays
  misc_feature: Ceres CLONE 1532205
  misc_feature: Encodes the peptide sequence at SEQ ID NO. 63774
tagctggagctccccgcggtggcggccgctctagaatagtggatcccccgggctgcaggaattcgtctcacccctagaaaaaatctcgatcgtgctccattccattccatccacgtatagctagagctgccaatcggagatacatggcccgtgtcgcgtcgctgctgctcaccgtcatcgtggctgcggcggcgtcgctgctgctgctgcttgcgccgtcggcggcggagctggcgcgggtggagcacccgcccaagaacgatggctcgctcgccatccttgcagttggcgactgggggcgccgggggcagttcaaccagaccctcgtggcccagcagatgggagtggtgggggagaagttggacatcgacttcgtcatctccacgggcgacaacatctacgacgaccgcatcgccaacaccagcgaccccctcctcaaggagtgcttcaccacatctacaccgcgcagagcctcagacgccttggtacttcgtcctcggcaaccatgaactacccggcaaacc

SEQ ID NO: 63774 - protein, 121 aa, Zea mays
  misc_feature: Ceres CLONE 1532205
  misc_feature: SWISSPROT Homolog: EC 3.1.3.2 Acid phosphatase
MARVASLLLTVIVAAAASLLLLLAPSAAELARVEHPPKNDGSLAILAVGDWGRRGQFNQTLVAQQMGVVGEKLDIDFVISTGDNIYDDRIANTSDPLLKECFTTSTPRRASDALVLRPRQP

SEQ ID NO: 63775 - DNA, 796 bp, Zea mays
  misc_feature: Ceres CLONE 1532206
  misc_feature: Translation starting site: 168
  misc_feature: SWISSPROT Homolog: EC 2.7.11.1 Non-specific serine/threonine protein kinase
ttatttttattttattcacaaaacaaccgaacaaaaatttaactttaaaattattaattgtgactccccacggtggcggccgttctatactaatggatcccccgggctgacagaattcgtctcacccctagaaaagccctgcccgtcgccttggtgccgcgcgcgccatggccaagagcaagtcgtccgccaaggccggctccccgctactcggcaagtacgaactcggccacctcctcggccggggcaacttcgccaaggtaataccacgcgcgctgcctcggcggaggcgaccccgtgaccgtgaaggtgctggacaaggccgggctggccgccaccggcatggcggcgcgggtcctgcgccaagagaccgccttgcgcccaccggaaccacccccactggctccgccttctcttaagtgctagcgaaaacgctccaagggggaacattcaaagataggaatctgtgcctccagccccttaatactacttgaactcggaattggtccatccattgcactgtcaaagtaactgatccaccctcaaatacaccatgtcgacgataccaaacgccctcctaccaatattagcactactatactaatccatttatacagaccccacccaccttccgactcactttccctcctcgaaatgtggataaatctagcataaaaactgcacagacttaacaacctcataacggtctacctacctaggggcaatatcaactacttgcgctcatttattatgtaacccacagaaatcccccctcagattaggagtatctctttcc

SEQ ID NO: 63776 - DNA, 807 bp, Zea mays
  misc_feature: Ceres CLONE 1532214
  misc_feature: Encodes the peptide sequence at SEQ ID NO. 63777
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (807)..(807): n is a, c, t, g, unknown, or other
nnccccccnnnnnnnttttaaaacaaccctcctttnnntnnnngggccttnnntcaaactggactccccgcggtggcggccgctctagaatagtggatcccccgggctgcaggaattcgtctcacccctagaaaaaacgacactccacactccaagcgagctagagctagagctatagagatcactctccttctccgcgtgaggtagtgacgcccagccatggcaacaatggcactgcgcgccgtggcaacggcgctgctggtggtggcggcgtccgtgtgcggagcgtcggcgtcgacgctggtgctgtacaaccggtgcggggagacggtgtggccgggcatccagccgaacgccgaggaaggaggtgctggcgcgcggcgggctgcaactggcgcccggggcggtctggcgtccccggcccgctccccggggggggggggggggggccgcattgcggggggacgacacggggcgcccccctttgaacttcggtagggggtccccggtgccgtgggcgtcccccggggcgaaactgggcgggcgggccagcggtctcttatcagaagggcggggcggccagggaggagcccccccccgcccggcacaacggctgggggcggaacaatccatcctcgggggggacctcggcgagtcacttccaaatcaattttcccatcagaagggggaagtcttggtggggggacgggggaggacagagaaatccgccacttcaccgaatggaattcgccggaacaatcgtgtgatagtgagcgccccgggtggttgccttttagatcctaacan

SEQ ID NO: 63777 - protein, 92 aa, Zea mays
  misc_feature: Ceres CLONE 1532214
MATMALRAVATALLVVAASVCGASASTLVLYNRCGETVWPGIQPNAEEGGAGARRAATGARGGLASPARSPGGGGGGRIAGGRHGAPPFELR

SEQ ID NO: 63778 - DNA, 624 bp, Zea mays
  misc_feature: Ceres CLONE 1532215
  misc_feature: Encodes the peptide sequence at SEQ ID NO. 63779
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (11)..(11): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (283)..(283): n is a, c, t, g, unknown, or other
  misc_feature (294)..(294): n is a, c, t, g, unknown, or other
  misc_feature (302)..(302): n is a, c, t, g, unknown, or other
  misc_feature (459)..(459): n is a, c, t, g, unknown, or other
  misc_feature (460)..(460): n is a, c, t, g, unknown, or other
  misc_feature (468)..(468): n is a, c, t, g, unknown, or other
nnnnnnaaaanaaaaaaaaataatataaaaaaagaagctcccctncggattnnggttcatagctggactccccgcggtggcggccgctctagaatagtggatcccccgggctgcaggaattcgtctcacccctagaaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcngatccacatcnggccaggnccgggtatccaggtcggaaacgcgtggctggggagctgtactggccttcgagcattggcaattcaaggcctgaatgggtcaagatgccccgggggaacaaaaacccttttgggggggaaggggggaataaaaagcctttttacaaaaaaaaccgttnntttttccntttaaaaaagggggcctgggaaaaaaaaagtcccccccgggggggttttttttttgtaccccttgtggcccccccggggctcccccaataaaaaaggggaaagaaataggggacccttggtggttgcccgtaatcttttcctcaccaacccaggaa

SEQ ID NO: 63779 - protein, 97 aa, Zea mays
  misc_feature: Ceres CLONE 1532215
  misc_feature (10)..(10): Xaa is any aa, unknown, or other
  misc_feature (13)..(13): Xaa is any aa, unknown, or other
  misc_feature (65)..(65): Xaa is any aa, unknown, or other
  misc_feature (68)..(68): Xaa is any aa, unknown, or other
MRECISDPHXARXGYPGRKRVAGELYWPSSIGNSRPEWVKMPRGNKNPFGGEGGNKKPFYKKNRXFFXLKKGAWEKKSPPRGGFFFVPLVAPPGLPQ

SEQ ID NO: 63780 - DNA, 710 bp, Zea mays
  misc_feature: Ceres CLONE 1532225
  misc_feature: Encodes the peptide sequence at SEQ ID NO. 63781
  misc_feature (399)..(399): n is a, c, t, g, unknown, or other
  misc_feature (523)..(523): n is a, c, t, g, unknown, or other
  misc_feature (629)..(629): n is a, c, t, g, unknown, or other
agagctggagctcaccgcggtggcggccgctctagaactagtggatcccccgggctgcaggaattcgtctcacccctagaaaaaaaggaaggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgcggaggagctcgtgaanaccgcgaaaaccatcgcctcgcccgggccggggcatcctcgcccatggaccgaccccaacccgaccctgcccggaagccgcttggcgtccctccgggctggaaaacacggaggcgcaaccgggnaggcgtaaccgcacccttgttggtccacgggcgcccgggccctgggcccaatacaatttcccggggcgccttcctcctttcgagggaaacgccggttacccaagcncgcccgtccaacgggcccgcaaaaaatccgtgggacattcccgggcggggaaaccagggctcttcctccccgccgggaatc

SEQ ID NO: 63781 - protein, 90 aa, Zea mays
  misc_feature: Ceres CLONE 1532225
  misc_feature: SWISSPROT Homolog: EC 4.1.2.13 Fructose-bisphosphate aldolase
  misc_feature (47)..(47): Xaa is any aa, unknown, or other
  misc_feature (89)..(89): Xaa is any aa, unknown, or other
MASATVLKSSFLPKKSEWGATRQAAAPRPPTVSMVVRASAYAEELVXTAKTIASPGPGHPRPWTDPNPTLPGSRLASLRAGKHGGATGXA

SEQ ID NO: 63782 - DNA, 561 bp, Zea mays
  misc_feature: Ceres CLONE 1532226
  misc_feature: Encodes the peptide sequence at SEQ ID NO. 63783
ggagctccccgcggtggcggccgctctagaactagtggatcccccgggctgcaggaattcgtctcacccctagaaaaagtcctcatccacccacaggccacagtccactcacaactcccccggaacggcggcggcggcgacggcggagtaacgcggccgcgacgcaagatggcgaggaaacctctcgactacgaggagctgaacgagaacgtcaagagggtgcagtacgcggtgcgcggggagctgtacctccgcgcctccgagctgcagaaggagggcaagaagatcatcttcaccaacgtcggcaacccgcacgccctcggccagaaaccgctcaccttcccgcgccaggtggtggcgctgtgccaggctccgttcctcctcgacgatccccacgtcggcctcatgttcccgggcggacgccatcggctaggggccaaagcactatctcgccatggcgcccgggcggtctaggggcgttcagtgactcccgcgggcttcccgggatccggaagggagttgcccattcatccccaaccgggagggattcccagtgaccct

SEQ ID NO: 63783 - protein, 101 aa, Zea mays
  misc_feature: Ceres CLONE 1532226
  misc_feature: SWISSPROT Homolog: EC 2.6.1.2 Alanine transaminase
MARKPLDYEELNENVKRVQYAVRGELYLRASELQKEGKKIIFTNVGNPHALGQKPLTFPRQVVALCQAPFLLDDPHVGLMFPGGRHRLGAKALSRHGARAV

SEQ ID NO: 63784 - DNA, 576 bp, Zea mays
  misc_feature: Ceres CLONE 1532227
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (233)..(233): n is a, c, t, g, unknown, or other
  misc_feature (234)..(234): n is a, c, t, g, unknown, or other
  misc_feature (238)..(238): n is a, c, t, g, unknown, or other
  misc_feature (239)..(239): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (254)..(254): n is a, c, t, g, unknown, or other
  misc_feature (258)..(258): n is a, c, t, g, unknown, or other
  misc_feature (266)..(266): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (281)..(281): n is a, c, t, g, unknown, or other
  misc_feature (283)..(283): n is a, c, t, g, unknown, or other
  misc_feature (284)..(284): n is a, c, t, g, unknown, or other
  misc_feature (289)..(289): n is a, c, t, g, unknown, or other
  misc_feature (290)..(290): n is a, c, t, g, unknown, or other
  misc_feature (297)..(297): n is a, c, t, g, unknown, or other
  misc_feature (298)..(298): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (310)..(310): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (341)..(341): n is a, c, t, g, unknown, or other
  misc_feature (347)..(347): n is a, c, t, g, unknown, or other
  misc_feature (348)..(348): n is a, c, t, g, unknown, or other
  misc_feature (389)..(389): n is a, c, t, g, unknown, or other
  misc_feature (403)..(403): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (511)..(511): n is a, c, t, g, unknown, or other
  misc_feature (512)..(512): n is a, c, t, g, unknown, or other
  misc_feature (516)..(516): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (543)..(543): n is a, c, t, g, unknown, or other
tggagctccccgcggtggcggccgctctagaactagtggatcccccgggctgcaggaattcgtctcacccctagaaaaagaacctgaggtggagagatcgcacgcgccctctgccgcttgttcgttcctcgcgctcgccaccagggcaccaccacacaacatccccaatttctcgcgagggcaaagcagcaggggttctggcgggcggggnnnnnnnnnnnnnncnnnnnncnncccnnccccnnncccccccncccncccccccnccaaaccnnnncccncnnccccnnccccccnncccccnnncccnccnnnncccccaaaccccccnnncccccccncccccnncccccccccccccccccccccccccccaccccccccccccnccccacacccaccncaaacacaaaccacctaaaatacaccccccacccccttcacaaccacaacaactcccaacaacaaaccacaactnnnccccccacacttaaattcnnnnnnnnnnnannccantnnnnnccttttcccgtacccgtaaanaaatacagacattataaccaccctcaccatcta

SEQ ID NO: 63785 - DNA, 641 bp, Zea mays
  misc_feature: Ceres CLONE 1532230
  misc_feature: Translation starting site: 160
  misc_feature (553)..(553): n is a, c, t, g, unknown, or other
ggagctccccgcggtggcggccgctctagaactagtggatcccccgggctgcaggaattcgtctcacccctagaaaactctcacttgtgtagcccaacgagaagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaaccccttgtgaagagtgccattgtgcaagttgatgctgccccatttcagcagtggtacctcactcactatggagttgacattggtaggaagaagaaaacccctgctgcnaagaaggataatgctgagggactagaggttgaagcagcagctgaagaaacgaaaagaagcaccctgtcccgagaaagcttgagagcgc

SEQ ID NO: 63786 - DNA, 637 bp, Zea mays
  misc_feature: Ceres CLONE 1532232
  misc_feature: Encodes the peptide sequence at SEQ ID NO. 63787
  misc_feature (416)..(416): n is a, c, t, g, unknown, or other
  misc_feature (490)..(490): n is a, c, t, g, unknown, or other
ggagctccccgcggtggcggccgctctagaactagtggatcccccgggctgcaggaattcgtctcacccctagaaaaaacgcagctgaccgcggcccgcatccgctacgccaacgctgcgacgggcacgggcacgggcacgggcagcgcgataaaatccgccgcggccgcctccacccacctcgacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgnggccacggcgctgcggcgcgcccgcagcgtcacggacgacgacctcgacgagctccgcggctgcatcgacctgngcttcggcttcgagccggcgcccgccgccgcgtgcgcctgcgcctgcgccgggaggaaaccgcctctggagacgctgcctgcgctcgacctctactacgccgtccacggcggggcggcggaggcgccgccgtgctcgtgcggcgccg

SEQ ID NO: 63787 - protein, 122 aa, Zea mays
  misc_feature: Ceres CLONE 1532232
  misc_feature (21)..(120): Pfam Name: DUF1685 Pfam Description: Protein of unknown function (DUF1685)
  misc_feature (49)..(49): Xaa is any aa, unknown, or other
  misc_feature (74)..(74): Xaa is any aa, unknown, or other
MEKAGQQRHVIGGGGKKAPALGLQKQNSWSPDIERDEAWERRRRGMRRXATALRRARSVTDDDLDELRGCIDLXFGFEPAPAAACACACAGRKPPLETLPALDLYYAVHGGAAEAPPCSCGA

SEQ ID NO: 63788 - DNA, 900 bp, Zea mays
  misc_feature: Ceres CLONE 1532236-R
  misc_feature (900)..(900): n is a, c, t, g, unknown, or other
ttttttcaaatgggaccgggcccgcccctcgagtcgacggtatcgataagcttttttttttttttttttgctaccacacgcacaaacatgtgcgccgctaagttcagaagaggacattgatatgggtggacaatactagcgcggtagtgccacgaaccggttgccaccactacacgagacaacacggcacggcatagtacgcacatacatagagcctatatatatactagtactagtcagagaaaccaccagcaggcacaaaagatccgcgcaccccggtcgacgcggactgacaaaccagctagatgtccgtgccgtacgtccgcctagctaaaaccttggtgaaaaacggagggaagccctttcttcaagggccaggtcggggcggtctcgaaaaccccctgggggggaaaaagtgggttccaacccccctactttttattgggaaaaaaccccgggggggccgaattaaaagggggtgaaaaatcccccccggggggtttttcccagatttaaatacggggggcacctttggtccccaacattctttttccccccacccccgagtgtggggcctattagagaacgcgggctcctccttttaagagggtcgccaagcttttaggatatgtttcaataatagggggcggtccgggcaagaaataacacaccctagggagttgtgccacttgagatgttgttctctcgccccccgccgggtgaaggtttagtgtcgcccccggcggtgttctaccacggggtaaaagaggctttggggagtgctgttttagtaaaggggggaccccattttttcaccgcgggggcgcctctccgacccatataatccgcgcgggggggagttatccgcccgcctttgtgcaataaagcggccacctcatn

SEQ ID NO: 63789 - DNA, 657 bp, Zea mays
  misc_feature: Ceres CLONE 1532239
  misc_feature (51)..(51): n is a, c, t, g, unknown, or other
  misc_feature (206)..(206): n is a, c, t, g, unknown, or other
  misc_feature (213)..(213): n is a, c, t, g, unknown, or other
  misc_feature (349)..(349): n is a, c, t, g, unknown, or other
  misc_feature (393)..(393): n is a, c, t, g, unknown, or other
  misc_feature (449)..(449): n is a, c, t, g, unknown, or other
  misc_feature (455)..(455): n is a, c, t, g, unknown, or other
  misc_feature (487)..(487): n is a, c, t, g, unknown, or other
  misc_feature (489)..(489): n is a, c, t, g, unknown, or other
  misc_feature (490)..(490): n is a, c, t, g, unknown, or other
  misc_feature (494)..(494): n is a, c, t, g, unknown, or other
  misc_feature (502)..(502): n is a, c, t, g, unknown, or other
  misc_feature (539)..(539): n is a, c, t, g, unknown, or other
  misc_feature (541)..(541): n is a, c, t, g, unknown, or other
  misc_feature (556)..(556): n is a, c, t, g, unknown, or other
  misc_feature (557)..(557): n is a, c, t, g, unknown, or other
  misc_feature (594)..(594): n is a, c, t, g, unknown, or other
acctcaccccggtggcggccgctctagactagtggatcccccgggctgcangaattcgtctcacccctagaaaaaactccacagctagcatcgatccgccattgctcaccgcacaagtgcacgctcacctcacacacgcagctaagtagctaacgccgtaggcgaggacaagaaaaggctcgacatggccgaagagaaaaacaggncctgcanctgctggacttctgggtgagcccattccggcagccctgccccatcccgctgaacgagaaggcccttctcctacgagtacctggaccaggacctggggaaaaattaccaagttgttcctccgcgccaacccgggggntttttttttcctcccctccccagggggggcagaaggggggggtnttttcccattcccctccttcacctttcaataaccaaaaaaaaaaaaatatcccatntttatncgccgggggggtgctcccccccaacccctaanannttcngtataagnccgcttccttcccgaaactactttcaacacacaaccntncccaattgctatccnnaaccctcacccacccttacctggtaaccatccccctnctctcgctccgcccccaacactttaacacactactcccccatcccgcccccaactcaccccca

SEQ ID NO: 63790 - DNA, 618 bp, Zea mays
  misc_feature: Ceres CLONE 1532240
  misc_feature: Encodes the peptide sequence at SEQ ID NO. 63791
tggagctcaccgcggtggcggccgctctagaactagtggatcccccgggctgcaggaattcgtctcacccctagaaaaaggaaaatatttcttatgcaattgatttctggtcacagagccaaatgcaagcagtatttttgcgacatgaagggtatttgggagcacttggtgccctgatgagttatggggatccaagtggtgaaaatcttaccctcgaggagaaggagcctcatcacgaatcagcaccagttgatgggacatcagcggatgaagagagtgatagcaacatatttccttaccttcttgtaaatattggatcaggtgtcagcatgatagaggtaattggtaagggaaagtttgaaagaattataggatcccatctaggcggcggtactatccttggtcttgctaggcttttgactggttgttcaagttacgaagaattcctggagttgagccagaggggcaataatctgtctgtcgatttgactgtgggggacatatatggggaagaaggttatccgaagattggccttccagcatccactactgcggctagctttggaaaagtgaactcaagcaaactttctgagtataaagtagaggatcttgctgcag

SEQ ID NO: 63791 - protein, 165 aa, Zea mays
  misc_feature: Ceres CLONE 1532240
  misc_feature (13)..(165): Pfam Name: Fumble Pfam Description: Fumble
  misc_feature: SWISSPROT Homolog: EC 2.7.1.33 Pantothenate kinase
MQAVFLRHEGYLGALGALMSYGDPSGENLTLEEKEPHHESAPVDGTSADEESDSNIFPYLLVNIGSGVSMIEVIGKGKFERIIGSHLGGGTILGLARLLTGCSSYEEFLELSQRGNNLSVDLTVGDIYGEEGYPKIGLPASTTAASFGKVNSSKLSEYKVEDLAA

SEQ ID NO: 63792 - DNA, 663 bp, Zea mays
  misc_feature: Ceres CLONE 1532242
  misc_feature: Encodes the peptide sequence at SEQ ID NO. 63793
aaagctggagctcaccgcggtggcggccgctctagaactagtggatcccccgggctgcaggaattcgtctcacccctagaaaaatcgtcctcaatctcaatcccacaccaccaccacctcctccggtccccaacccctgtcgcaccgcagccgccggccatggcctgcctcaccgacctcgtcaacctcaacctctcggacaccaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcaggaggggcaacaacatccttgtgatgtgcgattgctacaccccagccggcgagccaatccccaccaacaagaggtaccacgccgccaagatcttccgcagccctgaggccgcccgccgaagaaccctggtatggtattgaaccagagtacccccctcctccaaaaggacaccaactgggccccttggggtggcccattcgtgggcttccccgggccttcagggtcctttaccactggggaaatccgccccccaaaag

SEQ ID NO: 63793 - protein, 128 aa, Zea mays
  misc_feature: Ceres CLONE 1532242
  misc_feature (17)..(97): Pfam Name: Gln-synt_N Pfam Description: Glutamine synthetase, beta-Grasp domain
  misc_feature: SWISSPROT Homolog: EC 6.3.1.2 Glutamate--ammonia ligase
MACLTDLVNLNLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYHAAKIFRSPEAARRRTLVWY

SEQ ID NO: 63794 - DNA, 648 bp, Zea mays
  misc_feature: Ceres CLONE 1532243
  misc_feature: Encodes the peptide sequence at SEQ ID NO. 63795
aagctggagctccccgcggtggcggccgctctagaactagtggatcccccgggctgcaggaattcgtctcacccctagaaaaaatccgacggccacgagactcccatcgttcggatataagtgcccctccaaccgaaaacccgtccttctccgcgcactccacccaactcgccgccgccgctgccaacgccgcctgctgccgcagccgccatgggggcgtacaagtatgtgtcggaactatggagtaggaagcagtcggacgtgatgcgcttcgtgcagcgcgtgcgctgctgggagtacaggcagcagccgtccatcgtccgcctcaccaggcccacccgccccgacaaggcccgtcgtctcggctacaaggccaagcagggatatgttgtctaccgtgtccgtgtgaagcgtggtggcaggaagaggcctgtgcccaagggtattgtctatggcaagcccaagcaccagggtatcacccagctcaagttcagagggaacaagaggtctgtcgctgaggagagagctggacgtaagcttggtggactgagggttcttaactcctactgggtgaatgaggataatacctacaagtactttgaaatcatccttggtggacgttgcccaccaaaccatcaaaaccgaacg

SEQ ID NO: 63795 - protein, 146 aa, Zea mays
  misc_feature: Ceres CLONE 1532243
  misc_feature (2)..(146): Pfam Name: Ribosomal_L15e Pfam Description: Ribosomal L15
MGAYKYVSELWSRKQSDVMRFVQRVRCWEYRQQPSIVRLTRPTRPDKARRLGYKAKQGYVVYRVRVKRGGRKRPVPKGIVYGKPKHQGITQLKFRGNKRSVAEERAGRKLGGLRVLNSYWVNEDNTYKYFEIILGGRCPPNHQNRT

SEQ ID NO: 63796 - DNA, 647 bp, Zea mays
  misc_feature: Ceres CLONE 1532249
  misc_feature: Encodes the peptide sequence at SEQ ID NO. 63797
  misc_feature (647)..(647): n is a, c, t, g, unknown, or other
ggagctccccgcggtggcggccgctctagaactagtggatcccccgggctgcaggaattcgtctcacccctagaaaaagagcgaaggaggagcctgcccgcgcctgcgcctggttgtaattgtagctcacgctcacccttcagttgaccaccgctgcggcagcaatggcggcgagtcgccggcagcaccgccgcggcttcccgctggtcccgctgctgctgtcgctcctggaggacgccgcgtacgggcgcctcatctccgacggcggcccgcccgcgccgctcctcccggtcatccgcctcgcggagccgccggccgaggccgagtgcgagcagacctacggcttcctcccctgcaccaccaccgtgctcggcaacctcttcctggtgctggcctacggcttcctcatgttcaaggcggacaccttcctgtcggcgggcagcgagctgctgctagagatcatggggcccggcctcgtaagaggcctgctcctccccagcctaggcgccctccccgacgcgctcctcggtctaatgtccggcctctccaggagcaagatgaggctcacagacaagtgctgatcgggatggtgctgctcgacggttccaccgtcatccctctcaccctgctctggagaacctgagtgn

SEQ ID NO: 63797 - protein, 138 aa, Zea mays
  misc_feature: Ceres CLONE 1532249
MAASRRQHRRGFPLVPLLLSLLEDAAYGRLISDGGPPAPLLPVIRLAEPPAEAECEQTYGFLPCTTTVLGNLFLVLAYGFLMFKADTFLSAGSELLLEIMGPGLVRGLLLPSLGALPDALLGLMSGLSRSKMRLTDKC

SEQ ID NO: 63798 - DNA, 716 bp, Zea mays
  misc_feature: Ceres CLONE 1532250
  misc_feature: Encodes the peptide sequence at SEQ ID NO. 63799
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (20)..(20): n is a, c, t, g, unknown, or other
  misc_feature (21)..(21): n is a, c, t, g, unknown, or other
nnaaaannccgtgtgggggnnctttaatctctagttcccgattatatttatttcatactggagctccccgcggtggcggccgctctagactagtggatcccccgggctgcaggaattcgtctcacccctagaaaaactccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagaccctgtcagtgttggatgtctggatcttgcatttttggaaaaataccaatttacctcgttcaaggatggcaaaattttttatttatattaaaaatataattaaccgaagaccctcgagggtccccaattccccccttttagtggaagcggtattaccgcgcgcttccttgggccgcgcgtttttaaaacggcca

SEQ ID NO: 63799 - protein, 69 aa, Zea mays; identical to SEQ ID NO: 8575
  misc_feature: Ceres CLONE 1532250
  misc_feature (2)..(69): Pfam Name: Ribosomal_L38e Pfam Description: Ribosomal L38e protein family

SEQ ID NO: 63800 - DNA, 631 bp, Zea mays
  misc_feature: Ceres CLONE 1532252
  misc_feature: Encodes the peptide sequence at SEQ ID NO. 63801
ggagctccccgcggtggcggccgctctagaactagtggatcccccgggctgcaggaattcgtctcacccctagaaaaaaccaccagtccagcctccagctaggggaagggggcgaggaaggagccagagcagacccaaaccctcaatggcttcctctcgcgctctcgctttcttcctcctctgcgccctgctgcccgcgcccccagtctcggccacattgctgttcggcggcggcaagtcggccaagaaggcgggcgtcgacgcggagtggcggccggccaccgcgacgtggtacggcgaggccgagggcgacggcagcgacggcggcgcgtgcggctacgggacgctggtggatgtggtgccgatgaaggcgcgggtggggtcggtgagccccgtgctgttcaaggacggcgagggctgcggcgcctgctacaaggtcaggtgcctggaccgcggcgtgtgctcgcgccgggccgtcacggtggtcgtcacggacgagtgccccggcgggctgtgcgcgttcggccgcacccacttcgacctcagcggcgccgcgttcagcaggatggccgtcgccggggccggcggccggctgcgcgaccggggccagctgtccgtcgtgtacaggagg

SEQ ID NO: 63801 - protein, 162 aa, Zea mays
  misc_feature: Ceres CLONE 1532252
  misc_feature (78)..(160): Pfam Name: DPBB_1 Pfam Description: Rare lipoprotein A (RlpA)-like double-psi beta-barrel
MASSRALAFFLLCALLPAPPVSATLLFGGGKSAKKAGVDAEWRPATATWYGEAEGDGSDGGACGYGTLVDVVPMKARVGSVSPVLFKDGEGCGACYKVRCLDRGVCSRRAVTVVVTDECPGGLCAFGRTHFDLSGAAFSRMAVAGAGGRLRDRGQLSVVYRR

SEQ ID NO: 63802 - DNA, 697 bp, Zea mays
  misc_feature: Ceres CLONE 1532253
  misc_feature: Encodes the peptide sequence at SEQ ID NO. 63803
  misc_feature (391)..(391): n is a, c, t, g, unknown, or other
ggagctcaccgcggtggcggccgctctataactagtggatcccccgggctgcaggaattcgtctcacccctagaaaaaaggcccaccgctagcatccgcagttcccccgcgcccgagacgcaaccccgcgccaggagtaagtttgttcttttatcgatatggcgagggaggagaatgtctacatggccaagctggctgagcaggccgaaaggtatgaagagatggttgagtatatggagaaggtggctaagactgtacatgtggaagagctcactgttgaggagcgtaacctcttgtcggtcgcataccagaatgtgattggggctcgccgtgcttcatggcgcattgtctcttcttttgtcccccccccccgaggggggggggggggganatcctgtgaacccttatcacccaccaccctgccaaaaatcgaggctgaacttgaaccattatctgtggatggcatcccgaaacctttttcgattccccccctagggccttccttctaccggccgcttgaatccaaaggattttctaccttcaacaataaaggggggactcttccactgtgtttctttgcggaaattataaacaatcggtccttccaaaagcgaaaggaaatccgcctcaaaaacccctcaataaacgttctccacaacagtttcgctctacacgaaatattgccacataaacctag

SEQ ID NO: 63803 - protein, 179 aa, Zea mays
  misc_feature: Ceres CLONE 1532253
  misc_feature (3)..(179): Pfam Name: 14-3-3 Pfam Description: 14-3-3 protein
  misc_feature (78)..(78): Xaa is any aa, unknown, or other
MAREENVYMAKLAEQAERYEEMVEYMEKVAKTVHVEELTVEERNLLSVAYQNVIGARRASWRIVSSFVPPPRGGGGGXSCEPLSPTTLPKIEAELEPLSVDGIPKPFSIPPLGPSFYRPLESKGFSTFNNKGGTLPLCFFAEIINNRSFQKRKEIRLKNPSINVLHNSFALHEILPHKP

SEQ ID NO: 63804 - DNA, 762 bp, Zea mays
  misc_feature: Ceres CLONE 1532256
  misc_feature: Encodes the peptide sequence at SEQ ID NO. 63805
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (14)..(14): n is a, c, t, g, unknown, or other
nnnnccctaaattnggataaataacgagcaaaagatcaatcctaaatccacacaaaatggagctccccgaggtggcggccgctctagaactagtggatcccccgggctgcaggaattcgtctcacccctagaaaaaactcctaaccctcgcccgactcagatctgtctgccccgcgccgccgtcgccatgccgttcactccgggtccctactctggcgtcagcaccctcgcccttgtagcgagggcatcggtcttcggcttcggtgtcgtctacgggagcatcaagctctcaatcctcaaggcaacaaagcctaaaaaggaagaagcgcatgctcatcactaaagacgacagggctgctacatgttaatttctatggaaggatgatataaaaatgtggttgcactcctttctccatacgtgcaatttgatttatgatttgtggacatcttgctgtaacacacctgccccactatcttaagttttgtgccataataaaacttcttagccaatgactttgaaatccgggaaggggaaaaatccaaagaacccacctttttgtttttgtcgccaaaaaaaccaacaaaaacgaaaacgctcccaggttaccccaattcgccccctataatggaggtcgtatttatacccggcgctccacaggcacgatcggtttttacaaaacgttcccctggccctggggaaaaaacccctgggtggtttttccccatatctttaaaactccccccttgggaaaatacccttct

SEQ ID NO: 63805 - protein, 51 aa, Zea mays
  misc_feature: Ceres CLONE 1532256
MPFTPGPYSGVSTLALVARASVFGFGVVYGSIKLSILKATKPKKEEAHAHH

SEQ ID NO: 63806 - DNA, 1697 bp, Zea mays
  misc_feature: Ceres CLONE 1532261
  misc_feature: Encodes the peptide sequence at SEQ ID NO. 63807
aacgccgaattctcggttggcttaggcggtgggtggatcaaatcgagtccggaagctcatctgggtgttggcctcatcccctgcacaagctgaggaatggggcaaaaggactccaagccttcaaatggatatggctactcttctgattacgggggtacttcatcgggatataacttgagaaatactggaagtacgtcctccagttatggcgcgaggtatgtgccttcttcagagaacaatgtacagccagaaacacatgccaggttgcagaggaagtattccaggattggtgatgactatcgttctctgagtcaggtgactgaagctttggcgcaagcaggccttgaatcttcaaatcttatcgtaggcattgattttacaaagagcaatgaatggacaggtaaaatttcatttaatcgccgctgcctacatgatattggaaacactccgaacccatatgagcaagctatatctattattggaaggacactttcagtatttgatgaagataacttgattccctgctttggatttggtgacgcatcaactcatgatcaggaggtattcagcttttacccagagaaccgcccatgcaacggatttgaagaggcactagacagatacagagaaatcgttccaactcttcgattagcaggacctacatctttcgctccgatgatcgagacagcaattggaattgttgacagcactggtggtcaatatcatgttcttctgataatcgcagatggacaggttacccgaagtgtcgatacacaatctggacaattgagtccacaggagcgggatactatagatgcaatagtaagagcaagccagttccccctgtcaattgttcttgttggggttggtgatggaccatgggacatgatgcaccagtttgatgacaatatacctgctcggtcatttgacaatttccagtttgtgaacttcacggagattatgtcaaagagcatagcagctgacagaaaggaggcagaatttgcattgtcagcgctgatggaaatccctacacagtacaaagcaacacttgatctccaactcttaggccgccgccaaagaataactccaagaattgctctgccgccaccaacaaggactgcttattcacggactactagctttagccaacagtctggtgtttattcgcgatcaagtagctttgaccaacaaacaagtgtctaccagcaacgttctgagagcttgaaacagcagcaacctgcagccccaaagggacctgacacttacgtatcagaaagtgctctggaggatagaattctgtgccccatctgcatgtataaatcgaaggaccttgcatttgggtgtggacatcagacttgctatgaatgcgggagagatttggagcgctgccctctgtgccagcaacacataaccacgaggatcaggctctactgatttgaagccaatgggattgaaaaatgttcagaaccagctttgatgctactgtgcttcatcattttgtaattctgaatgagataacactgtctcagtagtttcgctacactagttatgccaaaaggaagcgcaccagaaaataatgtacagatttttcctccttttatctcttttgttaggtaaacaagttagacagcagtaaaattctgaatgagataatggatattgtgaagcaaaactatcgccaaaaaaaaaaaaaaaaa

SEQ ID NO: 63807 - protein, 445 aa, Zea mays
  misc_feature: Ceres CLONE 1532261
  misc_feature (110)..(258): Pfam Name: Copine Pfam Description: Copine
MGQKDSKPSNGYGYSSDYGGTSSGYNLRNTGSTSSSYGARYVPSSENNVQPETHARLQRKYSRIGDDYRSLSQVTEALAQAGLESSNLIVGIDFTKSNEWTGKISFNRRCLHDIGNTPNPYEQAISIIGRTLSVFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTQYKATLDLQLLGRRQRITPRIALPPPTRTAYSRTTSFSQQSGVYSRSSSFDQQTSVYQQRSESLKQQQPAAPKGPDTYVSESALEDRILCPICMYKSKDLAFGCGHQTCYECGRDLERCPLCQQHITTRIRLY

SEQ ID NO: 63808 - DNA, 663 bp, Zea mays
  misc_feature: Ceres CLONE 1532263
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaaaattgattgatctatgtaatacagatatggttgtgtggcaaactgccaatgactattgagatccctgcatatattgacatgtgacaaggatcaacctgcaaaactggtgccctgcttctcgcagaccttattaccttaaataaccccggtggtgtgtttttcaattatgtgaaaaccttggccgcgcgctcactggccgtcattttacaacatcatgactgggaaaaccctggcgttacccaaattaatcgccttgcagaacatccccctttcgccagctggcgtaatatcgaagaggcccgcgccgatcgccctccccaacagttgcgcatactgaatggcgaatggaaattgtatgcgttaatattttgttaaaatacacgttaaattttcgataaatcagctcatttttttaaccaccatttccaaatcgggaaaatcccttataaatccaaagaatataccccagatacggattgagtgttgttcccaatttggaacaaagagacccctatttaaaaaacgttgtactcccaaccccccaaagggcgataaaacccgcgctatcaaggggcgaag

SEQ ID NO: 63809 - DNA, 653 bp, Zea mays
  misc_feature: Ceres CLONE 1532264
  misc_feature: Encodes the peptide sequence at SEQ ID NO. 63810
aagctggagctccccgcggtggcggccgctctagaactagtggatcccccgggctgcaggaattcgtctcacccctagaaaaaatccagttctcgctatatctttttctccccaagaaaaaaaaggcggcgagagcataagaaaaaaacacacacacacacacacacacaaagcgcacttttcaaatcgacaaaggggaaaggttcgcttcttctcgcatcttgctttacttcgagtgccatggccgatccggcggaggagaacgttgtctcgccgccaccgacccctgcggccccagccgtgggcgcctcagactcgcccctgcagcctgttgctgacggcgcctcaacggagaaggtgtctgcccccccccccgagggaaggggggggggattcacgcttcttggagaggacacttccctgcacaatcccttgggggcggtaaaactgctgacgttctgttatggaaagaccacaaaacttctgctgttggaaaaggcgggcccaactggcctctggggtcctgttccaagtgctttgattaccacctccctgaccctgaaaatcccatgtacctggatggcggtggctgcccactttaattcccgggggtcccaaagcaacccccctttctataaagaaaagaccccccg

SEQ ID NO: 63810 - protein, 137 aa, Zea mays
  misc_feature: Ceres CLONE 1532264
MADPAEENVVSPPPTPAAPAVGASDSPLQPVADGASTEKVSAPPPEGRGGGFTLLGEDTSLHNPLGAVKLLTFCYGKTTKLLLLEKAGPTGLWGPVPSALITTSLTLKIPCTWMAVAAHFNSRGSQSNPPFYKEKTP

SEQ ID NO: 63811 - DNA, 647 bp, Zea mays
  misc_feature: Ceres CLONE 1532267
  misc_feature: Encodes the peptide sequence at SEQ ID NO. 63812
ggagctccccgcggtggcggccgctctagaactagtggatcccccgggctgcaggaattcgtctcacccctagaaaaacccatggtttcgtatcaggaaaagctttctttatatatattcgggcattgcgttatcgtgtagcttagctttgcagaacagagaaggagaagggggagctgtaatcctacctaagaagcggcgatggggcggtcaggaggcggcgacggggacggcgaccggctcctcctcggcaagcccttggagtcgccgtcgtgcagctcgtccgacgagagcctggtcaagagaaccggcacggtatggacggcgatggcgcacatcatcacggcggtgatcgggtccggcgtgctgtccctggcgtggagcgtggcgcagctggggtgggtgggcgggccggcggcgatggtgttcttcgccggcgtcaccgcggtgcagtccaccctcatcgccgactgctacatctgcgaccacccggagcgaggcgtcgtcaggaaccgctcctacgtcgacgccgtgcgcatctacctgggcgacaagagccatttgttttgcggcttcttcctcaccttgagcttgtttggcaccgggtgtggtgtacacgctcacttcccgcactagcatgagggcga

SEQ ID NO: 63812 - protein, 144 aa, Zea mays
  misc_feature: Ceres CLONE 1532267
MGRSGGGDGDGDRLLLGKPLESPSCSSSDESLVKRTGTVWTAMAHIITAVIGSGVLSLAWSVAQLGWVGGPAAMVFFAGVTAVQSTLIADCYICDHPERGVVRNRSYVDAVRIYLGDKSHLFCGFFLTLSLFGTGCGVHAHFPH

SEQ ID NO: 63813 - DNA, 652 bp, Zea mays
  misc_feature: Ceres CLONE 1532268
  misc_feature (1)..(1): n is a, c, t, g, unknown, or other
  misc_feature (237)..(237): n is a, c, t, g, unknown, or other
  misc_feature (266)..(266): n is a, c, t, g, unknown, or other
  misc_feature (267)..(267): n is a, c, t, g, unknown, or other
  misc_feature (312)..(312): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (352)..(352): n is a, c, t, g, unknown, or other
  misc_feature (397)..(397): n is a, c, t, g, unknown, or other
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (446)..(446): n is a, c, t, g, unknown, or other
  misc_feature (447)..(447): n is a, c, t, g, unknown, or other
  misc_feature (449)..(449): n is a, c, t, g, unknown, or other
  misc_feature (450)..(450): n is a, c, t, g, unknown, or other
  misc_feature (470)..(470): n is a, c, t, g, unknown, or other
  misc_feature (471)..(471): n is a, c, t, g, unknown, or other
  misc_feature (474)..(474): n is a, c, t, g, unknown, or other
  misc_feature (477)..(477): n is a, c, t, g, unknown, or other
  misc_feature (485)..(485): n is a, c, t, g, unknown, or other
  misc_feature (511)..(511): n is a, c, t, g, unknown, or other
  misc_feature (512)..(512): n is a, c, t, g, unknown, or other
  misc_feature (542)..(542): n is a, c, t, g, unknown, or other
  misc_feature (634)..(634): n is a, c, t, g, unknown, or other
ngacacacccgagctccccgcggtggcggccgctctagaactagtggatcccccgggctgcaggaattcgtctcacccctagaaaaagacgcgtccaacgtttccagccggggtacggtcctaccaccgctgtgcctaattggcggctagctagctagctagctagctagctagctgtgcagctgctgcaatcctcgatcggcacagccggttcttgatgtggagggagcggcggcngcccctgctcctgctggtggccggcccgnnccttggactgatccgtgccgctctctcccacgagacgggggaggncnnncttaaagtttttttctacatgcgacgggccccatcncgaaaaattttttttctcccacccgcgggaaaaagaaaagggggnnannnnnnnnnnnnnnnnnnnncnnnaaaaaaaaaaaaaaaaaaaaaanntnngggggggggggggggggggnnttnttnctcccatnaaaaaaaaaaaggcaagcccataccnnaccccctcccccaaaaaaaaaattccaacnttcccaaccccaccaacccaatcacctgcccgctccaaaaccctctcccccccttcccgtggccctcggcaaaataatttcccaggagggcnaaggaacgagccgacccg

SEQ ID NO: 63814 - DNA, 652 bp, Zea mays
  misc_feature: Ceres CLONE 1532279
  misc_feature: Encodes the peptide sequence at SEQ ID NO. 63815
ccccgcggtggcggccgctctagaactagtggatcccccgggctgcaggaattcgtctcacccctagaaaaaatccctaatcccagcgcagcacagacaaacaccgcgccgccgccacagctttgccctacagaatccttttactccaaagattctcaagacgcccctgatggctccccgcgtcgcctccgctctgctcttcgtcgtggccgtcctcgtggcctccgcggcggcgcatgagtccatggcgcccgcgtctgctccggcgccgggaccggtcgctggcgcggcctccgctccggcctccgctgtggccgtggtgtcgtccgcactgctgtccctccttatgacggccctgatgctgtacaaatatcatactagatttgagcgggaattttggttcagtgttgctattcctcattctttttcgttttcctatatgtctggccacctttatatatgatcataaagttgggtcgatcccctcgcttccccctccctgataggcgaattggaaatttgtaaacccttctaatattttggcgtaaaatttggaagttaaaattttttttctcctgcccccctcaatgtttccccattttccccccctttataaggggggccgaatttccccccgccgataccacagaga

SEQ ID NO: 63815 - protein, 97 aa, Zea mays
  misc_feature: Ceres CLONE 1532279
MAPRVASALLFVVAVLVASAAAHESMAPASAPAPGPVAGAASAPASAVAVVSSALLSLLMTALMLYKYHTRFEREFWFSVAIPHSFSFSYMSGHLYI

SEQ ID NO: 63816 - DNA, 635 bp, Zea mays
  misc_feature: Ceres CLONE 1532281
  misc_feature: Encodes the peptide sequence at SEQ ID NO. 63817
atagctggagctccccgcggtggcggccgctctagaactagtggatcccccgggctgcaggaattcgtctcacccctagaaaaaaaaaaaaagcttctagggttttcgcgccgccgccgccgcttcgtcgtctccgccgcagcgatgccgtcgcacaagaccttccggatcaagaagaagctggcgaagaagatgcgccagaaccgccccatcccctactggatccgcatgcgcacggacaacaccatcaggtacaacgccaagcgcaggcactggcgccgcaccaagctcggcttctgagcgtggggatcggccggctcccgcgtcggaattctagggtctctacctttcctttggttttatcgatgtctcttgtgtttctgtaagctagcaaacagttccagaaagcttttgttaagattttgatgacgctaagaggattgatgctactatgctgtactcaggattccatgctgcattgcgatgctaaattaaagaacccctgttacccttaaaaaaaaaaaaaaaaaaccagaccgctccgaggtccccattttccccccattaggggagtccgtattaccccccgcccccccggggccggccgttttttcaaaccctccgggaccggggaa

SEQ ID NO: 63817 - protein, 51 aa, Zea mays; identical to SEQ ID NO: 2355
  misc_feature: Ceres CLONE 1532281
  misc_feature (9)..(51): Pfam Name: Ribosomal_L39 Pfam Description: Ribosomal L39 protein

SEQ ID NO: 63818 - DNA, 646 bp, Zea mays
  misc_feature: Ceres CLONE 1532282
  misc_feature: Encodes the peptide sequence at SEQ ID NO. 63819
  misc_feature (318)..(318): n is a, c, t, g, unknown, or other
aagctggagctccccgcggtggcggccgctctagaactagtggatcccccgggctgcaggaattcgtctcacccctagaaaaataccaagtccagacatagcaaggattgacagactgagagctctttcttgattctatgggtggtggtgcatggccgttcttagttggtggagcgatttgtctggttaattccgttaacgaacgagacctcagcctgcttgtacctagattactgtttccattgtcgtcatcatcggctaacattgtcataatgtcagtttgggtaatgttagattaagtaattattgtgttcaaanaacaaaaaaaaaaaaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttccccacagttgcccagcctgaatggcgaatggaaaattgtagcgttaatattttgttaaaatcgccgttaaatttttgttaaatcagctcattttttttaccaataggcccg

SEQ ID NO: 63819 - protein, 53 aa, Zea mays
  misc_feature: Ceres CLONE 1532282
MGGGAWPFLVGGAICLVNSVNERDLSLLVPRLLFPLSSSSANIVIMSVWVMLD

SEQ ID NO: 63820 - DNA, 482 bp, Zea mays
  misc_feature: Ceres CLONE 1532286
  misc_feature: Encodes the peptide sequence at SEQ ID NO. 63821
ggagctccccgcggtggcggccgctctagaactagtggatcccccgggctgcaggaattcgtctcacccctagaaaaaaacctcagatccacccggcgagctcatttcagatccatccatgcgcttcccgttccttttcgccctccagctggtcgccttggcggcggcagcgtcggcggccgaggtcgcggtgacgcgctcttcgaggatggtgcaccgtctgtcagacgaggcccggctggaggtaggcccgcgtgtggtgtggtggccgcagcgaggaagcgggagtactaccgcgcgctatgaggaggatatccagcggcagaagcggggctcgcggcctctcgctctcaagggcgtcagcaccttctccccgggcaacgacttatgctagctatattactcttgcgtggatgttgtgacgcctgctacctcctttctcgttgcattgcatactggtagtgaaccttttctggggtccc

SEQ ID NO: 63821 - protein, 91 aa, Zea mays
  misc_feature: Ceres CLONE 1532286
MRFPFLFALQLVALAAAASAAEVAVTRSSRMVHRLSDEARLEVGPRVVWWPQRGSGSTTARYEEDIQRQKRGSRPLALKGVSTFSPGNDLC

SEQ ID NO: 63822 - DNA, 797 bp, Zea mays
  misc_feature: Ceres CLONE 1532289
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (483)..(483): n is a, c, t, g, unknown, or other
  misc_feature (564)..(564): n is a, c, t, g, unknown, or other
  misc_feature (600)..(600): n is a, c, t, g, unknown, or other
  misc_feature (621)..(621): n is a, c, t, g, unknown, or other
  misc_feature (746)..(746): n is a, c, t, g, unknown, or other
nnnnnnnnnngggaacccaaggctaaaaaacatgacaaccaccataataaattttatacaaactggtactccccgcggtggcggccgctctagaatagtggatccccccgggctgcaggaattcgtctcacccctagaaaaataagggtaaggatagcctgtctgcccagggaaagcgccgttatgaccgcaagcagtcaggatatggtggccagaccaagcctgtcttccacaagaaggccaagaccaccaagaaaatcgtattgaagctgcagtgccagagctgcaagcactactctctgcacgcaattcagaggtgcaagcattttgagattggtggagacaagaagggtaagggaacatctctcttctaagtttttcatcgccccaccccgatgttatgataaaacctgtggagtctacctacggttcgaaaaacttcgtaaaaatttcaatgctctctacgtaatatatgtaaagganagccaacagctaacgtattaacaatcccaattgtcttgacttctttgttcctcaaaccgtgcgatcttgggatataggtgntataactgaacgctttttacgactcacgaccataancataaagaatccatcacctcntccgtgtgtcatccgcaatcgcacccaactaatactgccacctccgaaatctaatttctaaggaccccacatgggttttacctcgatctagcactaaccactcctggcgcccctctaccaaaaanatcacccggcgcgaccagacccccaacacttgactactccacccaataaac

SEQ ID NO: 63823 - DNA, 606 bp, Zea mays
  misc_feature: Ceres CLONE 1532290
  misc_feature: Encodes the peptide sequence at SEQ ID NO. 63824
ctagaactagtggatcccccgggctgcaggaattcgtctcacccctagaaaaaagcgaaagctcatgcgatacaagctctcagttataccacactcagaccaggcgcggacagcctcaaaatcccgagcaggagctcgctcggagccacgagaacccgaaagctctgcagcgagatgtctcccaagctgaacggcgagatggccgccaaggccgccgccgccgctgctgcggtgaagcccgcgacgagggcgtacgtgacgatcctggcgggcgacggcgactactggaagggcgtggtgggcctggccaagggcctgcgcaaggtcggctcggcctatcccctggtggtggcccttctgcccgacgtgccggaatcccaccgccgcatcctcgtctcgcagggctgcatcctccgcaagatcgagcccgtgtacccgcctgagaaccagacgcagttcgccatggcgtactacgtcatcaactactccaagctccggctcttgggagttcgtggagtacgagaggatgggtgtacctggacgccgcacatcctggtgttcgagaacatcgacgagctgttcgacctccgagaaggggtacttctt

SEQ ID NO: 63824 - protein, 144 aa, Zea mays
  misc_feature: Ceres CLONE 1532290
MSPKLNGEMAAKAAAAAAAVKPATRAYVTILAGDGDYWKGVVGLAKGLRKVGSAYPLVVALLPDVPESHRRILVSQGCILRKIEPVYPPENQTQFAMAYYVINYSKLRLLGVRGVREDGCTWTPHILVFENIDELFDLREGVLL

SEQ ID NO: 63825 - DNA, 673 bp, Zea mays
  misc_feature: Ceres CLONE 1532296
  misc_feature: Encodes the peptide sequence at SEQ ID NO. 63826
  misc_feature (673)..(673): n is a, c, t, g, unknown, or other
ccccgcggtggcggccgctctagaactagtggatcccccgggctgcaggaattcgtctcacccctagaaaaactcacgagcacaacagggcggcctgacgagggtcccacgggccatcaccacgacacacaaatacagctcagagcaactcatagacaggctcctctcccccgttgcgcaacgcgctttcccccacttcatccgcctcggcgccatgggtaaccacgcgctggcgctcctcctcctgctggccgtggcggaatccgcgtcggccagcaacgggagccacctgaatctcgacctgagcttcctctcctctggggaacgacggagggagtgccgagccacgatggccgagtgcctcaccgatgagacagatgaggacggtcttgacatgcctagatcccaccgccgcacgctctactgcagctgatacatcagctagcgcgcgctgcggggggacaacgtgccctgctcccgcagaggcgccagctaatacaactgccgcccgggcgagccaggccaaccccctagcaccgcgggctggttccctcattcaaccgggtgccggggactgactgcggggaaccccaatcccgcgcagaatggcccaaagaaaaaggtcttggggccccaggggccccgggccccattttgcgccgcacacaatgan

SEQ ID NO: 63826 - protein, 72 aa, Zea mays
  misc_feature: Ceres CLONE 1532296
MGNHALALLLLLAVAESASASNGSHLNLDLSFLSSGERRRECRATMAECLTDETDEDGLDMPRSHRRTLYCS

SEQ ID NO: 63827 - DNA, 791 bp, Zea mays
  misc_feature: Ceres CLONE 1532302
  misc_feature: Encodes the peptide sequence at SEQ ID NO. 63828
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (130)..(130): n is a, c, t, g, unknown, or other
nttaatcccnnnaancacagtccttcagtctagttnttgttttnnnnnnntcaaagctggagctcaccgcggtggcggccgctctatactagtggatcccccgggctgcaggaattcgtctcacccctangaaaagacgaaagggctctgatcctcctctgccattcctctcatcaccctctcctcactcctcagtcagtcctcactcccccgcccttccaatggccacctcgtccgtgctcccgttccacctcccgtcctgcgcgcgccgggccagcaccgccgcgcgcgcctccgcggccccggcggcgaccaccgcgcagtccctggaggagtcgttcggaaggaacggcctgcggttcgtggccaacccagtcggcggggcccccgccgcggagctcaacgtgcggaaagggagcctcgctgcacctccgcctcggcgaacgggctcgtcatgtccccccccccccccaggtgcagtggaaaggactaccgggtgcccgggaagtgcctgctacacccgtgggcggcaaaggggaggcggtcgggcctcggtccctccagcgatcaaggacgtcaaggtgggccaagtcccttctcttgcttcgaccggccgcaccaagtgggggcccggtcgggggcacgcccgaacctccccaaattccctaacgaaccgcccgtgcgccgggtttggaagctctcggggtggcaccccatgtgggggtaaagccggggaacaatcttacgatacacttgggggggaccccctttttacccttcgacttgaaaca

SEQ ID NO: 63828 - protein, 190 aa, Zea mays
  misc_feature: Ceres CLONE 1532302
MATSSVLPFHLPSCARRASTAARASAAPAATTAQSLEESFGRNGLRFVANPVGGAPAAELNVRKGSLAAPPPRRTGSSCPPPPPGAVERTTGCPGSACYTRGRQRGGGRASVPPAIKDVKVGQVPSLASTGRTKWGPGRGHARTSPNSLTNRPCAGFGSSRGGTPCGGKAGEQSYDTLGGDPLFTLRLET

SEQ ID NO: 63829 - DNA, 1053 bp, Zea mays
  misc_feature: Ceres CLONE 1532303-R
  misc_feature (959)..(959): n is a, c, t, g, unknown, or other
gggtgattaaataatactctagtcttggtgtgttgtgattcagttcaagtactgggcggggtgttccttcctctccaaaactgagctcccgttgggcatccttgcgtcttggtgatgaacaatataacggaccgtcctatagatctgtactagtaaatcacatctcatttgaatcgaattaagcaaggggaggggaaaaacaattgaaggaaaggaatgaactttggtcagctagattaggacatgatctggttctgatccgagcactgagatgatatgtggccggcctggccgtccttgacaagagactccacccaccacacgtctggctcgaccggagccggcgctggggcacgggactgccaacgcaaacaacaagaacctgacttgctggagttgcggcacctcgctggccttggacgaccctagtctcatctttgccgatcagaacaatttcccgattgtgaagagacagggaccgcccccccccctgccgatgggcttgcccagaaacataaaactcaagtggcctgggctccggggtctccccccccggcccccgcaggcataatataatatttttttgggtcttggggacttaatggtgcaaaaaggtctggcgagggcgaggctggaaagacattataggctctatggggcccctattgggcacaatttggggaacctgtggttcctgccaagaccccccgagaatacatttggcttgaggttcgcggggcctcttgatcctattcgggttcttcatagcctctcgtgtattgaagtgggcacgaaatgtcacatgggtcgccggatacattctgtggaatgctgctcttgtcgacgtgtggtcctatgttcatctctggcagttgtatctttatttctcgtccgccgacgccctcgtagtatttattctcagcggactagcttacttgcgccctctagtgactcttccncgagaagaacgccagacatagggcgattgccggtttgtggtatgtgagagtcactagtctcctttgggcttgtccccctgtctcttctgtcttt

SEQ ID NO: 63830 - DNA, 623 bp, Zea mays
  misc_feature: Ceres CLONE 1532303
  misc_feature: Encodes the peptide sequence at SEQ ID NO. 63831
aaagctggagctccccgcggtggcggccgctctagaactagtggatcccccgggctgcaggaattcgtctcacccctagaaaaactcaacccacccacctcccactctcgccaccgtgtggtccagacgtccagtcctctaaccgaaccaggaagcaccacaccaggcagcggaagctcgcgctgggatcggctaccaacaataatatcgttcctcgcctccctcacctctgaacgagaacgcgaacgcgccctgtgatcactaccccacagcatgtgctcaggacctcgcaagccgtccacaccccctctgccggcggcgacggccaaggactcctcggcgatggcggtgctgctggagctggcggcggcggacgacgtcgtggggttcaggcgcgccgtggagggcgacaaagccccagccttggacgacgcgggtcactggtacggcccgtccgccgcggccgccggccgcctccgcctgcgcctcgaggcgcgcactccggccatggtggccgcgctctacggcagcacggcgagtgctggcgtacctgctgtcctccgcgccggccgatgccgcgcgcgcctcaaccactgacagaaccacgccgctacaactcgccg

SEQ ID NO: 63831 - protein, 84 aa, Zea mays
  misc_feature: Ceres CLONE 1532303
MAVLLELAAADDVVGFRRAVEGDKAPALDDAGHWYGPSAAAAGRLRLRLEARTPAMVAALYGSTASAGVPAVLRAGRCRARLNH

SEQ ID NO: 63832 - DNA, 637 bp, Zea mays
  misc_feature: Ceres CLONE 1532304
  misc_feature: Translation starting site: 314
  misc_feature (396)..(396): n is a, c, t, g, unknown, or other
  misc_feature (398)..(398): n is a, c, t, g, unknown, or other
  misc_feature (405)..(405): n is a, c, t, g, unknown, or other
  misc_feature (407)..(407): n is a, c, t, g, unknown, or other
  misc_feature (436)..(436): n is a, c, t, g, unknown, or other
aaagctggagctccccgcggtggcggccgctctagaactagtggatcccccgggctgcaggaattcgtctcacccctagaaaaactcctttttttctctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggtttctcctcccacgacggagggggggggtcgtcaangnctacaancncacctttaatctcgcttgctttgacacanaagcacaccggagcatccggggaggacctgcccgcttgaaaccgaccaccaagccctatgctggggaaattgcatattggggcaagggtgggcccaaaacaaaaactaaaaagcaatccactcctttcgaaaaaaaaaaggggggattacacccggaaaaatttcctttggttttctccaaggaaggaaaatctcccttaa

SEQ ID NO: 63833 - DNA, 631 bp, Zea mays
  misc_feature: Ceres CLONE 1532308
  misc_feature: Encodes the peptide sequence at SEQ ID NO. 63834
aaagctggagctccccgcggtggcggccgctctagaactagtggatcccccgggctgcaggaattcgtctcacccctagaaaaaacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggtccccggagagattcgcgacccgcgcgggtccgcgtgaagttctccccgccaagggactgggacctgtgggaaaaatttccccgtttcttattccggaagggttaaatttccccaagtgttccccggttttaaccaaacccgggggcccaggg

SEQ ID NO: 63834 - protein, 145 aa, Zea mays
  misc_feature: Ceres CLONE 1532308
  misc_feature (18)..(146): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGPRRDSRPARVRVKFSPPRDWDLWEKFPRFLFRKG

SEQ ID NO: 63835 - DNA, 617 bp, Zea mays
  misc_feature: Ceres CLONE 1532315
  misc_feature: Encodes the peptide sequence at SEQ ID NO. 63836
  misc_feature (525)..(525): n is a, c, t, g, unknown, or other
  misc_feature (555)..(555): n is a, c, t, g, unknown, or other
  misc_feature (566)..(566): n is a, c, t, g, unknown, or other
  misc_feature (617)..(617): n is a, c, t, g, unknown, or other
aaagctggagctccccgcggtggcggccgctctagaactagtggatcccccgggctgcaggaattcgtctcacccctagaaaaagctttccgattttcgtttctctctcttttcctttccccccgtccctctctttctttctctcttggaattggaattggactcaaaagtttcggcggccttctccatgaacacggtggcttcgctgcctttggcgccgcgcctactcattaagccctccctcgcctgcttctccagaaaggacgtcgcccgctatggcgggatcaaggtgtacgccgtgctcagggaagacggggccgagttcgcccggaacaacaacctgggggccctgttccaggtggacgaccccgggccgcgggcccccgtcaagaagttcctggacgtgaacgaggctctggaggtggtccgcttcgacatccagtactgcgactggagggcgcgccaggatctcctcaccatcatgcttctccacagcaaggtggtggaggtcctcaaccctctggncgaggagttcaagtccatcgggaccttgangaaagagctcngcgagctacagcaggagctggaaaaaagctcacatcaggtccatctctcgn

SEQ ID NO: 63836 - protein, 143 aa, Zea mays
  misc_feature: Ceres CLONE 1532315
  misc_feature: SWISSPROT Homolog: EC 1.13.12.14 Chlorophyllide-a oxygenase
  misc_feature (113)..(113): Xaa is any aa, unknown, or other
  misc_feature (123)..(123): Xaa is any aa, unknown, or other
  misc_feature (127)..(127): Xaa is any aa, unknown, or other
MNTVASLPLAPRLLIKPSLACFSRKDVARYGGIKVYAVLREDGAEFARNNNLGALFQVDDPGPRAPVKKFLDVNEALEVVRFDIQYCDWRARQDLLTIMLLHSKVVEVLNPLXEEFKSIGTLXKELXELQQELEKSSHQVHLS

SEQ ID NO: 63837 - DNA, 678 bp, Zea mays
  misc_feature: Ceres CLONE 1532320
tccccgcggtggcggccgctctagaactagtggatcccccgggctgcaggaattcgtctcacccctagaaaaagtaagtcatatcgtaactagagaaacaagtagctttataatcacaatgtatcaccatcctacagagctatggatgcgtcttgtacatatgccggataaagcgcttctatgttcccgaacatcttttctttaccatgattccaaagtgtgtttttccccttagtaaaaaaaaaaaaaaaacgagacgctcgaggtacccaattcgccctatagtgagtcgtattacgcgcgctcactggccggcggtttacaacgtcgtgactgggaaaaccctggcgttaccccaacttatccccctggggggagatcccccttttcccagctggggtaaatagcgaaaaagcccgcaccgatcgcccttcccaacagttgggcagccctgaaggggggaatggaaatttgtaagctgtaatattttttttaaaaattccccgttaacttttttgggtaagcccccgccctttttttttaaccgaaaagggccaaaaatcgggaaaaatccccttttaaaagccaaagagaatagccccgcgatgagggggttgaggcgtctctccccggtttggggaaccgccgagctccccctaatataaaaaaacggtgggc

SEQ ID NO: 63838 - DNA, 624 bp, Zea mays
  misc_feature: Ceres CLONE 1532324
  misc_feature: Encodes the peptide sequence at SEQ ID NO. 63839
aaagctggagctccccgcggtggcggccgctctagaactagtggatcccccgggctgcaggaattcgtctcacccctagaaaaaacacaccacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccggggtacacgtccagggtaccaaaggcgtgttcccgatcaaggtgaccagaacaagcacgtcgtgcaggaaatggttagggtccggccagcatgggaacttagggctcgaggctgggttcaaagcaaaattgctcatccccatgaactgcccccccgtccccgaaaccaaacccaacccgtatttgatttg

SEQ ID NO: 63839 - protein, 156 aa, Zea mays
  misc_feature: Ceres CLONE 1532324
  misc_feature: SWISSPROT Homolog: EC 4.1.1.19 Arginine decarboxylase
MDKNYGELYNILGWGEEYFAVNTEGHLSVKPFGRWTEPGQEIDVHSVIVEALATQPNDSTSKSQFPMILRFPDVLKNRIETLHNAFNSAMESTGVHVQGTKGVFPIKVTRTSTSCRKWLGSGQHGNLGLEAGFKAKLLIPMNCPPVPETKPNPYLI

SEQ ID NO: 63840 - DNA, 655 bp, Zea mays
  misc_feature: Ceres CLONE 1532328
  misc_feature: Encodes the peptide sequence at SEQ ID NO. 63841
aaagctggagctccccgcggtggcggccgctctagaactagtggatcccccgggctgcaggaattcgtctcacccctagaaaaaactcgatcgcgtggtcattcatcgaccatcatcgtttatatgctgtcacgcacagtgcgggccggtagggtgtctgcaataataaacccggccagtgttgcattattgtgtgttttatttcgcatggattaggatcgagccgcgccaatggtagattctacggaataaatataataacattgttatgattgagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcggagaggcccgcaccgatccccccttccccaaaatttgcgcagcctgaaatggcgaaatggaaattgtaaaagcgttaatatttttgtttaaaattccgccgtttaaatttttttgtttaaaatccagcctccatttttttttaaacccaataaggccccgaaaatcccggcaaaaatcccccttttataaaaatccaaagaagaaa

SEQ ID NO: 63841 - protein, 75 aa, Zea mays
  misc_feature: Ceres CLONE 1532328
  misc_feature: SWISSPROT Homolog: EC 3.2.1.23 Beta-galactosidase
MIEKKKKKNETLEVPNSPYSESYYARSLAVVLQRRDWENPGVTQLNRLAAHPPFASWRNSGEARTDPPFPKICAA

SEQ ID NO: 63842 - DNA, 633 bp, Zea mays
  misc_feature: Ceres CLONE 1532330
  misc_feature: Encodes the peptide sequence at SEQ ID NO. 63843
atagctggagctccccgcggtggcggccgctctatcctagtggatcccccgggctgcaggatttcgtctcacccctagaaaaacattggagggcaagtctggtgccaacagacgcggtaattccagctccaatagcgtatatttaaattgttgcagttaaaaagctcgtacttggaccttgggccgggccggttggtccgcctcacggcgagaaccgaccgggtcgacccttctgccggcgatgcgctcctggccttaactggccgggtcgtgcctccggcgccgttactttgaagaaattacagtgatcagaacaagccatcgctctggatacattaccatggaataacatcataggattccggtcctattgtgttggccttcgcgatcggagtaatgattaatatggacagtcaggggcattcgtatttcatagtcaaaggtgaaattcttggatttatgaaagactaacaactgcgaaagcatttgccaaggatgttttcattaatcaagaacgaaagttgggggctcgaagacgatcagataccgtcctagtctcagccataaacgatgccgaccagagatcagcgggtgttactaattgccgcaacgaattcacagtctccagacaac

SEQ ID NO: 63843 - protein, 47 aa, Zea mays
  misc_feature: Ceres CLONE 1532330
SWSSPRWRPLYPSGSPGLQDFVSPLEKHWRASLVPTDAVIPAPIAYI

SEQ ID NO: 63844 - DNA, 657 bp, Zea mays
  misc_feature: Ceres CLONE 1532337
  misc_feature: Encodes the peptide sequence at SEQ ID NO. 63845
  misc_feature (52)..(52): n is a, c, t, g, unknown, or other
  misc_feature (102)..(102): n is a, c, t, g, unknown, or other
  misc_feature (119)..(119): n is a, c, t, g, unknown, or other
  misc_feature (168)..(168): n is a, c, t, g, unknown, or other
  misc_feature (193)..(193): n is a, c, t, g, unknown, or other
  misc_feature (228)..(228): n is a, c, t, g, unknown, or other
aaagctggagctccccgcggtggcggccgctctagaactagtggatcccccngggctgcaggaattcgtctcacccctagaaaaaaaaaaaaaaaaaaaccntcatcttctctcctttntggctcggaacgcacacacagccccggtccccgtatctccgtatccccntcgtcgatccaagatgcagatcttncgtcaagaccctcactgggaaagactatcaccctncgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggcccagatcccagacaaggagggcatccctcccggacagcagcggctcatttttgctggcagcagctcgaggacgggcgcacgctggccgacttacacattcaaaggaaagccccctccacttggggttccgcccccgggccggcttgcaaaatttggtaaaaa

SEQ ID NO: 63845 - protein, 158 aa, Zea mays
  misc_feature: Ceres CLONE 1532337
  misc_feature (2)..(75): Pfam Name: ubiquitin Pfam Description: Ubiquitin family
  misc_feature (83)..(143): Pfam Name: ubiquitin Pfam Description: Ubiquitin family
  misc_feature (4)..(4): Xaa is any aa, unknown, or other
  misc_feature (16)..(16): Xaa is any aa, unknown, or other
MQIXRQDPHWERLSPXEVESSDTIDNVKAKIQDKEGIPPDQQRLIFAGKQLEDGRTLADYNIQKESTLHLVLRLRGGMQIFVKTLTGKTITLEVESSDTIDNVKAQIPDKEGIPPGQQRLIFAGSSSRTGARWPTYTFKGKPPPLGVPPPGRLAKFGK

SEQ ID NO: 63846 - DNA, 641 bp, Zea mays
  misc_feature: Ceres CLONE 1532341
  misc_feature: Encodes the peptide sequence at SEQ ID NO. 63847
  misc_feature (1)..(1): n is a, c, t, g, unknown, or other
natagctggagctccccgcggtggcggccgctctagaactagtggatcccccgggctgcaggaattcgtctcacccctagaaaaagctagttgttctcgttcccttgttagttgagctctttcccttcctcgcttggaaccaaatcaattcggagcggcggagcaaaacgatcccttgcctcgcttccattcgaatcatctcgaatggggcactaatcgagaagctaatgacgcacaaatcgcgagatctgtagcgccactcggcttcaccggcggcgcggcgggcatggaagcgcagaacggctccggcgtaggggcgcccgtggtgctcaacgtgtacgaccttacgcccatgaacaactacctctactggttcggcctcggtattttccactccggaatcgaaggtgcttatgttcccacttcctcttgcctcggaatttattttccactccgaaaacatgggtgttctgttgaagttgtactgttgtacatattctcgtgctcgtacaagtacaatacctgtttggaggggataaagtttcagctgtgactagtagttacccgaaactgtagtctagtgattgaagaggggagaacgatagtttgtagttgaagagaaggaggccgaaattgcgata

SEQ ID NO: 63847 - protein, 88 aa, Zea mays
  misc_feature: Ceres CLONE 1532341
MEAQNGSGVGAPVVLNVYDLTPMNNYLYWFGLGIFHSGIEGAYVPTSSCLGIYFPLRKHGCSVEVVLLYIFSCSYKYNTCLEGIKFQL

SEQ ID NO: 63848 - DNA, 814 bp, Zea mays
  misc_feature: Ceres CLONE 1532342
  misc_feature: Encodes the peptide sequence at SEQ ID NO. 63849
  misc_feature (18)..(18): n is a, c, t, g, unknown, or other
  misc_feature (46)..(46): n is a, c, t, g, unknown, or other
ccactaacagcgccgatnaccccctaaataagcggggcctccccantccacaccgccaccctaacctcacgggcatcctaaaactacgcttcccccgggctgcaggaatcgtctcacccctagaaaaaaaaaaaacctcgtgttcgttcggagcgcacacactcacaacctgatctcccccaaatccacccgtcggcacctccgcttcaagatgcatatctttgtgacaaccctgaccggtaagactatcaccctcgaggtggagtcgtctgacaccattgacaacgttaaggccaagatccaggacaaaggagggaaatccccctttaataaataaaacaacaccgagacgctcgagggtccccaatttcccccctttaggcgagtcgtactacatgggtgttttccttggagagctcggttttatccccccgtgcccaacggggggaaaacccttgcttttttaccgaaacttattttggccgcttggacaccaacattacacctctttttcccgcgcattacgggtttcacacaagccgataaaacgggcaactaattcggattctatccactcttcccaataaagcacgcgtcgtcacccttggtaaaggtataccaacggggtagatggcaagaccgcctgaacactctctggcccatatattcacccggagaaaattattgccctgatcaccgggccttttttcccttttatcctaccctaattcgcagattttgttccccccccgtcctttatcaaacttatcactcagtttatagttccaaatactggcttgaattttgtcctaag

SEQ ID NO: 63849 - protein, 41 aa, Zea mays
  misc_feature: Ceres CLONE 1532342
MHIFVTTLTGKTITLEVESSDTIDNVKAKIQDKGGKSPFNK

SEQ ID NO: 63850 - DNA, 645 bp, Zea mays
  misc_feature: Ceres CLONE 1532345
  misc_feature: SWISSPROT Homolog: EC 3.2.1.23 Beta-galactosidase
  misc_feature (87)..(87): n is a, c, t, g, unknown, or other
atagctggagctccccgcggtggcggccgctctagaactagtggatcccccgaggctgcaagaattcgtctcacccctagaaaaaanaaaaaaaaaaaaaaaaaaaactttgttagcttgcttcaggcttcgacgcttcccaccacttccattccatgccgtccgtccgcttccttcctgtgtaatcctcctccaataatagacgtgtcatgctacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaaaagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaacc

SEQ ID NO: 63851 - DNA, 630 bp, Zea mays
  misc_feature: Ceres CLONE 1532348
  misc_feature: Encodes the peptide sequence at SEQ ID NO. 63852
aaagctggagctccccgcggtggcggccgctctagaactagtggatcccccgggctgcaggaattcgtctcacccctagaaaaagatcacacaaaattgtgcgcccgtcagtgtgatcgcctacttctacgctccgctcgttcccccaaatagttcctcggcttcgctcccttcccctccctgctccggctccggttcgcacacagtaagaaaagatggcgctgccatccatgagtcttgcggcaaagggtgtgcttcccttctcagcacgtacctcgagtggtgtcacacaaaggccggtgtcagtgaccgcttccttggagcacaaaaccagcgatgccagaaggaagttcctaaaacttgcacttgggaaccttggagttggactgcccaccttgttgggcgctaagaaagctctcgctgatgagcaaggcgtctcgtcctcgaggatgtcttattcgaggttccttgagtatcttgacaaggatagagtgaagaaggttgatttgtttgagaatgggacaattgctattgtggaagccatttctcctgagcttggtaaccgcgtgcaaagagtccgtgtgcagcttcctggtctaagcccagagcttcttcagaagtgaaggagaa

SEQ ID NO: 63852 - protein, 135 aa, Zea mays
  misc_feature: Ceres CLONE 1532348
MALPSMSLAAKGVLPFSARTSSGVTQRPVSVTASLEHKTSDARRKFLKLALGNLGVGLPTLLGAKKALADEQGVSSSRMSYSRFLEYLDKDRVKKVDLFENGTIAIVEAISPELGNRVQRVRVQLPGLSPELLQK

SEQ ID NO: 63853 - DNA, 611 bp, Zea mays
  misc_feature: Ceres CLONE 1532353
  misc_feature: Translation starting site: 159
  misc_feature: SWISSPROT Homolog: EC 3.2.1.23 Beta-galactosidase
  misc_feature: SWISSPROT Homolog: EC 2.7.1.19 Phosphoribulokinase
  misc_feature (307)..(307): n is a, c, t, g, unknown, or other
ccccgcggtggcggccgctctagaactagtggatcccccgggctgcaagaattcgtctcacccctagaaaaattggactgaagattagagacctctatgaacagattgttgctgagagagctggtgtaccagcggaagcagcaaaagtttaacgatctatgcattcagatgtcctaaaactacagctctccgaactcaatgggagtaacaaccttcgcatctgttgggatatatggcgagctaggaggtatagaaatgtcattgcagaactcaggaaaacgtgcaatggaatttcttgaaatcccgntttaaaaagccactgagaaagctgaaaaccaattcaaaaataaaaaacgagacgctcgaggtacccaattcgccctatagtgagtcgtattacgcgcgctcactggccgtcgttttacaacgtcgagactggaaaaaccctggggttacccaacttaatcgccttgcagcacatccccctttcgccagctggcgtaatagcaaagaggcccgcaccgatcgcccttcccaacagttgcgcaccctgaatggcgaatggaaattggaaccgttaatatttggttaaaatccgcggtaaatttttg

SEQ ID NO: 63854 - DNA, 824 bp, Zea mays
  misc_feature: Ceres CLONE 1532358
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (824)..(824): n is a, c, t, g, unknown, or other
nnnnnnnttttttgatgatcgagttgcccctaaacaaaatttgattatnnntttcaaactgggactccccgcggtggcggccgctctagactagtggatcccccgggctgcaggaattcgtctcacccctagaaaaaaaccttttcgctgctccagcgaagaacacagccaccgccgtttcttcgtcttcctcgcagcgccggcgcgccatctcggtacgaaggcgacggcggcgttcaggatcgggatctcagcgacgacgtcagaggcttcccatcccgacccccgccagtcgcctcgcgccctcgactccggactccggtcctccgcacaccggccggtgaccctgcgtttgaacctgctatagaaatttataaaatggcccgcgggttgatgccgacaaccaacggagatggatgcactgcctgctggacaaaaggaagaagaaaaaccagccgcttcgaggtaccccaattcccccccttatagtgggagtcgtaattacggcgcgccttcacggggacggaccgtctcccccaaccgtgcccggaactgggaaaaaaacccctgggcggttacccccaacccttcactccgccccttgcgacgcaaaaatccccccctttccccccccgctcgggggccgttaatacctctaaagaagggccgccccccccgatttccgccccctttccccaaccactttgggccccaagccctgagataggcggccgaacgggatcatttgcgccccccccgggaagatttttaccggggtcacaaacctcccgcgctaaaacaatatcttcccgtacaaaaaccan

SEQ ID NO: 63855 - DNA, 696 bp, Zea mays
  misc_feature: Ceres CLONE 1532363
taagctggagctccaccgcggtggcggccgctctattactagtggatcccccgggctgcaggaattcgtctcacccctagaaaaatttgcactactgctgctcgtctcgtgacatggagctggcctgagacacagagggctaattcctcttactgtcttgtctctcattcccagagctttcttggatcgcgaggaatccactggaaattttgcaattgtaactcagaactgtatcgtcagaacaaagtgcacggcgccggccatgggtaacgcctcggcaccgagacgagcaaggcgtcgctctccccccatctcattgatcacgtcctcgctgttaggtattcctgctgcggcctccaaatttcactctatgcaatctcgacgtgtgaggggaacactgcgccagcccccctctggctgcgttgacaatttcaaaccatgacggctacggccatgttctgcatggtggcatcatgtgacgcgtactcggaccaggacatgatgccattgtgtgcagatcttgtgaaaataaacgacgccctgatctcccaagtaagagtgcgcgccgagaacggtatcttcataatttaaaagataaacctggaatccgtattattaatggctgccgtcagggggcgacgcaccgcgcggccttgcggtgctgaaaccttgttttctccacatactgggtctccg

SEQ ID NO: 63856 - DNA, 854 bp, Zea mays
  misc_feature: Ceres CLONE 1532364
  misc_feature (19)..(19): n is a, c, t, g, unknown, or other
  misc_feature (21)..(21): n is a, c, t, g, unknown, or other
  misc_feature (27)..(27): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
tttttttttttttttttcncnccccanaaaaaatttnnnnnttttttttccccttttaatgatactttcctccatgccagacaattctaaaactagtggatccaccgggctgcaggaattcttctcacccctagaaaaaacaccctaatgctcatttcttctcaatctccccagccgccacagtaaaaaaaacacagccgcccaggagcttccactgatggtctctggccgatcgagccttttttttttattctcatttcttcatttctattacgtgctctcttttccttctgtttttgtaccccgcggtgagctgctctctgtgaattccctttcctacctcagtgcccacctcaaaagaaagcaaaaaaaccccgaacgctctttgttccccattctccccccccacgggaggtccaatttattttttttccccccccccccccgggggggggggggggggcgggaaccttccccacacctcctttctttttttttcacctttcatttcacccctgcccacacacaccctcccctttttccccccgggccggggggcagtatccccccaacaacccccccttctccccctttatgcccccccattacacaaacagcacttcctcgttctcatttcacacctcctttccccccgcaccatttttattcaacaatctacacagattcatttttacacaccatgctccgcccctttaagagtagccttcctccaagtccccgtctcccttttcttttctctccacccacccaacactcccccccctccccatcgtacaatctccccctctccctcccatactctttacgatctgctccccaccgatgtgctcctc

SEQ ID NO: 63857 - DNA, 781 bp, Zea mays
  misc_feature: Ceres CLONE 1532367
  misc_feature: Encodes the peptide sequence at SEQ ID NO. 63858
  misc_feature (10)..(10): n is a, c, t, g, unknown, or other
  misc_feature (11)..(11): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
cccccttatnntttacatagacccccaccccccccctntttctcannanncccaagctggagctccccgcggtggcggccgctctagaactagtggatcccccgggctgcaggaattcgtctcacccctagaaaaaccccgaaccaaatcactcccaccgtctccacagcaaccagcacacatttccctttggcggatcgaaggaaggaaggaggagatgggtggcggcatggaggtgcacaagaaccggtggatcgaagagtggaacgccggccgggagaacctcgagttcaacttccgctggacccgccgcagcctcgccgtcgtcggcctcttcggcctcgctgtccccatcctcgtctacaagggcatcgtccgcgaattccatatgcaggacgaggatgcaggtcggccatacaggaagttccctgtaagaggcgtcccaggggctgcagggaaacgtcgattccctcgacccgggggctggaaaggagggggaagtttccatttccagtttgggtccggataatgggtttagtcccggaatcttgaaggaaaccaattttgggaatggcgcaacttaatggtgccccggatccccaaatgaaataacgggggggaattgaaacccgcgttttgtcgttgtctggcagaaaaagaaaaaaaaaccaacgccgtctccgaggggcaccccaaattttgccccacacaaaggggggggcgaaaaattacgcgggggcgcacacggggggtggccgggtttttaaaaaaagcgggcggg

SEQ ID NO: 63858 - protein, 103 aa, Zea mays
  misc_feature: Ceres CLONE 1532367
MGGGMEVHKNRWIEEWNAGRENLEFNFRWTRRSLAVVGLFGLAVPILVYKGIVREFHMQDEDAGRPYRKFPVRGVPGAAGKRRFPRPGGWKGGGSFHFQFGSG

SEQ ID NO: 63859 - DNA, 628 bp, Zea mays
  misc_feature: Ceres CLONE 1532371
  misc_feature: Encodes the peptide sequence at SEQ ID NO. 63860
  misc_feature (466)..(466): n is a, c, t, g, unknown, or other
  misc_feature (502)..(502): n is a, c, t, g, unknown, or other
aaagctggagctccccgcggtggcggccgctctagaactagtggatcccccgggctgcaggaattcgtctcacccctagaaaaaagtttcccactccccctgggtcttccccatcccccctccactccccccctgggttttccccttcctttaccccccatcagatcttcccccatatctctgtcctgcatcactcgccgccatccactcccgatccaaacccgagagctcccacctccgccgccctgttcgctcgtccgccttttcactccccgtagctagctgctgtcgcggagcaaccccgcgattccaagaaaagcaacttggtcaagaaagagtgcaagaaaggaggacggtgctgacgatgatggcgataagccaccccatgattcgccccatcattccgtcgcctccggggcctgcgcgctagctgctagaagggcctcgccgtccgtcgtggtggtgngtggtggtggtgtgcgcggggcgggaggggaggggnaaagggaagtcgtcactgcgccgccacaatgccacagtaccaggagctgccctgcggcgggcaggagctcgatatcgacaccgcgctcaaggatggcatcctcgggggcgcgctggagcccgtggg

SEQ ID NO: 63860 - protein, 32 aa, Zea mays
  misc_feature: Ceres CLONE 1532371
MPQYQELPCGGQELDIDTALKDGILGGALEPV

SEQ ID NO: 63861 - DNA, 651 bp, Zea mays
  misc_feature: Ceres CLONE 1532373
  misc_feature: Encodes the peptide sequence at SEQ ID NO. 63862
  misc_feature (345)..(345): n is a, c, t, g, unknown, or other
ggcggccgctctagaactagtggatcccccgggctgcaggaattcgtctcacccctagaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgntgtggagtgtaatggagcttccatgcatgagtgaatccatgccatgttatgaatctaggcccttcctttcttgtatctcccatgggacgcggcgtgtgcgtcccctcatgtgtgatgatggccgaagaatactacaaataacacttttttggtaactggttgccaaaacccccacattcttatgagtatcttcccccttaccctcaaaaaaaaaaaaaccggggaccctccaggggaccccaattctcccccttaagggggggcctaattacccccccccccccggggccgtctttttttacaacg

SEQ ID NO: 63862 - protein, 63 aa, Zea mays; identical to SEQ ID NO: 28299
  misc_feature: Ceres CLONE 1532373

SEQ ID NO: 63863 - DNA, 623 bp, Zea mays
  misc_feature: Ceres CLONE 1532376
  misc_feature: Encodes the peptide sequence at SEQ ID NO. 63864
gctctgaactagtggatcccccgggctgcaggaattcgtctcacccctagaaaaactcttttccggctgcgccttcccctcgcagccgccagccctcaacgttcctaccagctgccaccgcctgttacccgtgatgtctcccgcccttgccgctggcgtggagcccatggccgtcgacgattccgcctccaagaaggccaagcgcaagcagctcaaggccgccgccgccgccgcggaggcagaggcggaggccgcttcggtcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatccgctccatttttttaaccaataggcccgaaatcggcaaaatcccttataaatcaaaagaattaaaccgaagatagggttg

SEQ ID NO: 63864 - protein, 110 aa, Zea mays
  misc_feature: Ceres CLONE 1532376
  misc_feature: SWISSPROT Homolog: EC 3.2.1.23 Beta-galactosidase
MAVDDSASKKAKRKQLKAAAAAAEAEAEAASVKKKKKNETLEVPNSPYSESYYARSLAVVLQRRDWENPGVTQLNRLAAHPPFASWRNSEEARTDRPSQQLRSLNGEWKL

SEQ ID NO: 63865 - DNA, 624 bp, Zea mays
  misc_feature: Ceres CLONE 1532377
  misc_feature: Encodes the peptide sequence at SEQ ID NO. 63866
atagctggagctccccgcggtggcggccgctctagaactagtggatcccccgggctgcaggaattcgtctcacccctagaaaaaaattgccttgagacgccgcagcactgcagcagcacagggggggagaaggggcgggcgctcgagtgaacctccactacactactccgcgtctccctcccctggctacgaggctataataacgagcgcggaagacggccggcggcgcacgcagccatgtccgcgcacctccgcctactctcggccgcccacgtctccgcgcccacacccacctccctccaccgcctccgtggccctcctccttctcctcccgcggcccgcctccggctgctgctgcgaccgccgcggctcggggggagccaggcgcgcttcgccggcgccgtccgctgctccggctcggcgtcggcgccggcggtcgcgcgggttggcgaggacagcgacgcggcggcgggcatatgggagcaggtgcgggatatcgtcgtgttcgccggccccgcgctagggctctggatctgcggtccgctcatgagcctcatcgacaccatggtcatcggccagacctccgcactccagctcgccgcgctagggcctgggacagtgttc

SEQ ID NO: 63866 - protein, 129 aa, Zea mays
  misc_feature: Ceres CLONE 1532377
MSAHLRLLSAAHVSAPTPTSLHRLRGPPPSPPAARLRLLLRPPRLGGSQARFAGAVRCSGSASAPAVARVGEDSDAAAGIWEQVRDIVVFAGPALGLWICGPLMSLIDTMVIGQTSALQLAALGPGTVF

SEQ ID NO: 63867 - DNA, 640 bp, Zea mays
  misc_feature: Ceres CLONE 1532386
  misc_feature: Encodes the peptide sequence at SEQ ID NO. 63868
  misc_feature (640)..(640): n is a, c, t, g, unknown, or other
ggatcccccgggctgcaggaattcgtctcacccctagaaaaactctcgcccctctctcccaccccgcagccgccctagcacccgcgacgagcaggatctgcccagttgctcttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcacacagctccttggacaggctgtggcaaaagaaaaaggctgatatcaagcagtagattttacatctagtttaccaagaattggacaccgccctaactaatgttttgattccatgtcactaaatgcaaaggttggggattccccctgggacccttaaatctgaagaatttacaatctagctaaaaaaaaaaaaaaccgaaacccttccggggtcccccattttccccccttaggggagcttttaattcccctggtcctcacccgggccctgtccttctttaacaaccgctcctggaactggggaaaacacccn

SEQ ID NO: 63868 - protein, 81 aa, Zea mays
  misc_feature: Ceres CLONE 1532386
  misc_feature (1)..(81): Pfam Name: Ribosomal_S21e Pfam Description: Ribosomal protein S21e
MQNEEGKTVDLYVPRKCSATNRIITAKDHASVQINIGHLDANGLYDGHFTTFALSGFVRAQGDAHSSLDRLWQKKKADIKQ

SEQ ID NO: 63869 - DNA, 536 bp, Zea mays
  misc_feature: Ceres CLONE 1532387
tcccgcggtggcggccgctctagaatagtggatcccccgggctgcaggaattcgtctcacccctagaaaaaggtcggggttggggagcacaccccatcacccatggcctgactgacctccggactctccctgcttccgtcgccgccgagagccgtacagctgactgctcctgcactcagcccgtcctccatggcgtatgtcaagctcggctccaagactgacgccttctagcggcaatgccaggcatggttctgcacaacaggacttcctagcgatgtcaccgttgaggttgggggatatgtctttccacctctcacaagttcgccttcactttcaaaaagtgccgattctttgaaccgcccaatggacgaaaaactctgaccaagaaaattgccatcatcaaaactaaatgaaatttccaggagggtgccaaaaccatttggaactaacttcccaggttccgcctagggggggaaaataaaatttttaaccagaaaaaagttccaacctaaggaggtgccccaaaaaaaccaaag

SEQ ID NO: 63870 - DNA, 759 bp, Zea mays
  misc_feature: Ceres CLONE 1532393
  misc_feature: Encodes the peptide sequence at SEQ ID NO. 63871
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (24)..(24): n is a, c, t, g, unknown, or other
  misc_feature (28)..(28): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (316)..(316): n is a, c, t, g, unknown, or other
  misc_feature (450)..(450): n is a, c, t, g, unknown, or other
  misc_feature (451)..(451): n is a, c, t, g, unknown, or other
  misc_feature (456)..(456): n is a, c, t, g, unknown, or other
ttttttttnnntcccccccaaaanaccncccnnnntnnnnnnccgccgnnnnnncatacctggactccccgcggtggcggccgctctataactaatggatcccccgggctgcaggaattcctctcacccctagaaaaaacgtcagccgccccgcgccgagcagacctcctccactagccgccgggccgcacaccaaacgctcctgggaatgccgacgccgacgatgggcaggccttttccgctcttcttcttcatcgtcgtcgtcttgctggtccggtcgccggcgggtgcggcggccgacggcggcgggaacacnaccacggattcctgcccgctagatctgggctacgtgcggacattcccatgggaccctttgcccgggccgggggggcgcgcccaacgtgaaaattttgtttttccccccccccccttggggaaagaaggggggtnnctttnccaaaaaacctccccccaaaaggggctcaattacaacacccacgaaccggaaggaggcctccaacggcctcgcacccaaagcctttacagggaacccctatttccaccccgcggcccgcgaaagccctcctccggaatcctcctctctgggggggcggaaaagaactccccggggaccccgaacccacgtttggccacaatcatacttacccccaacacgacgccgcgccgatccctcaccccccctccctaagtagccgggacctccctcgctcgtgaaacacaacacccccccacagtacg

SEQ ID NO: 63871 - protein, 161 aa, Zea mays
  misc_feature: Ceres CLONE 1532393
  misc_feature (76)..(76): Xaa is any aa, unknown, or other
  misc_feature (78)..(78): Xaa is any aa, unknown, or other
MGRPFPLFFFIVVVLLVRSPAGAAADGGGNTTTDSCPLDLGYVRTFPWDPLPGPGGRAQRENFVFPPPPLGKEGGXLXQKTSPQKGLNYNTHEPEGGLQRPRTQSLYREPLFPPRGPRKPSSGILLSGGAEKNSPGTPNPRLATIILTPNTTPRRSLTPPP

SEQ ID NO: 63872 - DNA, 642 bp, Zea mays
  misc_feature: Ceres CLONE 1532395
  misc_feature: Encodes the peptide sequence at SEQ ID NO. 63873
tggcggccgctctagaactagtggatcccccgggctgcaggaattcgtctcacccctagaaaaacccacccacccaccgagctgcctgctacacccctgccaagatccatctttccggttccgccgcctgatcgaagtgaacaagcaaggaagagccatggcgagcgagcacgcggcggggggcgatgctaagcatcaccagaagcagagcctgatggacaaggcgaaggggttcgtcgcggagaagatcgcgcacatccccaagcccgaggccacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaaggagtggcgtccggcacaatgccggaccccggctggatcgccgccagcggctccaccgcgctggaagcccccctagaaaaattgagcaaacgccactctaattcccttatttataatggcaccacttttccttcgtccctgattttggttggttggacaaaccattattgggaaattccaaagtcccctggcccccccaggccattgtccggcgtaacggggcccccatattt

SEQ ID NO: 63873 - protein, 161 aa, Zea mays
  misc_feature: Ceres CLONE 1532395
  misc_feature (17)..(157): Pfam Name: LEA_2 Pfam Description: Late embryogenesis abundant protein
MASEHAAGGDAKHHQKQSLMDKAKGFVAEKIAHIPKPEATLDGVTFKGLSRECITLHSSVNVSNPYDHRLPICEVTYTLRCAGKGVASGTMPDPGWIAASGSTALEAPLEKLSKRHSNSLIYNGTTFPSSLILVGWTNHYWEIPKSPGPPRPLSGVTGPPY

SEQ ID NO: 63874 - DNA, 811 bp, Zea mays
  misc_feature: Ceres CLONE 1532400
  misc_feature (18)..(18): n is a, c, t, g, unknown, or other
  misc_feature (20)..(20): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (93)..(93): n is a, c, t, g, unknown, or other
  misc_feature (806)..(806): n is a, c, t, g, unknown, or other
  misc_feature (810)..(810): n is a, c, t, g, unknown, or other
  misc_feature (811)..(811): n is a, c, t, g, unknown, or other
cgcccggcgcataatatntnccccttttttttttannnnannnnncccccccnnnatactggagctccctcggtggcggccgctctagactantggatcccccgggctgcaggaattcgtctcacccctagaaaacttctgccaaaagtgtagagcgggtagatagcctttatacttcgatgcttacagccttgtctcttcgtggacatctcagattatcagttagcctattctataaatttttttgctgtacaaataacatcaggtaatatctgatggtttaattcaagtactggattttctgggaaaattggggatttggaaatgtactggtaaaaaaaaaaaaaaaaaaacaagacgcctccgagggtcacccaatttcgccccctataacggagttcgtaatttacgcgccccctccatctgggccctttcgttttttacaaacccttccggggaacttgggggaaaaaaacccttgggccgctttacccccccagcctttttattccccccttttgtgcatggtaacacctccccccccttttttttcccccaaggctgtggggggataacttatgcgtaaaaaaagggcccccctacacccgaattttcgcccctttttccccaaaacctgttttgggccgccaatctcttggtatatggggtccgaaaagggaaaaacatttttgttgcacgcccggacccaaaaatattttttcgggttataaaaatatttcgcccctctttaaaaaaatatctctggggcgaaaaagaattgggagggttgggccttccttgggtcnattnn

SEQ ID NO: 63875 - DNA, 617 bp, Zea mays
  misc_feature: Ceres CLONE 1532401
  misc_feature: Encodes the peptide sequence at SEQ ID NO. 63876
ggagctccccgcggtggcggccgctctagaactagtggatcccccgggctgcaggaattcgtctcacccctagaaaaactccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagacctgtcagtgttggatgtctggatcttgcatttttggagaataccaatttacctcgttcagggatgcaagtatatttcttgtttaactgcacattactttatatttatgcctgtttcataccttttctcaaaaaaaaaaaaaaaacgagacgg

SEQ ID NO: 63876 - protein, 69 aa, Zea mays; identical to SEQ ID NO: 8575
  misc_feature: Ceres CLONE 1532401
  misc_feature (2)..(69): Pfam Name: Ribosomal_L38e Pfam Description: Ribosomal L38e protein family

SEQ ID NO: 63877 - DNA, 742 bp, Zea mays
  misc_feature: Ceres CLONE 1532403
  misc_feature: Encodes the peptide sequence at SEQ ID NO. 63878
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (742)..(742): n is a, c, t, g, unknown, or other
ccttttagttgtgtgtttttcctctttttatcctttccccccnnnnnnnnnnaaatgggactccccgcggtggcggccgctctagactagtggatcccccgggctgcaggaattcgtctcacccctagaaaaaaattccattcacctcccatccatttctcaccagaagcgaaggcggaggcggaggagcggaggtaggagatctcgagcaagccggaggcagaggagatgaagacgttcgacccgtggccggtcttcttccgccgggagtggaagcgcaactggcccttcctcacgggtttcgccatcaccggattcatcatcacgaagatgacggccaacttcaccgaggaggatctcaagaactccaagttcgtccaggaacacaagaagaagcactgacgaaccaggtgaaggagttgtcagaaacgcatgtttggccagccagttctgttatgcttttgaatgaaaaatttagacccttctttctcgtttccttaatcgaaatgcttgcactctatgttccatttgtaatgtaataagaggcaaatgggattgaaacccacaacaaatcaactttctgattggaaaaatatcgcatgtgttggccccggaattgttgtgggttaaaaaaaaaaaaaaaaaaaaacgaagaaccccttcgaggggacccccaatttccccccctaaaaagggggagggcgctaattaacggcgccggcctctcccgtgggcgccggtn

SEQ ID NO: 63878 - protein, 57 aa, Zea mays; identical to SEQ ID NO: 4512
  misc_feature: Ceres CLONE 1532403

SEQ ID NO: 63879 - DNA, 765 bp, Zea mays
  misc_feature: Ceres CLONE 1532406
  misc_feature (48)..(48): n is a, c, t, g, unknown, or other
gagtgaggtaagaataagattatatggtacggtggggggtgagaaacnttaaaactggaactccaccgcggtggcggccgctctagactagtggatcccccgggctgcaggaattcgtctcacccctagaaaatagaaatagatatctagaaatagaaacgaactaatatatagataatcgaaatcgaaaagaactgtcttttctgtatactttccccgttctattgctaccgcgggtcttatgcaatcgatcggatcatatagatctcccttcaacacaacataggtcatcgaaaggatctcggacgactcaccaaagcacgaaagccagttagaaaatggattcctatttgaagagtgcctaaccgcatggataagctcacattaacccgtcaattcttgggatccaattcgggatttttcttgggcaagtttcgggggaagaaattggaataaatatcgatttcatcccccccgaaaaagttctcttatcggtgcaaacgctgtaccctgaaggattagtgtattagaggaagaagggaaaaaatcgaattgggaaatctattgaaggaatagtgcccaaaaaaaaaaaaaaaaaaccgagacgctccgagggacctcaatttcgcccctaaccatgaacccgcaatttccgcccgcgccacacggggccggtaccctttttaacaacgttcgttgacccgggaaaaaaaccctggggcggtaaaccccacataaaaaatggcaccttggccacttcatata

SEQ ID NO: 63880 - DNA, 773 bp, Zea mays
  misc_feature: Ceres CLONE 1532407
  misc_feature (32)..(32): n is a, c, t, g, unknown, or other
  misc_feature (33)..(33): n is a, c, t, g, unknown, or other
tttttaattttttggttggccagcggacaaannaaaaacacacccactctaaactgggactccacgcggtggcggccgctctagaactagtggatcccccgggctgcaggaattcgtctcacccctagaaaatagaaaatataacctcatcgtccctagctccccacccccaatcagaatcagcgggtgcgtgcgtgcgtgtgtgaatatctctctctctctctctctctctctctctctctctctgcctgcctgcctcacaggctgaaaggcgtgtacatttctgatcagcaccaccggtcgcccgtcggtgcgcgcgtgcatgtaaagcatgcaccaccagctgcagcccaagtgcgtgcatgagcatgacgagtcatgcaatgtgttgtacgtattttacatgatgataagaataacacaccgtgtttagctgcagagaccccgagcagcggttttaaccaaccccccccccaataaaaatcataagggtaccagataaccattaaccatctatcctctccgagaccgctcggaggtacccaattccccccctaatggggaggtgttattaggcgggggctcacttggccgtccttttaaacaacaaacgtggattggggaaaaaaccccgggcggtttccccccaacttttaatccccctttggaataaaaatcccccctcttatcccacacaagtgggcagtaaaataacctaataaaaagagcccccccacccaaaattcgacccctttccccacaaaaattttgtg

SEQ ID NO: 63881 - DNA, 624 bp, Zea mays
  misc_feature: Ceres CLONE 1532411
  misc_feature: Encodes the peptide sequence at SEQ ID NO. 63882
ggagctccccgcggtggcggccgctctattactagtggatcccccgggctgcaggaattcgtctcacccctagacaaactgaaaaagaggaaattgaaaaactaaatgagaaaacctcgacaaaaacaaatctccctaatttcagtcatgaaggcccaggtcgcaccagcaactgtcttggtcttgctcctcctaatctttgctgcggaggctcgtacgtgcatgtcgcgaagccaggaacagaaagggaggtgctttcacgatacggattgtgccgccgtctgcgtcaaacagagcttcaccggaggcttatgcaacgggcggccgccgttcaagcagtgcttctgcactaagccatgcaagagagagagagctgatgctacactccggtcgtcaggcctctgatcatgtgtgcttgatccacatgacagcgcgactctcgcatgtatgcctaggttgatgtgtatgtaataaataaacaaaatagtaaatgacttgttttcttacatgaaagtctaaaaaaaaaaaaaaaaacaagacgctcgaggtacccaattcgccctatagtgagtcgtattacgcgcgctcactggccgtcgttttacaacgtcgtgactggaaaaa

SEQ ID NO: 63882 - protein, 85 aa, Zea mays
  misc_feature: Ceres CLONE 1532411
  misc_feature (23)..(71): Pfam Name: Gamma-thionin Pfam Description: Gamma-thionin family
MKAQVAPATVLVLLLLIFAAEARTCMSRSQEQKGRCFHDTDCAAVCVKQSFTGGLCNGRPPFKQCFCTKPCKRERADATLRSSGL

SEQ ID NO: 63883 - DNA, 620 bp, Zea mays
  misc_feature: Ceres CLONE 1532430
  misc_feature (483)..(483): n is a, c, t, g, unknown, or other
  misc_feature (530)..(530): n is a, c, t, g, unknown, or other
  misc_feature (615)..(615): n is a, c, t, g, unknown, or other
aagctggagctcaccgcggtggcggccgctctagaactagtggatcccccgggctgcaggaattcgtctcacccctagaaaaacggggagtgcaatagagaacctgagatccgatgcgaacaatcagtcgaaggagcggagcgcgggcgcactcactctaacggcgtacctttcgcatgatgggtcagcgaggaaatgggaacagcggcttaagccattaggtgtaggcgctttccagaggtggaatggaagatttacgttcttcctatttgacccgaaaccgatcgatctagccatgagcaggttgaagagagctctaacaggccttggaggaccgaacccacgtatgtggcaaaatacggggatgacttgtggctaggggtgaaaggccaaccaagatcggatatagctggttttcccgcgaatctatttcagtagagcgtatgatgtcgatggccccgagtagagcactcaatgggctanggtggcccccatttcgctttaccaccccagggaaactccgaatacangccgtcatccttagtacagacagactggatggggtgctagatccaaagtcgagaggaaacagcccagatcgtacgctaaggcccntagca

SEQ ID NO: 63884 - DNA, 652 bp, Zea mays
  misc_feature: Ceres CLONE 1532438
  misc_feature: Encodes the peptide sequence at SEQ ID NO. 63885
  misc_feature (432)..(432): n is a, c, t, g, unknown, or other
  misc_feature (440)..(440): n is a, c, t, g, unknown, or other
  misc_feature (497)..(497): n is a, c, t, g, unknown, or other
  misc_feature (568)..(568): n is a, c, t, g, unknown, or other
  misc_feature (652)..(652): n is a, c, t, g, unknown, or other
aaagctggagctccccgcggtggcggccgctctagaactagtggatcccccgggctgcaggaattcgtctcacccctagaaaaaaaagactcaatacacaagcagagctcaaacaattcttgcttcccgctagctagctcgcaagaaataatggctccacttcttcttgcttctcgcacagcctgtcatcctggccttacaagcagccgccatgataatggccggcacggcctttcttcttcaccgggaagtagtagtaagcgaagccgtagccttagcttcataccacgagctgaaaagacgacgacaggcggtgagggtcatgttgtgagcgaaaagctgagcccctggcaaatcccccagaggaagtggttcccccctagctttatctttggtgccgccacttcagcataccaaattgaaggcgctggnaaacgaangtgcaaggggccaagcacttgggacgacttttctgcacaatatcccgaatggatagncgaacggagcactggggatgttggaacgaactcctactacctgtataaagaaagatgtcatattgctgaangaaatggggtatggacgccctacaggttcctctattccttgggcccaaaatactgccaaaaggggacgctccgagggaaggatn

SEQ ID NO: 63885 - protein, 167 aa, Zea mays
  misc_feature: Ceres CLONE 1532438
  misc_feature: SWISSPROT Homolog: EC 3.2.1.21 Beta-glucosidase
  misc_feature (97)..(97): Xaa is any aa, unknown, or other
  misc_feature (116)..(116): Xaa is any aa, unknown, or other
  misc_feature (140)..(140): Xaa is any aa, unknown, or other
MAPLLLASRTACHPGLTSSRHDNGRHGLSSSPGSSSKRSRSLSFIPRAEKTTTGGEGHVVSEKLSPWQIPQRKWFPPSFIFGAATSAYQIEGAGKRXCKGPSTWDDFSAQYPEWIXERSTGDVGTNSYYLYKERCHIAEXNGVWTPYRFLYSLGPKYCQKGTLRGKD

SEQ ID NO: 63886 - DNA, 655 bp, Zea mays
  misc_feature: Ceres CLONE 1532463
  misc_feature: Encodes the peptide sequence at SEQ ID NO. 63887
aaaactggagctcaccgcggtggcggccgctctagaactagtggatcccccgggctgcaggaattcgtctcacccctagaaaaacccgctcactccgagtctcactctcactccgtcctccctcttccttacagaaacacaactcatgcagctcgtacggcaccaccaccaccaccaccaactgccgcactgacacatgcatgcgcagaaagcagctagctagcggccggtggccttgagagccgctcgctagcttttaaaattagccaccaattcaatctctagctagcttgggggagctccgttcctagctacacgtacgggcggcgcggcaaccaccagccgtgtagccgacctagtacgttggagcgaagcatatatcggcggccgcatcacatggagagcgcgatggagaaggtgtgggagtcggggcggcggatgagccggagcatcgggcggggcatgggcatggaggcgtggggcgtcgacgacgccttcgtgccgcagcacggctcccggtcccggggcggcggcggcggcggcggcaacaacaacgaggaggcgctgcgctgggcggccatcgagcgcctgcccacctacagccgcgtgcgcaccgccatcctgtccacgagaaacgccgccgtggttgacgaca

SEQ ID NO: 63887 - protein, 86 aa, Zea mays
  misc_feature: Ceres CLONE 1532463
MESAMEKVWESGRRMSRSIGRGMGMEAWGVDDAFVPQHGSRSRGGGGGGGNNNEEALRWAAIERLPTYSRVRTAILSTRNAAVVDD

SEQ ID NO: 63888 - DNA, 631 bp, Zea mays
  misc_feature: Ceres CLONE 1532470
  misc_feature (592)..(592): n is a, c, t, g, unknown, or other
tccccgcggtggcggccgctctagaactagtggatcccccgggctgcaggaattcgtctcacccctagaaaaagcagcagcagcagcagcagcgcctcatcactcgcgtccctctcttttcctcttctccattccgtcgcgtgcacagaaattccttcctctgcctccctgttcagctctccttttcccttcctcctgtaattctgttcgtgtgcgtgtaatttccgtgcaaataatacacgcacgccgattttcgaaagcatcgaaagcaaaaaaaaaaaaaaaggcgacggcaaggaatcccccgattaggaaagattctccgctccccgccttcaaatcccccaccggccaccacgacccgtctcgattcgcatacgctctgtgctgccgaggtcgggattggtgctggaattcggtgcgccgagttgttccttgctcgattagacttccggttcggttcgcttcgttccaatcggggcttgctgcttccgccgccaccggtgcgctccgagctgctcaagctgggcgccggataccctctcgggctgcccgatctgattcggtcccaaacacacccccgctcccgcgntgtggctgccgctccctccccgctgactccggcgccatt

SEQ ID NO: 63889 - DNA, 637 bp, Zea mays
  misc_feature: Ceres CLONE 1532472
  misc_feature: Encodes the peptide sequence at SEQ ID NO. 63890
  misc_feature (371)..(371): n is a, c, t, g, unknown, or other
  misc_feature (424)..(424): n is a, c, t, g, unknown, or other
ggagctccccgcggtggcggccgctctagaactagtggatcccccgggctgcaggaattcgtctcacccctagaaaatattattcgtcaggcagtagctttgtatttaggtaggatcctgagataatacatgttatttctggtcgatatttattagttgcattgaactgtattctgggttgctcatcacttgtatgttaaattggaggaaaattgatgctatgagcttcaggtgaatctgtttcgtgcctgtgttctttctaaaaaaaaaaaaaaacgagacgctcgaggtacccattcggcctatagtgagtcgtattacgcgcgctcactggccgtcgtttttacacgtcgtgactgggaaaaacctgncggttaccaacttaatcgcctttgcaccacatcccccttttggccaggtgggntaattaacaagaagcccggcccgattgccccttcccaacagtttgcccagcctgaatggccaaatggaaaattgtagccgttaatattttggtaaaaattcgcgttaaattttttggttaaatcaacctcattttttttaacccaattaggccgaaattcgggcaaaatccccttataaatcaaaagaatagacccgagataggggtttgaat

SEQ ID NO: 63890 - protein, 41 aa, Zea mays
  misc_feature: Ceres CLONE 1532472
GAPRGGGRSRTSGSPGLQEFVSPLENIIRQAVALYLGRILR

SEQ ID NO: 63891 - DNA, 665 bp, Zea mays
  misc_feature: Ceres CLONE 1532473
  misc_feature: Encodes the peptide sequence at SEQ ID NO. 63892
  misc_feature (422)..(422): n is a, c, t, g, unknown, or other
  misc_feature (424)..(424): n is a, c, t, g, unknown, or other
  misc_feature (451)..(451): n is a, c, t, g, unknown, or other
  misc_feature (453)..(453): n is a, c, t, g, unknown, or other
  misc_feature (488)..(488): n is a, c, t, g, unknown, or other
  misc_feature (623)..(623): n is a, c, t, g, unknown, or other
acccgcggtggcggccgctctagaactagtggatcccccgggctgcaggaattcgtctcacccctagaaaaattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttgttgccgttgttgttgaagacgcgtagctcgctagggttcgtgatttctcgccgatcggttcgggaactggtaagctatggatctctcgcggcccgcatcgtcagacctctcgctcgggctgcactctcatggccacgcccacgctcgcgtgcatgcggnanccgcgccgctgcgcctgttcgacaacncnaagccggaaccgcctcgtggccggggaagcccacncggaaaggggacgacgggggaccggtgggcaccaagactttctccctcctcgggaaactccctcttggttcaaggggccggcggccgcggccgtcaaacagacgttgggggccccgggagatgaaaaaaacgttnattcctggctccgttccccgggggcctggcgccccccaccaa

SEQ ID NO: 63892 - protein, 90 aa, Zea mays
  misc_feature: Ceres CLONE 1532473
  misc_feature (28)..(28): Xaa is any aa, unknown, or other
  misc_feature (29)..(29): Xaa is any aa, unknown, or other
  misc_feature (38)..(38): Xaa is any aa, unknown, or other
  misc_feature (50)..(50): Xaa is any aa, unknown, or other
MDLSRPASSDLSLGLHSHGHAHARVHAXXAPLRLFDNXKPEPPRGRGSPXGKGTTGDRWAPRLSPSSGNSLLVQGAGGRGRQTDVGGPGR

SEQ ID NO: 63893 - DNA, 772 bp, Zea mays
  misc_feature: Ceres CLONE 1532509
  misc_feature: SWISSPROT Homolog: EC 3.2.1.23 Beta-galactosidase
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (48)..(48): n is a, c, t, g, unknown, or other
tatatacccctctccccccaccccccattatatttnnatctaaanacnaactaaagatggactccaccgcggtggcggccgctctataatagtggatcccccgggctgcaggaattcgtctcacccctagaaaaaaaaatctgtatatgtgtttcccgcattaaccaccctatgctgaagcaaccatctgcaattgttgcagagtttatattcttcattgtgctggactaagttgattatacattcgtgcttctactttgtgtatgtatatatctgacctatagttgctgaacatagactatttcacttgcctctagttgaacactatgtgaaacgagacgctcgaggtacccaattcgccctatagtgagtcgtattacgcgcgctcactggccgtcgttttacaacgtcgtgactgggaaaaccctggcgttacccaacttaatcgccttgccgcacatccccctttcgccagctggcgtaatagcgaagaggcccgcaccgatcgcccttcccaacagttgcgcagcctgaatggccaatggaaattgtaagcgttaatattttgttaaaactcccgttaaatttttgctaaatcacctcaattttttaaaccaataggcccaaactccacaaaaatccccttattatatcaggaaggaattgcgccgaaggaaagggtttgaagttgttggttcccaacctttgggaaacaaaatatttccatcctatttaacaaaaaaccgttgtacacttccacacccgtctatag

SEQ ID NO: 63894 - DNA, 731 bp, Zea mays
  misc_feature: Ceres CLONE 1532513
  misc_feature: Encodes the peptide sequence at SEQ ID NO. 63895
  misc_feature (20)..(20): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
gcgcgccgctttatttcctncccacctccctcacaagggnnnnnnnnnnnntctagctgggactccaccgcggtggcggccgctctatcactagtggatcccccgggctgcaggaattcgtctcacccctagaaaaaataccctaatgctcatttcttctctatctcgccgtccgccacagtaaaaaaaacacagccgccagggtagcttcgacggatggcctctggccgatcgagccttttttttttattctcatttcttcatgtctattacgtgctctcttttccttctgtttttgtacaccgcgttgagctgctctctgcgtattatcttcactagtaaagtgagaagctaattgcctgtgctggaaaaaaaaaaaaaatgacaagacgctcgaggtacccaattcaccctattgggagtccatattacgtgcgctcactggccgtaattttgaaaaggctggaccccccacaaccctggcattacccgaccttattcgattgcgacacaaccccctttcgcctactggtgtgataaaagaacaaggcccgattcgtattgcccttcccaaacatttgcacacccttgaaatgagagaatgggaatatgcacagcgttaaatatttatggataaaaattccacagttaaaattttgatgggttagatccgccctcttgttatttttaaaccccttaaggtctaaaattacgcgtgcgaatctcccgtt

SEQ ID NO: 63895 - protein, 40 aa, Zea mays
  misc_feature: Ceres CLONE 1532513
MASGRSSLFFLFSFLHVYYVLSFPSVFVHRVELLSAYYLH

SEQ ID NO: 63896 - DNA, 860 bp, Zea mays
  misc_feature: Ceres CLONE 1532514
  misc_feature: Encodes the peptide sequence at SEQ ID NO. 63897
  misc_feature (5)..(5): n is a, c, t, g, unknown, or other
  misc_feature (6)..(6): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (70)..(70): n is a, c, t, g, unknown, or other
  misc_feature (76)..(76): n is a, c, t, g, unknown, or other
  misc_feature (86)..(86): n is a, c, t, g, unknown, or other
ttttnnaaaaaaaaaaattnnnttaagccttcccccncccggaaaannnnnnacaacaggaactccacgnggtggnggccgctctntttctcccccatcccccgggctgcaggaattcgtctcacccctagaaaaaaccatctttttcttcctcgcgccgccgccgccgtgacggaaggaagaggaggagcaaggagcacgacgcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccacggtgctgctgggggaaaattcctacctcttttaaacgcccccttcggggggggggggggggggttccccctttatcttttttggttcagaatttggaacaccccaggagtaaagactccagcgtggttgagaagttgggggagggccgacctttctgggcctggtcgccacacccccctacaaacccgggaaggacgggggggcacttatccccccccgcgctcgcttagagaagaggcccccgccagaacgcgcgtcgggggggtgcggcgacgatcgcagccctggtggggaggggtgcattaaggtgcgcgggcggcgggtgacggagaagagagcagctgtgtgacactcacgcctcacgtttgcgggaggcgcgcccccgtgggttcaccgcgccccctctgtgcacccgcgggtggcacacaccaattgggcccactctcggagcatcacgcgcactccaccagcgag

SEQ ID NO: 63897 - protein, 56 aa, Zea mays; identical to SEQ ID NO: 1999
  misc_feature: Ceres CLONE 1532514
  misc_feature (3)..(56): Pfam Name: Ribosomal_S14 Pfam Description: Ribosomal protein S14p/S29e

SEQ ID NO: 63898 - DNA, 689 bp, Zea mays
  misc_feature: Ceres CLONE 1532515
  misc_feature: Encodes the peptide sequence at SEQ ID NO. 63899
  misc_feature (387)..(387): n is a, c, t, g, unknown, or other
  misc_feature (399)..(399): n is a, c, t, g, unknown, or other
acccgcggtggcggccgctctagaactagtggatcccccgggctgcaggaattcgtctcacccctagaaaaacgagattgtggagcagagctggacagccgactagtgcaggaggaggatgctcatcgtgcccgaaagggcacaataaggaaccatgaaaaaccatccttgtgtttgtggttcgccagacctgtcgaaacattgaagaactctagttctagtctgtcgttgtcatggttttggtctgatccagagcaccggttgctcatggtggtggctgtcgtaatgtagcggttgttgttgacctatatcttctcaagatttaaaatgatcctgcttgtgtactttttttttccccccaccagaggggcagaagggggcaattcnccctaaattgantcctattacccccgctcacaggacaacgttttaccacctctggactgggaaaacccttgcctttccccacttatccgcctttgcacaacatccccccttctccccggtggggaaaaaaggcaaaaaagccccgcccgatttccccttcccaaaatattgcgcaccccgtaatggccgaaggttaaattgtaaacgcttaatttttttgttaaattgccccccccaattttcggttaaattcacctctgttttttttatcccatatagcgctaaaatacgagcaaaatccg

SEQ ID NO: 63899 - protein, 96 aa, Zea mays
  misc_feature: Ceres CLONE 1532515
TRGGGRSRTSGSPGLQEFVSPLEKRDCGAELDSRLVQEEDAHRARKGTIRNHEKPSLCLWFARPVETLKNSSSSLSLSWFWSDPEHRLLMVVAVVM

SEQ ID NO: 63900 - DNA, 714 bp, Zea mays
  misc_feature: Ceres CLONE 1532516
  misc_feature: Encodes the peptide sequence at SEQ ID NO. 63901
  misc_feature (390)..(390): n is a, c, t, g, unknown, or other
  misc_feature (391)..(391): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (447)..(447): n is a, c, t, g, unknown, or other
ccaccgcggtggcggccgctctatttctcctggatcccccgggctgcaggaattcctctcacccctagaaaaaagacacaccgacgcgtacgtagcacagtccattattgccgtctcccttttgcgtgagcaaagaaagagagcgagaagcagtcgccatgtctggcatcatccacaagatcgaggagaagctccacatggggggcgaccacaagaataaggaggaggagcaccccaagaaggccgaggagcaccacaagaaggagggggggtatctttaccttattggatcgggttggatttgaaccggatattatgcttttttctttttttttgggtggccggtggttttctgtcccccccccccccaagagaaagaaaaggggtttnnttnnntncnnnnnnnnnntttttaccccaaacaaaaaaaaaaacccattccccccnggggggggggggaatccccccccctcccctttccccccctttatacaacctcttcgactggaaaaacccccggcttaacaccaccttatccccccttgccccactctccccctttcccccgcttggtgtaaatatataaaaaagcctcccccccaacccccctcccccactacttctgcccctcttttattttcttatgtgaaaccttatactcccccatacactctcctgtacccgctcgtgttatttttttttccactcctctcg

SEQ ID NO: 63901 - protein, 48 aa, Zea mays
  misc_feature: Ceres CLONE 1532516
MSGIIHKIEEKLHMGGDHKNKEEEHPKKAEEHHKKEGGYLYLIGSGWI

SEQ ID NO: 63902 - DNA, 497 bp, Zea mays
  misc_feature: Ceres CLONE 1532518
  misc_feature: Encodes the peptide sequence at SEQ ID NO. 63903
  misc_feature (434)..(434): n is a, c, t, g, unknown, or other
ggagctccccgcggtggcggccgctctagaactagtggatcccccgggctgcaggaattcgtctcacccctagaaaaaaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaaaccgtccgccgccgaaaaagcggcgggcgttttaaaaagggtttaaaaacaaaaaacccccccgggggaaaaccccccaaaggagagggggggaaaaaaaaaaaattttaaaaacccggggggggggggggggggggggccaaaaaaaaggggggccccccccccctctccccccccttttttgtgggggnttagagtttaaaaaaaggaaggaccctcctccccgggggggagggggagaaaaaggaagaagg

SEQ ID NO: 63903 - protein, 43 aa, Zea mays
  misc_feature: Ceres CLONE 1532518
MASLKAAKPSGVAAQGKEPAPKLSETATKPSAAEKAAGVLKRV

SEQ ID NO: 63904 - DNA, 644 bp, Zea mays
  misc_feature: Ceres CLONE 1532519
tccccgcggtggcggccgctctatacctagtggatcccccgggctgcaggaattcgtctcacccctagaaaaagaatggtcaacagtgtgagattccctgctggtcttgccacgcccttttcggtttggcttcgcgtctggaatgtgtatacaggattactggtcagaattctgagaataacgagaagattctctgctgggatagtgggattccctgcatatttatgtgaaaccagctgtcggtctttatgcacagatgcaacagcaacacaaatctggtaggaacactggtgggtttctgtcgataatttgagtgtatatgtaatattatgtaatctacttccagggtaaacataccctaaacccgaggtggggggaagagcccaagaaaattttacaaaaaatcccccaccccccccctgtaaaaaacaaaacccctccgagggacccccattccccccccaataggaagcccaaattaccgccggcgcccccggggcctttttttttttttaacatccttccggcaattgggaaaaaaaactcttggggcgcgttttcccccccacctttaattttccccctcttgacaaaaaaaaatacacccccccttttttttttcccaaaagtggggtgcgtaaaag

SEQ ID NO: 63905 - DNA, 711 bp, Zea mays
  misc_feature: Ceres CLONE 1532521
  misc_feature: Encodes the peptide sequence at SEQ ID NO. 63906
  misc_feature (76)..(76): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
ggagctccccgcggtggcggccgctctataactagtggatcccccgggctgcaggaattcgtctcacccctagaanannnnnnaaaaaaaaaaaaaaaaaaaaaaaaagttttagtaatttccttggtgaccgtggaaggcgcagcgtgggactctatgtacatgtgcatctgctcctcatgtctatgcatatgacaacgttgccataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgccctttcccaacagttgcgcagcctgaatggcaaatggaaattgtaagcgttaatattttgttaaaattcccgttaaaatttttgttaaattcaactcatttttttaaaccaataaggccaaaatccggcaaaatcccctttaaatctcaaaaaaattaaacccaaaaatggggttgaatggtttttcccctttttggaaaaaaaaatcccccttatttaaaaaaaaggggggacccccaacggccaaaggggggaaaaaaacccctttttttaggggggaatgggccccacttacgtgaaaccccccccccg

SEQ ID NO: 63906 - protein, 41 aa, Zea mays
  misc_feature: Ceres CLONE 1532521
MEIVSVNILLKFPLKFLLNSTHFFKPIRPKSGKIPFKSQKN

SEQ ID NO: 63907 - DNA, 842 bp, Zea mays
  misc_feature: Ceres CLONE 1532523
  misc_feature: Encodes the peptide sequence at SEQ ID NO. 63908
  misc_feature (842)..(842): n is a, c, t, g, unknown, or other
atttctatgtcttgcgctactcttccaatacctaatcgcgcacctcgcgcgtctcaaacatgcaactccacgcggcggcggccgctcttaaaatagtggatcccccgggctgcaggaattcgtctcacccctagaaaaagtcgcctcacgctcacgctcacgctgcttgctcctcctcccccatccctccgcccctcccatggcgtccctcttcggggctcgccgccggcgatcgccggagtacgacggcgaggacgatagatccggcggagggagggccaagcaccgacgcctgttcgccggaggaggctgcggcgtctccggcggacccaggcgcggcgacggggacttagccacggactgggctctccggcttcgtcgtccggagcaaagagggcccatttctttccggtttgctggcctccttccgcccgaaggaaaaacccgggctcctgggggaagaaccgggggaaggttgcccccacgcaagaagggatggaacgaaccgaattaaccaagaaaggggcttctcacctttccattgtaaagatggaacaattatttccctgtgaatattcccccggggggaaaaataattttcccttatctggcggggggtccaaaaaaacttggctttttggaagaccaaaattgggtttttcggaaggggaaaacccacttctctcaagggggcttgaaattgcgtgaatgaggggagggggcaaaaccccttaacaataaatcctcaacctttttgggaagaatatctccactctctccgggaaaacctcccgtgcgttctttgtggcaaccgccctcaaagagaaaatctccctttcaan

SEQ ID NO: 63908 - protein, 104 aa, Zea mays
  misc_feature: Ceres CLONE 1532523
MASLFGARRRRSPEYDGEDDRSGGGRAKHRRLFAGGGCGVSGGPRRGDGDLATDWALRLRRPEQRGPISFRFAGLLPPEGKTRAPGGRTGGRLPPRKKGWNEPN

SEQ ID NO: 63909 - DNA, 829 bp, Zea mays
  misc_feature: Ceres CLONE 1532533-R2
cctcgagcgtctcgtttttctgtttttttttataaagtgcacatgacttattttttttatccggcgaaaacacttagaacctttcactcaatgtccaaagagcccattttttctaagttttctgaaatgaacagccctacggccccaactgaaaataagtggtaatgcacgggctacctagtgatttttaatacccaaatcgggggagcaggagcacagcaacccccctccctgaccctgcgtgcgctttcatgaatacaggcatacagctacagtacagtgggccccgacggggcacattattctaccaaaaaggggtttagttttattgattaactagggggcaagcgtggtgggaaaacacctgtcgtgcacccatctaaggacgtcccggtagcccctgtcaatgggaaaggagtcgtaaaccttgctgcccctgctcttcttgtattcaaacaccaccaacaagtggttaaaggccgtgaccttgacaaacccaaaatcttattcccggtaaatgctccacttggggatggccgtggtgtacctggacaggtggaacccgcccccgccggcaactacaaaaatggtgccgttcatggcccccgagtaagtggggcttctccctggtcatgcactggctctggtacatggggcaaggcccctcgtaatttgtgaacgtggccaaaaaaagccatgtcaacccggtacttctgccaaaggggcctgaaggttctcgcgggccctctggctcccctcgaagacccttcccccgggttacaaggggtgggaagaatacccccacccccccggggcgtggcgaaaaaaa

SEQ ID NO: 63910 - DNA, 868 bp, Zea mays
  misc_feature: Ceres CLONE 1532533-R
ggggtggcgggcgctacacttataccgtatcaatcaatgtagcaaagaagccatattttcatagttttctgagatgaaccgccctacggcaccaactgagaataagtggtaatgcacgggctagctagtgatatttaatacacagatcgagggagcaggagcacagcaacaccactccctgaccctgcgtgcgctatcatgaatacaggcatacagctacagtacagtgtgcctcgacggggcacattattctaccaataagtggtttagttttattgattaactaggtggcgagcgtggaggggaagcagctgtcgtgcacgcatctgaagacgtcgcggtagtccctgtcgatggtgaaggagtcgtagaccttgctgtcgctgctcttcttgtattcgaacagcaacgacaagtggttgaaggccgtgagcttgacgaagccgaaatagtactccgcggtagatgctccaccttggggatgggcgtgggtgtaactggaccaggggggaaaccgtccgcccccccggcgaagaccaaaagatgggtgccgtttcatgggtcccctggaaggaaggtgaggtctttctcgcctgggacatggccctggggcctcggggtacatgcggaggccaggggccggcttccgtagttgttgggacgggggcccgaaagaaaggcgaatcgcccgacggggggccctttctgcccaccagagcgcgggaagggtccatccgggccccttggggttccctccgaggaaccctttcgccggcggtcccagggctttgggaggaataccccactccggggggtgcgggggccaaaataaacccacgggtggggggatgtgggtccaccggggaaa

SEQ ID NO: 63911 - DNA, 679 bp, Zea mays
  misc_feature: Ceres CLONE 1532536
  misc_feature: Translation starting site: 241
  misc_feature: SWISSPROT Homolog: EC 2.7.11.1 Non-specific serine/threonine protein kinase
  misc_feature (413)..(413): n is a, c, t, g, unknown, or other
  misc_feature (456)..(456): n is a, c, t, g, unknown, or other
  misc_feature (457)..(457): n is a, c, t, g, unknown, or other
  misc_feature (564)..(564): n is a, c, t, g, unknown, or other
  misc_feature (598)..(598): n is a, c, t, g, unknown, or other
  misc_feature (653)..(653): n is a, c, t, g, unknown, or other
  misc_feature (656)..(656): n is a, c, t, g, unknown, or other
  misc_feature (679)..(679): n is a, c, t, g, unknown, or other
tccccgcggtggcggccgctctagaactagtggatcccccgggctgcaggaattcgtctcacccctagaaaactcgctggtcgcctccctcgtccctcgcatcttctccctctttctctctccagcccagtagcctgtagccccccccccccctcctctctctctcttcctcccccactcgcacagtgcccaatgccgcacaaaccctagtgcccccactcccaatctcgcgcggcggccatgggaaactgctgccgctcgccggccgccgcggcgcgggaagacgtcaagtcgtcgcacttcccggcctccgccggcgggaagaagaagccccaccaggcgcggaacggcggccccggctcccgggagaagaagcgtctgtcggtgctcggggaaggaggggtgcgacgtgngcgccggcgggatcgaggagaagtacgcgctggaaccggagcnntgggcgcgcgagtttcggggtgacgtacctgtgcatggaccggggcacgcgggagctgctggcctgcaagtccatctccaaagcgaagctgcggacccccgtcaacntggaggaacgtgcggcgggagtggccatcatgcngcacctgccaggagcctcagcatcgtgtccctgcgggaagcgtgcgaagacaacngcnccgtgcacctcgtcatggagctn

SEQ ID NO: 63912 - DNA, 763 bp, Zea mays
  misc_feature: Ceres CLONE 1532538
  misc_feature (763)..(763): n is a, c, t, g, unknown, or other
tctagaacctagcaaacgttatatgataccaaaataaccaacccaccaaccccaaatactggaactccccgcggtggcggtcgctcttaaactagtggatcccccgggctgcaggtattcgtctcacccctagaaaattttatacaaggaaaatatcccaggccatgtgttgctgttgcattccatctccatagacaagtaatcccaatcccgtcctacctggatggttcctgcctgtctgtcgcctcgtgacgtctgtgcaagaacactcgctccccacctgttcgctgcttcttcttcttgccaatctgctccttcttctagctagatcttggatggagctggggatgacgatggaggtagcgaagatcatctaggtatgtagagtacgcggctgctagttagttcaccagggcagcaagcgagctccagcttcgtcccatcgatagatgccagctgcccccccgtggcagccattcatcagatgtcagatcttatattccccccatccccgctactagttggtggttaggcaatcccaccaagcaggaaacaccccgttaacgaaaccatggccatgaaacccgttcctaaagggtggccctgggctacaggcgggaatccgcctttgttcctgggggcctgggcggtgcttccccggccggttgccggtttcctggaccccattgggaccacagggggtgggcctccctcggcctggtgcccacccactgcctcgaaaagagtgttattcactagggcn

SEQ ID NO: 63913 - DNA, 659 bp, Zea mays
  misc_feature: Ceres CLONE 1532540
  misc_feature: Encodes the peptide sequence at SEQ ID NO. 63914
tccccgcggtggcggccgctctagaactagtggatcccccgggctgcaggaattcgtctcacccctagaaaaagttccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttgttgagtggatggtggtgtccactcccgccttgaccaactgcagttacttctgaaaggtgtcagtgagagaggagcaaaaaaattcgtgtgcacatccttaccgatgggcgtgacgtt

SEQ ID NO: 63914 - protein, 140 aa, Zea mays
  misc_feature: Ceres CLONE 1532540
  misc_feature (15)..(140): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSGWWCPLPP

SEQ ID NO: 63915 - DNA, 680 bp, Zea mays
  misc_feature: Ceres CLONE 1532542
  misc_feature: Encodes the peptide sequence at SEQ ID NO. 63916
ggagctccccgcggtggcggccgctctataactagtggatcccccgggctgcaggaattcgtctcacccctagaaaaatttattgcgcgatgattttattgaaaaagatcgttctcgcggtatctttttcactcaagactgggtatccatgccaagtgttataccggtggcttctgggggtattcatgtttggcatatgccacctctgacccaaatctttggagatgattccgtattacaatttggaggaggaactttaggacatccttggagaaatgcacctggtgcatcacctaatcgtgtggctttacaagccagtgtacaagctcgtaacgaagggcgcgatcttgctcgtgaaggtaatgaaattatcaaagcagcttgcaaatggagtgctgaactatccgcatcttgggaaatatggaaggagatcatatttgatggtttcaaagcgatggataccatataaaataaaaaaaaaaaacgagacgctcgaggtacccaattcgccctatagtgagtcgtattacgcgcgctcactggccgtcattttactacccctagactgggaaaaccctggcgttaccccacttaatcgccttgcaacacatcccccttttcccacctggcgtaataccgaaaaggcccgcaccgatccccctttcccaacaattgcgcaa

SEQ ID NO: 63916 - protein, 106 aa, Zea mays
  misc_feature: Ceres CLONE 1532542
  misc_feature: SWISSPROT Homolog: EC 4.1.1.39 Ribulose-bisphosphate carboxylase
MPSVIPVASGGIHVWHMPPLTQIFGDDSVLQFGGGTLGHPWRNAPGASPNRVALQASVQARNEGRDLAREGNEIIKAACKWSAELSASWEIWKEIIFDGFKAMDTI

SEQ ID NO: 63917 - DNA, 791 bp, Zea mays
  misc_feature: Ceres CLONE 1532543
  misc_feature: Encodes the peptide sequence at SEQ ID NO. 63918
gccgcctttttcgcccgttcgctggcgcgcggggcggggccccgcaaccaacactgaaatccaccgcggtggcggccgctttccaataggggatcccccgggctgcgggaattcgtctcacccctgaaaaacccgaccgcttcttcgcaaacctccccctctcccatcgacttcctcggtcgtccgtcgcacggccacggatcaccctcttccttcgtcttcctccacaaaacctacagcgctggtgcgccgaggaagctagctagctagcccggccggccggccggcgccatgcctcccgtgaaggccgaggacctggttgtgcacgccgtcaaggagcagttcgccggcctcgactactgcatcaccagccccccgccatggatcacgacggtgctcgttggcttccagcactacctggtcatggtcggcaccacacgtccttcatcgccacccccctcgttcccgttcatgggcggcggccatgccgagaaggcgatcgtgaatccgaccatcctgtttcctctcggggataacacgctgctgcgggtccactttcgggacgcggcctccccgcccgtgatgaggccggctcctacaacctacgatgtaacccggggcgtggcgcattcaccccttggagccccgcgattacggcgcctcccgcagtcgaaccccttttcgcgaaaaattccggggttcaccaaatagagggtccgcttccccggaggaggcggcttcattcattcggcccggggtgttcttttccgcgggccgtattcggttggagg

SEQ ID NO: 63918 - protein, 139 aa, Zea mays
  misc_feature: Ceres CLONE 1532543
MPPVKAEDLVVHAVKEQFAGLDYCITSPPPWITTVLVGFQHYLVMVGTTRPSSPPPSFPFMGGGHAEKAIVNPTILFPLGDNTLLRVHFRDAASPPVMRPAPTTYDVTRGVAHSPLGAPRLRRLPQSNPFSRKIPGFTK

SEQ ID NO: 63919 - DNA, 660 bp, Zea mays
  misc_feature: Ceres CLONE 1532547
  misc_feature: Encodes the peptide sequence at SEQ ID NO. 63920
ccccgcggtggcggccgctctagaatagtggatcccccgggctgcaggaattcgtctcacccctagaaaaagttctgcaccgaagcaatcatggaggcgcgctgggttcgttcctgacgctcagcccgccgctgccctcatccgcctcgtcgacaaatcacgccacggcttttcttttcttttcgttgctttacaatcgcagttcaggagttgttttaccactagctgcgtgcctgcctgctgccacctccttttttccggctttcacttttccgctctctgccccaacctcaaccacccaaccgcgacctccggccgatttctcttcagtcggggccgggcgcacctcggactcatcaggtgctgctgtgctgggagagtacggccctccttccttgctattgtgaggcattctgtctctctagttatgcgcaacacggccgtcgccgacgcgggattctcgcctgaggctttgagccgagagatcgattggggactcggtttccttcctgcactgagtagggatacgctctgctcggacattctcctgtgggagaataaactggccggaagcttctgggcgctgcggacgctaggatggaggacaagcacgtgatcacggtgagggagctggaccaggtcttcggccggatgctggtc

SEQ ID NO: 63920 - protein, 62 aa, Zea mays
  misc_feature: Ceres CLONE 1532547
MRNTAVADAGFSPEALSREIDWGLGFLPALSRDTLCSDILLWENKLAGSFWALRTLGWRTST

SEQ ID NO: 63921 - DNA, 703 bp, Zea mays
  misc_feature: Ceres CLONE 1532550
  misc_feature: Encodes the peptide sequence at SEQ ID NO. 63922
ccccgcggtggcggccgctctatactagtggatcccccgggctgcaggaattcgtctcacccctagaaaaagatttcccaactttttgttcctcgcgccgccgccgccgccgccgtgacggaaggaagaggaggagcaaggagcacgacgcgatgggccactccaacgtgtggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaacgcctaatttatgcgctttagctttttgttcagaacttgagactcttgtgttaaaactcgacttggaaaagttttgatgggctactttggggctggtggaccagccttcatcaaaaaattggaatttttccctaaaaaaaaaaaaaaaatgaaacccttcgagggtcccaatttcccccttaagtgggatcctaattacccggcgctccctgggcccgtcgttttcaaacacccttggaagggggaaaaaccctgggcgttaccccaatttaatccggcctggcaaaaactcccccccttttcccccagatggggtgaa

SEQ ID NO: 63922 - protein, 56 aa, Zea mays; identical to SEQ ID NO: 1999
  misc_feature: Ceres CLONE 1532550
  misc_feature (3)..(56): Pfam Name: Ribosomal_S14 Pfam Description: Ribosomal protein S14p/S29e

SEQ ID NO: 63923 - DNA, 700 bp, Zea mays
  misc_feature: Ceres CLONE 1532555
  misc_feature (573)..(573): n is a, c, t, g, unknown, or other
  misc_feature (606)..(606): n is a, c, t, g, unknown, or other
  misc_feature (700)..(700): n is a, c, t, g, unknown, or other
tctgaactagtggatcccccgggctgcaggaattcgtctcacccctagaaaaaactcaacccaaacaccacaatccccttcaacaaacgcaccgcactccacggcagccagaaaacacaatccacacagtctccgtgaggtctgagcgaggtaggactagctctgagcgagttcttccgtcttccaggtataatccttgcaactctcactatcctcttcgcatcgctcgtctctttttgagactagttggatttctcttctttttccttggatcctactacctactagaacagagctccggagccttttagttcctgggatctgatctactcattttcctttcttcccctgggggggacataagcaaggcctagttaaaaacccccccccgccgggtcctttgttttttaccctataaccccgcgcgaatttggtcctcttcccttcccagcataaaaaaattaaactgaaaacgccccaggggtcccccattctcccccctaggtgggacccaattataaccgcgcctcctttgggcctcggttttttcacacgtccgtgaccggggcaganaccgcgggcggtagccaccaactataacccccntgagagaaaacctcccccctttttacccccggtttcgcgctgctcttttaccacatacggcctcccaccttttctcccctcctcccaaatattn

SEQ ID NO: 63924 - DNA, 704 bp, Zea mays
  misc_feature: Ceres CLONE 1532559
  misc_feature: Encodes the peptide sequence at SEQ ID NO. 63925
ggagctccccgcggtggcggccgctctataactagtggatcccccgggctgcaggaattcgtctcacccctagaaaaagactaattgtttgcattccacctgcattgatctttgaagggcccaagctaatgcagcatggatttagtgatgccattgcaaaagtaggtttgacaaagtttgtcagtgacctattcttggttggactgttctaccatctgtataaccagattgctacaaacaccttggagcgagtggctcctctgacacatgctgtcggcaatgtgttgaaacgtgtttttgtcatcggtttctcaatcattgtttttggcaacaaaattagcacacaaactggaattggcacgtccattgccatagctggtgttgctatgtactcttacattaaggctaccatttgaaaaaaaaaaaaaaaaaacgagacgctccaaggtaccaaattcgccctaatagtgagtcctaattaccgcccccttccctgggccctccttttttacaaacctcctgaactggggaaaaaccctgggcgttttccccaactttaatccccctttggaaaaaaatccccccttttccccagttgtgggttaaataaccaaaaaagcccccccaccaattccccctttccccaaaaatttggccccacccccttaaaggcgaaaatgggaaatatttgtaaaccctttatt

SEQ ID NO: 63925 - protein, 95 aa, Zea mays
  misc_feature: Ceres CLONE 1532559
  misc_feature (4)..(90): Pfam Name: TPT Pfam Description: Triose-phosphate Transporter family
MQHGFSDAIAKVGLTKFVSDLFLVGLFYHLYNQIATNTLERVAPLTHAVGNVLKRVFVIGFSIIVFGNKISTQTGIGTSIAIAGVAMYSYIKATI

SEQ ID NO: 63926 - DNA, 782 bp, Zea mays
  misc_feature: Ceres CLONE 1532561
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
aatgtgggggtttgttgttataaattatgatacaaatacccnnnnnncttctctccactaatcgtggtggtggccgctctatcctaaaggacccccgggctgcagaattcctctcaccctagaaaaaatggtcgccttcctcggctttgccgtgcaggccgccgccaccggcaaggggccactcaacaactgggccacccaccttagcgacccactccataccaccatctttcaacacgttccgaagatcctcttaatccccccatcgccccactccctccatcaatccaaacgagatcttgaattaactatgatctctatgaacctgtagatggatcaacccgtcaagctatcttctcactccgccaataaaacccccctatcaaacaacaattaaccacttcctccatgcttagatgcctgtcagcgtggcattaaattctccccctcccttattttgtgccccccctttaatacaaaaaaaaagccaattataataaacacgtctccaacactcgatccaaccaattaccaaatccaaaataaaaacttttgccgaccaaaccaaagtccccccacaaaaaacaagaagtaaaaaatctccctcgcacccccaattgatagttttacccatagtcagtatcctccctccctattcaaacccccccactcatgagacacaccaccttaattccaccctgcaccggaaatgaatctcccccaaaacataacaacacccccaccccaatataatataaaaaatgaccttccatacaaaccaa

SEQ ID NO: 63927 - DNA, 657 bp, Zea mays
  misc_feature: Ceres CLONE 1532565
  misc_feature: Encodes the peptide sequence at SEQ ID NO. 63928
tccccgcggtggcggccgctctagaactagtggatcccccgggctgcaggaattcgtctcacccctagaaaaaacggtttcagttcaaaaccattctccactgttcctccgctccctctgtctcgtcgtctcccatctccggctagggtttgccctttccaccgcgtccgacgcctacctcgcccgcgccactgcagggaccaaggatgtcgcaacagcaaggtgtggaggagccgccgccggcaccgctgccggcggcggaaggcgaggcacaaccggccgccgatatccccatgagcgaggccgcggcggtggaggatgaggaggaggaacccgtcgtgggggaaggggaggacggtgcagacggggccgcctacgccgtcgattccgtcaatgcttcagcgaaacccgaagcatagggcgcggaggaggggggcagccacaggaaggagcggaatggtggcccgactgcggatttggttggcgaggttgtgaagttggagaatggggacgggcctgtgacggtgggcggctcggtggactagggtctaggtggagatggcggtgacgactaaggcctggctggtcagaatcagcctgctgtgaacatcttttgctggcgccggctgaggaggatgtggcattgtccaagatctc

SEQ ID NO: 63928 - protein, 70 aa, Zea mays
  misc_feature: Ceres CLONE 1532565
MSQQQGVEEPPPAPLPAAEGEAQPAADIPMSEAAAVEDEEEEPVVGEGEDGADGAAYAVDSVNASAKPEA

SEQ ID NO: 63929 - DNA, 862 bp, Zea mays
  misc_feature: Ceres CLONE 1532566
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (26)..(26): n is a, c, t, g, unknown, or other
  misc_feature (27)..(27): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (71)..(71): n is a, c, t, g, unknown, or other
  misc_feature (86)..(86): n is a, c, t, g, unknown, or other
  misc_feature (398)..(398): n is a, c, t, g, unknown, or other
  misc_feature (399)..(399): n is a, c, t, g, unknown, or other
  misc_feature (407)..(407): n is a, c, t, g, unknown, or other
  misc_feature (409)..(409): n is a, c, t, g, unknown, or other
  misc_feature (466)..(466): n is a, c, t, g, unknown, or other
  misc_feature (862)..(862): n is a, c, t, g, unknown, or other
nnnnnnnnnaaaaaaannttntcccnnggnnnnnnnaaaactaccnnnnncaaaacccacgtctcccccgntgcccgccgctctanaactagtggatcccccgggctgcaggaattcgtctcacccctagaaaatttatgttttttgcgctatatttattacagtgactgccgataacgtagttgagcgttacaagggaaatacattctttcttcccagtatcgatggcagtcactagactccgttcttacaaaaaaaaaggcatgtcgagagatcttgtagttcatacacttgttaaaacacttttttgtacaatgtatgggaaagaagctcactttttttaaaaaaaaagaaaaggagaccgctcgaggtacccctttttttccctaaagagaganngaaataanancgggctcatttttttttccccccccccccggggggggaaagaagggggaaccctttnccttttccccccccttctctcccctctttccccccaacaaacaactattaccccaatctgggccggataggggggaaaaaagcccccctcccccaatgcgcccctttccccgccaggtgtgtagccacccccaccacactcccgacattggaattacttcacaaatactcgcccatatcttttttattaacaccaaccctcaccaagaatattttgtccagacaaaatcccgcggtcccttttttgtctcccacccccacagcggcctcttaaaacacaagacaaaaaacaatgcccgcaattactgtactaaaacaagacctacaccccgccgccacgcgcccgccgcctacatagcacctaatgcactcattcccacgcccaccccacagaacn

SEQ ID NO: 63930 - DNA, 685 bp, Zea mays
  misc_feature: Ceres CLONE 1532570
  misc_feature: Encodes the peptide sequence at SEQ ID NO. 63931
tcttaactagtggatcccccgggctgcaggaattcgtctcacccctagaaaaaacgccgatacccactgacgccaccgcccgaagcctccccgagaaacaggagccggcgcggggatgtcgtccatctcgcggaatctccggcgatccctcgccccggaccgcctgcgccgcctctcccagcacccgcgagagtatgtgacgtctgagtgccaccgccccgtcgtcctccacaagcgcggccccgacatcctccacgacccctggttcaaccggggcacggcgttctctatgaccgagagggaccgcctcggcctccgcggcctgctcccgcccaacgtcgtctcctcgcggcagcagatcgacagattcatgctcccccccaaacggctgcggagatatgcaagagatggcccgcctgatacttatcccttggctaaatggcgcatcccttaacagattgcctggcggacctggaacgatgtacttccaggcactaattggtaaacgtggaggagtatggcccttatcggttaccccccaacccttttgggcgtggttttggcgaaacctcacggggggcctggttccgccccccccttgggggaatggtacttttaggtgcccaaaaaattcgcggggagaggaataacggtccacgggggggtcacaatttgggcccagagc

SEQ ID NO: 63931 - protein, 112 aa, Zea mays
  misc_feature: Ceres CLONE 1532570
  misc_feature: SWISSPROT Homolog: EC 1.1.1.39 Malate dehydrogenase (decarboxylating)
MSSISRNLRRSLAPDRLRRLSQHPREYVTSECHRPVVLHKRGPDILHDPWFNRGTAFSMTERDRLGLRGLLPPNVVSSRQQIDRFMLPPKRLRRYARDGPPDTYPLAKWRIP

SEQ ID NO: 63932 - DNA, 697 bp, Zea mays
  misc_feature: Ceres CLONE 1532576
  misc_feature: SWISSPROT Homolog: EC 3.2.1.23 Beta-galactosidase
ggagctccccgcggtggcggccgctctataactagtggatcccccgggctgcaggaattcgtctcacccctagaaaaatagaaaaacttgatactgacaaagccctcaaggaaccgtgcttggacatctgcacaaacgcaaggcggcgtacggagctcggaagaaatagcagcccagatgagctcagttgcccccaagtttgatatgctccctgtaaaagactgcacatcatagattattgcgcgttgggcttgggcatggtgtgccttgcttgcatttgtcagtcttcgtgcaacgatgtcaagtaatttcggtaataccatttctatgttgcagaaaaaaaaaaagaaacacgagacgctcgaggtacccaattcgccctatagtgagtcgtattacgcgcgctcactggccgtcgttttacaacgtcgtgactgggaaaaccctggcgttacccaacttaatcgccttgcagcacatcccccttttcgccagctggcggaatagcgaagaggcccgcaccgatcgcccttcccaacaagtggcgcagccctgaatgccgaatggaaaatggtaagcgttaatattttcgttaaaatctcgccgttaaattttttggtaaaacccgccttcattttttttaacccaataggcgccgaaaatccggcaaaaatcccctttataaaatccaaaagaa

SEQ ID NO: 63933 - DNA, 712 bp, Zea mays
  misc_feature: Ceres CLONE 1532584
  misc_feature: Encodes the peptide sequence at SEQ ID NO. 63934
ggagctcaccgcggtggcggccgctctatactagtggatcccccgggctgcaggaattcgtctcacccctagaaaaaacccctcctgcatttcaaaataatatctccctgcgcttttcctagccctttgtcatccaaggaaacaataaacaaccggcgcttttacacccccgccaagaacaggagcaacaacaacaaggctcctcgcaacaatccattctcatccatggcgaagctcatgaacaagctggtcgattcgttcgagcacgacgagataccggacgtcggctgcgtgcgcgccgtgctggccgagctcgtcctcaccttcctcttcgtcttcaccggcgtctccgccgccatggccgccggaatcgacgggaagcccggcgacgctatgccgatgcccaccctggccgcggtggctatcgcgcacgcgctggccgctggcgtcctggtgaacgccgggttcaagtctccggcggccacctgaacccccggtgacggtggggctcatgggggcggccaaataccaaactcccggcgggggtttaaattcccccccaatttgtgggccccttcccccgccgggggtctccctccctttcctaaaggggggggtggggaccttccccttttccccgaacccgggaaatatttttggttttaggagaaacccccgttattttccccccaaaaaatctgtgccctgggaa

SEQ ID NO: 63934 - protein, 87 aa, Zea mays
  misc_feature: Ceres CLONE 1532584
MAKLMNKLVDSFEHDEIPDVGCVRAVLAELVLTFLFVFTGVSAAMAAGIDGKPGDAMPMPTLAAVAIAHALAAGVLVNAGFKSPAAT

SEQ ID NO: 63935 - DNA, 761 bp, Zea mays
  misc_feature: Ceres CLONE 1532592
  misc_feature: SWISSPROT Homolog: EC 3.2.1.23 Beta-galactosidase
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (349)..(349): n is a, c, t, g, unknown, or other
tccaccaaaacccccccctcacccatctctctaatataattttcnnnnaaataactggagctccccgcggtggcggccgctctagatctagtggatcccccgggctgcaggaattcgtctcacccctagaaaaacccctagaaaaacatcaataagcacccaggaatttgtggtagaggtacctgtaccagttcagtgtctgaaaactgcgggtaacaaacctttgtgtcccggataagtgatgtgtgtgtgtgtgtgagtgaacagtgcatctagtaggagaattgttgcgtggtttgttacttggattcttcgctctttagacaagaagtaccatggcatcccccanaaaaaaaaaaaaaaaaaaaagaaaaaaaaaaataaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcaaagaggcccgctccgatcgcccttcccaacagttgcccagcctgaatggcgaatggaaatttgtaaacgttaataattttgttaaaatttcgcgtttaaattttttggtaaaatcacccccattttttttaacccaaaaaggcccaaaaatccggcaaaattccccctttaaaaaatcaaaaaaaaaataagaacccaaaaattaggggttggaagtgg

SEQ ID NO: 63936 - DNA, 681 bp, Zea mays
  misc_feature: Ceres CLONE 1532593
  misc_feature (97)..(97): n is a, c, t, g, unknown, or other
  misc_feature (110)..(110): n is a, c, t, g, unknown, or other
ggcggtggcggccgctctattcctagtggatccccctgggctgcaggaattcgtctcacccctagaaaaaaaaaaaaaaaaaaaaaagtgattaacnggaaagcactgtnttgactagtccttgctagccctcctctctctctctctctcttacttatctactcgtttcctcttcctttccgtaaagattgcacacaaaaactattggatcttttcccctttcgatgtgctcatctcatgtgtggttctgtgactgttgagagagaggtgggcgaggcagccatacgaagttggtggtcggagccagatctgcttggatgcatagtgaaagggccggagatcggcacggcacctacctccggcggcgggcgacggctgcttcttctagatctggaaactaatgtttcttctccgatccagcagttttagcaaacaccatatatagcaatatgtggacatgctcattgtacctttccccctactaatcatgcaaaggtatcatctgaagaaagagaaagacaggttcttggaagccaaatcaagagttgatgatgcctttcgaaaaaaggaataccttgcatttagtggattcttacatgaagtttgggtttgtttcttcaatgctgggtttcgtgaagatcaacaagggcttactattaaacatgctttcgcaggggttga

SEQ ID NO: 63937 - DNA, 659 bp, Zea mays
  misc_feature: Ceres CLONE 1532596
  misc_feature: Encodes the peptide sequence at SEQ ID NO. 63938
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
ggcggccgctctagaactagtggatcccccgggctgcaggaattcgtctcacccctagaananngnnannaaaaaaaaaaaaaaaaaaaccgaccgggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaccctctcccgccgggggccggccccgccgcgctcatcggggacgtgtccgccaggctcacggggaaggacttctgcgtcaccgtggctctgggccccggaaaaacgcagaccgtgctggacaagctcaccgggtacgcggagcccgggtcgctaaccgcgccaaggggccctcggggtccgggaagtccaccctggtcgaacgccttcccgggccgccttagcggcaaagcctttcctctccgggaacgtgctccctaaacggccccagggc

SEQ ID NO: 63938 - protein, 140 aa, Zea mays
  misc_feature: Ceres CLONE 1532596
MRRVGGDLQGDGTTPRSAAAGQAMMELQANGSAAVGGAMVVGLSPLSEALWRDSNPLPPGAGPAALIGDVSARLTGKDFCVTVALGPGKTQTVLDKLTGYAEPGSLTAPRGPRGPGSPPWSNAFPGRLSGKAFPLRERAP

SEQ ID NO: 63939 - DNA, 654 bp, Zea mays
  misc_feature: Ceres CLONE 1532600
  misc_feature: Encodes the peptide sequence at SEQ ID NO. 63940
  misc_feature (593)..(593): n is a, c, t, g, unknown, or other
tccccgcggtggcggccgctcttaactagtggatcccccgggctgcaggaattcgtctcacccctagaaaaaacgcgcctttccccttttcctctcccccagatccacccgccgcgccacccctctcggctcctcccaggcggcgtcggccctttcctcgccctcctccgtttctctccggcgtatatatgggttcgaaatcggtagatgaggtgctcgatgccgccgccggagtccattgctctgctctccgtctggacggtcccaacgtccagttttccgcctcctccgaggaagaaccaacgacgtctggcctggagaatggccatcaggagccctttgttattggcgttgctgggggtgcatcgtcaggcaaaagtaccgtgtgcaagatgatcattgatcagctccgtgaccagcgcgttgtggctgttacacaggagtccttttattatggattgacggatgaagaattagtccatgttcatgattataattttgatcatccagatgcatttcatacagagctacttctctcttgtatgcaaaacttgaaacatggcaaagctgtcgacatccctaattacaacttncagacatacaagagtgtaccaaatgccaggaaggtaatatttttaagttagtgcaattctt

SEQ ID NO: 63940 - protein, 151 aa, Zea mays
  misc_feature: Ceres CLONE 1532600
  misc_feature: SWISSPROT Homolog: EC 2.7.1.48 Uridine kinase
  misc_feature (135)..(135): Xaa is any aa, unknown, or other
MGSKSVDEVLDAAAGVHCSALRLDGPNVQFSASSEEEPTTSGLENGHQEPFVIGVAGGASSGKSTVCKMIIDQLRDQRVVAVTQESFYYGLTDEELVHVHDYNFDHPDAFHTELLLSCMQNLKHGKAVDIPNYNXQTYKSVPNARKVIFLS

SEQ ID NO: 63941 - DNA, 734 bp, Zea mays
  misc_feature: Ceres CLONE 1532604
  misc_feature (33)..(33): n is a, c, t, g, unknown, or other
  misc_feature (34)..(34): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
tttttggcgcgtttgtggtctcctatacgatgnngcctcctttttnnnnnnntaaacctggtgctccccgcggtggcggccgctctatactagtggatcccccgggctgcaggaattcgtctcacccctagaaaaataaagacccagtgttggccgctctcatatgtcactaggtctgaaaggaaattggccgctaatttgcgcgaggcctgtccttcagagaggtgctttgctgcatttgtaaattatcattactgtacagggaccatactgtcttagcattctgtttttaagttgttaagattttaaatttctttgtgggtgtcttggtcttcgaagatctaggtgattggtcttccaagatctaggtgatagcttgtttgactagcactatgatcagtgttcgaaagtacagttccatgtgtcatgaagaaaaacactgcaagatttttaatacatttttgacgcaccaaaaaaaaaaaaaacgagacgctcgaggtacccaattcgccctatagtgagtcgtattacgcgcgctcactggccgtcgttttacaacgtcgtgactgggaaaaccctgagcgttacccaactttatccgcttgcaacacatccccctttccccagcttggcgtaaaagctaaaaaggcccgcaccgaatcgccccttccccaaaggttgcgccaaccttgaatggccaaatgggaaaatggtaagccgttaaaaatttttgt

SEQ ID NO: 63942 - DNA, 828 bp, Zea mays
  misc_feature: Ceres CLONE 1532612
  misc_feature: Translation starting site: 412
atactgtttttcccccggtaccgatttgaccaggcacccccgctgaattcccttactccaaaaataccaccggtggcggccgctctagactagtggatcccccgggctgcaggaattcgtctcacccctagaaaaacccctagggtttcgtcgctccgccgccgccgaaacagcacatcgttctctccatctcccccctgggggaggtggagcagccccacgaggcggtgaagctcttctaccgctggaccttcgacgatgttcaggtgaacgatatctcgttgaaccactacttggctgtcactgcggcgaagcacgcgacattcttgccgtattccgcggggcgctgctccgagaagcgggttctcaaggcgcactgcgccagcgtactagcgcctccccgacgtggtcatgatttacttgccgcaacatccgttcggaatagtccttggccgcccatttgtcccccccccccgcgcattcggtgagctgcatccacctgggtcaatggacgctaggatccccattagggcgggggtatggcacgtcgaattactaacagcttgacccccgttaccgggatgtccctcccgctatctggttttcccccgggaggcccgtgtaataagccgttgtttgctggggtttcccccttcaccttttagataggggtcgaccctcaggcctccccttcttctctcgcgaatctaccttttttgccctcatagggtagaagccgaacctcttttgatacaccatacgataaaatctccttagcgtttaaaacggcactgttcttatgctctcaccctattttatgtgttcggc

SEQ ID NO: 63943 - DNA, 620 bp, Zea mays
  misc_feature: Ceres CLONE 1532613
  misc_feature: Encodes the peptide sequence at SEQ ID NO. 63944
ggatcccccgggctgcaggtattcgtctcacccctagaaaaaaggagtcgaagtcgattgacgactcacgactggcgtatcgtaggaggcggcggttccaagcgaccatccaataatcgccaccctcacgcgagaaatccccggcaacttttggggaactacacgtgtatggagttttattagcattccaggggcgtcacaatggcatactttcctgatgaactagtagggtatatccttggctatgtaacgtcgcatcaagaccgaaacgcggtgtccttggtctgccgggcatggtacgacattgagcgtcatggacgccattcagtgcttgcaagaaactgttatgcggtgtgcccagagcgcccccacatgcggtttcccaacatgcttgcactgagcttgaagggcaaaccgcactttgctgaatttcacccttgtcccggcgggttggggtgccactgccaaatccctgggtggatgtgtgcccccgttgcatgcccaaggttttgaggaacatccggcctgaagttatggggttgggactgaataattgcctccagatgcgtttcctcgtccctataccaactttgaaattccttggccccttggattggtgg

SEQ ID NO: 63944 - protein, 103 aa, Zea mays
  misc_feature: Ceres CLONE 1532613
MAYFPDELVGYILGYVTSHQDRNAVSLVCRAWYDIERHGRHSVLARNCYAVCPERPHMRFPNMLALSLKGKPHFAEFHPCPGGLGCHCQIPGWMCAPVACPRF

SEQ ID NO: 63945 - DNA, 672 bp, Zea mays
  misc_feature: Ceres CLONE 1532614
  misc_feature: Encodes the peptide sequence at SEQ ID NO. 63946
tccccgcggtggcggccgctctagaactagtggatcccccgggctgcaggaattcgtctcacccctagaaaaaaagaaaaaaccgcaccgcaccgcatctccctcccattccactccagtccaccaccgctcccattccccagccgccgtcggcccgtcgccatggccgccgccgcccactccctcctgcacacaccggaggcccacaggaccgccacccgctcgcccttctctcctcccgcgcccactcccttcctccatctccgccctcaccgcctccccctccgcctccgctccacctccccgaccgcctccgacctcaccgccttccccccgaacccgaacgggatcttcgcgtccgaccggcccatcgacgtggacgccgccacggaggccgagctgcgggagaacgggttccggagtacgcgccgcaccaagctcgtctgcaccgtgggccccgccacctcgcgcccggaccagctcgaggcgctcgccgtcggcgggatgaacgttgcccggctcaacatgtgccacggcgacagggagtggcacagggccgcccatcgcgccgtcaggagcctcaacgaggagaagggcttcgccgtcgccgtcatgatggacaccgagggcagcgagatccacatgggggaacctcgcggcgcgtcctcggtc

SEQ ID NO: 63946 - protein, 170 aa, Zea mays
  misc_feature: Ceres CLONE 1532614
  misc_feature: SWISSPROT Homolog: EC 2.7.1.40 Pyruvate kinase
MAAAAHSLLHTPEAHRTATRSPFSPPAPTPFLHLRPHRLPLRLRSTSPTASDLTAFPPNPNGIFASDRPIDVDAATEAELRENGFRSTRRTKLVCTVGPATSRPDQLEALAVGGMNVARLNMCHGDREWHRAAHRAVRSLNEEKGFAVAVMMDTEGSEIHMGEPRGASSV

SEQ ID NO: 63947 - DNA, 671 bp, Zea mays
  misc_feature: Ceres CLONE 1532615
  misc_feature: Encodes the peptide sequence at SEQ ID NO. 63948
aagctggagctccccgcggtggcggccgctctagaactagtggatcccccgggctgcaggaattcgtctcacccctagaaaaaccgctctgctccctccgccgtgcgctcgaacgaactccacacgaaattatccgcgtaaagttggggagcagcgaacccgtagcgcgcgccccggatccctccacggggggcaatggcctcgtcggcgttcctgcccgagctgggcacgcaggtggtggtgcccgtcgcggccgtggtaggcatcgcgttcgcggtgctgcagtgggtgctggtctccaaggtgaagctctcccccgagccgcgccgcggagacggctccgccgggaagagcggcgccggcgccggcgccagcgagtacctcatcgagggaggaggagggctcaacgagcacaacgtcgtcgtcaagtgcgccgagatccagaacgccatcttcgaaagagcaacttctttcccttttcactgaataccagtatgtgggactattcatgggcaatttttgctgtccctgatcttcctccttccttggttccgtttgaaaagcttcagtaccaagaagtcagcccatgccactacagccaggggcaaaaacttgcaagccctgccctttgccaatggctaatttttcaacaacatttgccctttgtggct

SEQ ID NO: 63948 - protein, 96 aa, Zea mays
  misc_feature: Ceres CLONE 1532615
  misc_feature: SWISSPROT Homolog: EC 3.6.1.1 Inorganic diphosphatase
MASSAFLPELGTQVVVPVAAVVGIAFAVLQWVLVSKVKLSPEPRRGDGSAGKSGAGAGASEYLIEGGGGLNEHNVVVKCAEIQNAIFERATSFPFH

SEQ ID NO: 63949 - DNA, 646 bp, Zea mays
  misc_feature: Ceres CLONE 1532618
  misc_feature: Encodes the peptide sequence at SEQ ID NO. 63950
  misc_feature (574)..(574): n is a, c, t, g, unknown, or other
gcggtggcggccgctctagaactagtggatcccccgggctgcaggaattcgtctcacccctagaaaaactggactacacagcagaagcatcggcggcgagcgtatacgtatacaccaccagtacagcatccattccaactaccttccccatccctacccatcatcaccctcaccagtcaccactcgccaccctcgcccgcccccatggtctcgctcgctggctcccagatcccctcgccttcgccggggcagagcccctgcgcggccgcgcgcccgcagcgccgccagggacactccatgcgcaccatccgctccgctctgctgcagccggactcctccccggggtccccgtccccgcgcgatggcggcgccgacgcgggcgactcggacattgagaacctcaccgactccgtcatcgacttccacctccgcgagctcgccgccaccgcggggcccgcgcacgcggcggccgtcgccaagtcctcttccgccatcaacgccgcccgcacggagctgctcgacctgtcgcgggacttctccgactactccagcttcaactccgacatctccggcngagctcgagcagcttcgctgccgcgggcgggggcgggccccaaattcaaaccccccgaacccgcccccctga

SEQ ID NO: 63950 - protein, 147 aa, Zea mays
  misc_feature: Ceres CLONE 1532618
  misc_feature (124)..(124): Xaa is any aa, unknown, or other
MVSLAGSQIPSPSPGQSPCAAARPQRRQGHSMRTIRSALLQPDSSPGSPSPRDGGADAGDSDIENLTDSVIDFHLRELAATAGPAHAAAVAKSSSAINAARTELLDLSRDFSDYSSFNSDISGXARAASLPRAGAGPKFKPPEPAPL

SEQ ID NO: 63951 - DNA, 654 bp, Zea mays
  misc_feature: Ceres CLONE 1532619
tggcggccgctctagaactagtggatcccccgggctgcaggaattcgtctcacccctagaaaaaaaaccaaacccagctcaggcacaaccccaacgcaccgccgccgctcgcctggcctcacctcgccggagaagagttataagacaggagaaccccgtccccggggcgcaggcctcggcagcttccgtgaccaccgcccaatcctgccacagctgccctccctcctcccctctgggcgtggccgagttgtaggcatcacggctagcgttgcagccccccggcgcggccccgcagctgcgcaggtggagcccacgggcaccatcgcctccgctgtcgcgtccagccccgctccgcacggcggccgcggggcgctgccctcggccggaggaagcccgtccgatctcctcttcctcgccggcggcggtcgcctctgagccgttcctgtctctcaccttcttccttttctagcaattagtcccttctgctaacccccccggacccggacgagtttccaccccccagagtaactggacgacctaccgggcttggaaatgaacttaaccctccgggaggggggcccccccggtcgtctcccaaattaccccggaggaacccgcaaaaaacccccccccgggttttgggggaaaaatatg

SEQ ID NO: 63952 - DNA, 668 bp, Zea mays
  misc_feature: Ceres CLONE 1532620
  misc_feature: Encodes the peptide sequence at SEQ ID NO. 63953
  misc_feature (652)..(652): n is a, c, t, g, unknown, or other
ctccccgcggtggcggccgctctagaactagtggatcccccgggctgcaggaattcgtctcacccctagaaaaagcctcgtcccatcgttcctctctctctgccccgcctacgcctcgccccagacgcatcaaaccgctctcctctccctccctgccccctcgcaaccccgaagaagccccccacacgcaaggccgcaaacgcgccgcgcaccggaaggccccagggagcgacacgaggcggcctcattgcggcatggctgctatggccgccgctggcggcgtcgggctccatctcattggcgctgccacggccacgctcatcgcggcggtccttgttgcggccgtgctggggcgccgccgccgggcccgggcccaggcgcctccggtggaagggaaacccgcgccggaggcaggctgcgcggtcggtgacggcgcgggtcccgacggcgggacggacgtcatcatcgtcggcgccggagtggctggatctgcgctggcgtacacgctcggaaaggatggccgccgggtgcatgtcatcgagagggatctgacagaacctgacagaattgtgggcgagctgttgcaacctggaggttacttgaaattaattgagttaggcctccaagattgtgtggaagaaattgatgcccnacgggtgcttgggtac

SEQ ID NO: 63953 - protein, 138 aa, Zea mays
  misc_feature: Ceres CLONE 1532620
  misc_feature: SWISSPROT Homolog: EC 1.14.99.7 Squalene monooxygenase
  misc_feature (133)..(133): Xaa is any aa, unknown, or other
MAAMAAAGGVGLHLIGAATATLIAAVLVAAVLGRRRRARAQAPPVEGKPAPEAGCAVGDGAGPDGGTDVIIVGAGVAGSALAYTLGKDGRRVHVIERDLTEPDRIVGELLQPGGYLKLIELGLQDCVEEIDAXRVLGY

SEQ ID NO: 63954 - DNA, 652 bp, Zea mays
  misc_feature: Ceres CLONE 1532622
  misc_feature: Encodes the peptide sequence at SEQ ID NO. 63955
ggcggccgctctagaactagtggatcccccgggctgcaggaattcgtctcacccctagaaaaagtggtgcacggttctgcctttgttccgcgcccctgcgtccggaaatctcgccgcgcccctgcgtccggaaatctcgccgcgcccctacgcaatcacctcctcctctcccctcactacgccgccacctcctcctctccccctcactgcgtcgccctcctctcccactcactgcgtcgtcccctggatcctcgccccagcctctccaaccgcctccgcgctgtcccctggatctcgcgtcgcgcgtctgcagcacgcccgccacacacgccgcgattggagattggtggaaagcggtccgcggcttcaactccgacatctccggcgagctcgagcgcctcgctgcaacgacgggggcgacgctcagatccgacgtgccggacgcggccgccgtggatctgaacgacctcgagtccatggatctgtcggcggacgctgctccgctggagcacatggagccgttcgtgctggcatgcgcgcgggtgctgggcccgacgccgggccggacgcgtggcgtcgccgacggccgggtcgtcttctgggacggcaagcggtgggtcccattcgcgacggcctctccgcgctggacgcg

SEQ ID NO: 63955 - protein, 58 aa, Zea mays
  misc_feature: Ceres CLONE 1532622
MDLSADAAPLEHMEPFVLACARVLGPTPGRTRGVADGRVVFWDGKRWVPFATASPRWT

SEQ ID NO: 63956 - DNA, 965 bp, Zea mays
  misc_feature: Ceres CLONE 1532623-R
  misc_feature: Pfam Name: Methyltransf_7 Pfam Description: SAM dependent carboxyl methyltransferase
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
nggggggggnnnnnnnnnnnnnnnnnnnnnnggnnnngggnnnnnnnnnnnnnnnngagnngngnnngnnnggnnnntnnnnnnnnnnnnnnnggggggcattgagttgtatgaattccttgtaaagagtgttgcctgaaatcgccttaaaattcaggcatctaaaatataggagaagcgataaagaaaacaacaaaaacaccatgacattcaatacaccagctagtgacgcaaacatgcacattcaaaacaaacatacattaccatgtgataataatggaaagatatatagtgagaaacaagacacttcacacatgaattattgctttctcgatggataggacaagaacagcatgcttggttttctcattctcaaggtgtttggcaacacggcgagcgtactctttgaataactcgtcgagtatgcgttctccaaatttggcttgcgaacagcagcgtcataactgcgcgtaggcacttagcaacattttcaccactctcagtactggttatgcacatccaacacctttcctgaggcatcggaaagggatccccattttatcttcaaaataactttaaaaaagaaattccaggttaaaacaaaccccaaagttggctttcaaaaaatttgcccttccaaccttttccccaaacaccaaaagggggtgagaagaaaaaattccggaaaaaaaaataaaaaatgggccctccccggggtttttttttttttttttttttcccccaaaaaaaaaaccccctctaataaaaattcaggggggatattttccggggggaaagtgggcgcccccagagaaaaatcccccgagaaaaaaaaaagaggttggggaaacacccctcccccggggaaaaaaacaaacccccccgccggggggggccgtcccccctcccgccaaaaaaaaaagggtgtgtagaaaacaacgtgttggggggccacacacaaaaaa

SEQ ID NO: 63957 - DNA, 661 bp, Zea mays
  misc_feature: Ceres CLONE 1532624
  misc_feature: Encodes the peptide sequence at SEQ ID NO. 63958
ctccccgttgtggcgtgccgctctataactagtggatcccccgggctgcgagagttcgtctcacaccctagaaaaaaaccgttgcacatggtactgtaccaatctgcctccacactttgatcacacacaggaagttgagatcacaaatatgcaggctgccgctactgccttctggttctcaggcgtgctgaccccctatgtcatgcctgctgcaatgagcacggtggtggcccgtgtccccaccacatagacgagcagtccttgtagctgccgtcttcacaaccaagaccacgaatatccactactgctcatgcgtctcttatgttccctatggaggcctgctacctgcttggtggctgactcatgcaacgggcccatgttcccggaagacaatcccgcatcggcggcggcagcgagcgagctaagatgtgatcggatgtggacagggactaccatgtcctacgactagccaaagacagtattccctgccaatgcgagcgatgtaccttggcggcgatgtctgcgacgcgccttccaggactgcgtctccaagagctggctcactcctgaatacctgatcatccatttcttcctccacgcttgtaatatgtgtacacatggtttcatctcttgttatacccataagctgagaactatctag

SEQ ID NO: 63958 - protein, 52 aa, Zea mays
  misc_feature: Ceres CLONE 1532624
MRLLCSLWRPATCLVADSCNGPMFPEDNPASAAAASELRCDRMWTGTTMSYD

SEQ ID NO: 63959 - DNA, 648 bp, Zea mays
  misc_feature: Ceres CLONE 1532625
  misc_feature: Encodes the peptide sequence at SEQ ID NO. 63960
ggcggccgctctagaactagtggatcccccgggctgcaggaattcgtctcacccctagaaaaatacacttcaaaagttggggcagcgtctgcatgataaaaacattgaggggcataaacttctcaaaaaacattttgaagctagggacgcaaaagcgaaggaagaaccttctgactcatctaattctttggataagccacctgatgttccagagatgccggtgcattcataagaagataccgttgatcttaaagtgaatggaacaccaaagaaggatgcatctgtggtcaaccctgttctggaggattctgtttcaggcataccagtcactgcaaacaatgaacctgtgccttctcccaccacaacaaacatggacccagtttcaaacaaagttaatggatcaagtttgaaaatgaaagtcaccatggcatctccttgctccaaatcacatccagctgaaatgggataagatgcctctcttccttctaaaatcaccacgaaacaatagagctgccccagttcctcctaagctgccttcaactgataaagcaacgctacgttccctcaaagctaaccttcggttgataaagctaaccccagatcctccaaaatctccaaatggaaaacaaagtagctcgtgcccaatcc

SEQ ID NO: 63960 - protein, 54 aa, Zea mays
  misc_feature: Ceres CLONE 1532625
MIKTLRGINFSKNILKLGTQKRRKNLLTHLILWISHLMFQRCRCIHKKIPLILK

SEQ ID NO: 63961 - DNA, 645 bp, Zea mays
  misc_feature: Ceres CLONE 1532628
  misc_feature: Encodes the peptide sequence at SEQ ID NO. 63962
  misc_feature (489)..(489): n is a, c, t, g, unknown, or other
ggatcccccgggctgcaggaattcgtctcacccctagaaaaactcgccccagccgcttccgccctctcccttccgtttccttcccaactcccaattcccaaccctggatccaaatcccaagctatcccggaaccgatacggaggggcgcaagcaattattagctggctagcccggcctgtagctccgagatcatgaagcgcgagtaccaaaacgccggcgggagcgacggctacatgggctcctccaaggacaagtcgatggcggcagcggcggcgggggcaggggagcaggaggaggaggtggacgagctgctggcggcgctcgggtacaaggtgcgttcgtcggatatggcggacgtcgcgcagaagctagagcagctcgagatggccatggggatgggcggcgcctgccccaccgctgatgacgggttcgtctcgcacctcgccacggacaccgtgcactacaatccctccgacctgtcgtcctgngtcgagagcatgctgtccgagctcaacgcgcccccgccgccgctcccgcccgcgacgccggcaccaaggctcgcgtccacctcgtccaccgttcacaagtgggcaccgccggcggttgccggctacttcgacctcccgcccgcccgtcaaatcgtc

SEQ ID NO: 63962 - protein, 151 aa, Zea mays
  misc_feature: Ceres CLONE 1532628
  misc_feature (99)..(99): Xaa is any aa, unknown, or other
MKREYQNAGGSDGYMGSSKDKSMAAAAAGAGEQEEEVDELLAALGYKVRSSDMADVAQKLEQLEMAMGMGGACPTADDGFVSHLATDTVHYNPSDLSSXVESMLSELNAPPPPLPPATPAPRLASTSSTVHKWAPPAVAGYFDLPPARQIV

SEQ ID NO: 63963 - DNA, 662 bp, Zea mays
  misc_feature: Ceres CLONE 1532631
  misc_feature: Encodes the peptide sequence at SEQ ID NO. 63964
  misc_feature (401)..(401): n is a, c, t, g, unknown, or other
gcggtggcggccgctctagaactagtggatcccccgggctgcaggaattcgtctcacccctagaaaaaatcccccctctccacactgccaactcgctccgaagagggaggaggacgacgccggttgccactgccactgccgcgccgctcccgtctcccctccctccgcgggaactcggcgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgccttgccgcccaggcgggtggacgcggtcgcgatggtctccaacgcggagacggagacgganaaggagcaggaggaagcggcggccgccagcgaggagctgcccgtcatgccctgggccacctccgtcgcaagcggttaccccccttttgagggatccacaccacaccaggggtcttgctttccccaaagaaggaaagggatgggacactccttgcgggggaatgcttttcctccggcagttatttttctcaggaaatccaaatttaaaaaagtccttgaaaacccccttggggggggtacccaaaacccccctttcaatggg

SEQ ID NO: 63964 - protein, 159 aa, Zea mays
  misc_feature: Ceres CLONE 1532631
  misc_feature: SWISSPROT Homolog: EC 1.1.1.40 Malate dehydrogenase (oxaloacetate-decarboxylating) (NADP(+))
  misc_feature (72)..(72): Xaa is any aa, unknown, or other
MLSTRTAAVAASASPASPWKLGGRSEGGASCDGCRTYRNTLRRRAAPAKVRALPPRRVDAVAMVSNAETETXKEQEEAAAASEELPVMPWATSVASGYPPFEGSTPHQGSCFPQRRKGMGHSLRGNAFPPAVIFLRKSKFKKVLENPLGGGTQNPPFNG

SEQ ID NO: 63965 - DNA, 657 bp, Zea mays
  misc_feature: Ceres CLONE 1532634
  misc_feature: Encodes the peptide sequence at SEQ ID NO. 63966
tccccgcggtggcggccgctctagaactagtggatcccccgggctgcaggaattcgtctcacccctagaaaaaagccaactcagatgttcccgttgcacgattcgaacggcggcgaatcgcaaaaaattgggagggagaggtcgagtgcgaacgcctcctcctcgccgccaccgccaccgccgccgccaccaccacaaccggcgtctcgtcggctataaaaccctaccccttctagtcttcccgtggccaccagccgcctcgctgaaaccctaaacctctctccccgttaggtctcccccagcgccccgacgatggcggaggacgcaccgcctgcagcccctgtgatgacgccggaggaagtgcaggctgagaccgagctgcggatgcgcgacataggccagcgctttggtgctatcccagaggaccccgacgagctgctccggttactcgaagaagccgaaatctggttgtccagggtggatcaatctccgcccgagagcatgtacaatgctcttcgccccaccatggctgttttgattacaaatgagctactggagcaccctgatcccaacgtgaaggttgctctcacctcttgcttaacagaagttaccaggattactgcgccagaagccccctatgatgatgatgttatgaag

SEQ ID NO: 63966 - protein, 115 aa, Zea mays
  misc_feature: Ceres CLONE 1532634
MAEDAPPAAPVMTPEEVQAETELRMRDIGQRFGAIPEDPDELLRLLEEAEIWLSRVDQSPPESMYNALRPTMAVLITNELLEHPDPNVKVALTSCLTEVTRITAPEAPYDDDVMK

SEQ ID NO: 63967 - DNA, 656 bp, Zea mays
  misc_feature: Ceres CLONE 1532636
  misc_feature: Encodes the peptide sequence at SEQ ID NO. 63968
  misc_feature (592)..(592): n is a, c, t, g, unknown, or other
  misc_feature (633)..(633): n is a, c, t, g, unknown, or other
acccgcggtggcggccgctctataactagtggatcccccgggctgcaggaattcgtctcacccctagaaaaaagtgactgtgagcaggcgtttcttcctccactggtctcggtctttgccgcaaatatccgctcgccccccttctcggcctcgggctctcactcaccctcgaccctcctcgcgcagcgcagccgcacgcgcgccatggcggcgctctgctccgcctccccggccatctccgcggcggcgtccctcgggtcgcccgcgcgcgtggtcgcgtccttcctccgcctgcgcctgcgcctgcgcgccgccaagcgctcctgctcccacgcgccggcgccgtcgtggcgggcgcgacggcgcttcgcggcggccgcggcggaggcggaggagtgctcgggtgtggagacgctgatcccgcccgacaatcgcatccccgccaccatcatcaccggcttcctcggctctggcaagacaactttactgaatcacatcttgactgcccaccatggaaagcgaattgctgttattgaaaatgagtttggagaagtagacattgatggctcactagtccgctgcacaaaccgcntggagctgaggacataatgatgctaaataacggctgccttngttgcactgggcgggggattaac

SEQ ID NO: 63968 - protein, 134 aa, Zea mays
  misc_feature: Ceres CLONE 1532636
  misc_feature (130)..(130): Xaa is any aa, unknown, or other
MAALCSASPAISAAASLGSPARVVASFLRLRLRLRAAKRSCSHAPAPSWRARRRFAAAAAEAEECSGVETLIPPDNRIPATIITGFLGSGKTTLLNHILTAHHGKRIAVIENEFGEVDIDGSLVRCTNRXELRT

SEQ ID NO: 63969 - DNA, 731 bp, Zea mays
  misc_feature: Ceres CLONE 1532639
  misc_feature: Encodes the peptide sequence at SEQ ID NO. 63970
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (25)..(25): n is a, c, t, g, unknown, or other
  misc_feature (27)..(27): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (475)..(475): n is a, c, t, g, unknown, or other
tgtggtttaannnnnnnnnnnnaantncaaccaagccnnnnnnnnnnnnnnnnaaaaactggagctcaccgcggtggcggccgctctagaactagtggatcccccgggctgcaggaattcgtctcacccctagaaaaatcgccaccagtggccgcgtcctcttcatttccgccatccgtatcgtctccctagggtttggcactttggccgccgccatggcgtcggcgtcgcgtgcgctcctcctctcccgtgcgctccaggccggcgcgtctcgccgcgtccccgccctcctgcgcccggtcgctgcggccgcgagcctcctcccagcggtggcggggccggcaggggccgccctcggcgctagggtgcggtgcttcgcgacccagccggcgacgtcctcgctgcgggactcgtccccaaactggagcaatcgcccgcccaaggagacgatcctcctcgatggccaccattccancactggctcgtcatcatggagccgccgcctggtgacgcctccaaccccgacatcacacgcgacgagatcatcgatagctatatcaagactctcgcccaagtcgtcgggagtgaggaagaagctaggcaaaaatatactctgtatcgactcgtcattactttggctttggtgctcttgtatctgaggaaactttccttacaacttgaaaaaaatcccaagggccccgggggcctccgcgattccacgtggagggaaa

SEQ ID NO: 63970 - protein, 80 aa, Zea mays
  misc_feature: Ceres CLONE 1532639
MEPPPGDASNPDITRDEIIDSYIKTLAQVVGSEEEARQKYTLYRLVITLALVLLYLRKLSLQLEKNPKGPGGLRDSTWRE

SEQ ID NO: 63971 - DNA, 652 bp, Zea mays
  misc_feature: Ceres CLONE 1532642
  misc_feature: Encodes the peptide sequence at SEQ ID NO. 63972
ggcggccgctctagaactagtggatcccccgggctgcaggaattcgtctcacccctagaaaaaagcaggagaagagagacgacacagcagcttttttggtttccccttccctttccccgcgcggtgatcgctgggttctccgcgagcgaggcagggcactgcgcgtcctccgcgaccgcctggtgatcgctgggggttctggacgttggcgtttcatttggttggttggtgggtggcagcagccgtggcgagatggagctgatgctgccggtgacggtgaaggaggaggacgtggacgcggacgcggacgcggacgcggacgctccgcggccgatggaggggctgcacgaggtcgggccaccgccgttcctgaccaagacgttcgacctggtggccgacccggccaccgacgaggtcatctcctggggccgcgccggcaacagcttcgtggtctgggatccccacgtgttcgccgccgtgctgctccccaggttctttaagcacaacaacttctccagctttgtccgccagctgaacacctatgtgagtgccccaagtactctgcttgctcagttgctgtcgtgtgaatttttgtttctggttggctttgtgctcgcgcgctgctctggttctgcagttcatctcgcctctt

SEQ ID NO: 63972 - protein, 133 aa, Zea mays
  misc_feature: Ceres CLONE 1532642
  misc_feature (37)..(133): Pfam Name: HSF_DNA-bind Pfam Description: HSF-type DNA-binding
MELMLPVTVKEEDVDADADADADAPRPMEGLHEVGPPPFLTKTFDLVADPATDEVISWGRAGNSFVVWDPHVFAAVLLPRFFKHNNFSSFVRQLNTYVSAPSTLLAQLLSCEFLFLVGFVLARCSGSAVHLAS

SEQ ID NO: 63973 - DNA, 826 bp, Zea mays
  misc_feature: Ceres CLONE 1532642-R
ccgattgggtacctcgagcgtctcgtttttttttttttttttaaggagaaaaaacgtcaattatgacacggcccggcaactgtggaatatacttgcgctgggtacaacacaggggaggtaccaagaatactttacactacacgtctgcactctgcacaaaatgacacagtgtaaccttcacgatccccctcctatatactacaatctacaacaatggagctttcgctaaaaaaattcactgacccctgtcggagggacaattaacctactgttactagtcgtataggattaattaacgagatcatctctacttccccggggggttattgctcatggagctcaacttctgcgccagcgcgtcaacttaccaagccggtcgtctcctctccgggggcagcgtctcagcctcggaaccgcccttcatcccttcgttaagaagctcctcccaaaagtcgtcggtaagctcccccgtctcaaacccgccctgctgttggctccgcgcggggccaccctgcttctcgctcccgtcctgcctgcgcttgccaagcccctggatgttgagcgccaggttctccagctccaacgtggtccctcgctcgtccagctccccaaacaacccccgcgtggcggtggggtcgtcttcttccccctgctgctgctcctcctcctgctgctgaaagcgcccttttggccgggggcggccccaatgggccgccctccccttccggggagggcggcggaaaaacaaaggccccggcccttcaagtttcccctcccgcctgggccttgtttgtttggggcccaaacaacttgggaaacaaaattc

SEQ ID NO: 63974 - DNA, 621 bp, Zea mays
  misc_feature: Ceres CLONE 1532650
  misc_feature: SWISSPROT Homolog: EC 1.13.11.12 Lipoxygenase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (79)..(79): n is a, c, t, g, unknown, or other
  misc_feature (81)..(81): n is a, c, t, g, unknown, or other
  misc_feature (82)..(82): n is a, c, t, g, unknown, or other
  misc_feature (84)..(84): n is a, c, t, g, unknown, or other
  misc_feature (111)..(111): n is a, c, t, g, unknown, or other
  misc_feature (112)..(112): n is a, c, t, g, unknown, or other
  misc_feature (115)..(115): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (193)..(193): n is a, c, t, g, unknown, or other
  misc_feature (198)..(198): n is a, c, t, g, unknown, or other
  misc_feature (211)..(211): n is a, c, t, g, unknown, or other
  misc_feature (219)..(219): n is a, c, t, g, unknown, or other
  misc_feature (233)..(233): n is a, c, t, g, unknown, or other
  misc_feature (240)..(240): n is a, c, t, g, unknown, or other
  misc_feature (266)..(266): n is a, c, t, g, unknown, or other
  misc_feature (271)..(271): n is a, c, t, g, unknown, or other
  misc_feature (276)..(276): n is a, c, t, g, unknown, or other
nnnnnnnnnnnnnnnnnntttttttnnnnnnnnnnnnnnnnnnnnnnnnnnnnnnnnnnnnnnnnnggggggnnnnncntnncnggggggcccccgggggcgggagtcccnnccncnnnnncccgctccnnnnnnnnnaaaaacctggggaacctccaccgtcgtgtggggcgggccggctctagtaactagntgggnaaatcccccgggnctgcaggnaaattcgtctcacnccctagnaaaaactgggagggtggagaagcacnggcgntcccngggcgccatcatcgtgaagaacaaccacgcctccgagttcttcctcaagaccatcaccatcgacgacgtccccggccacggccccatcgtcttcgtcgccaactcatgggtgtacccgcagtacaaagtaccgcttaaaaccgcggtcttctttctcccaacgacaccttaccttcccccaaccaaaatgcccgggcgggccctttaaaccccttaaccccccaaaaaaaaaaaaattttcccccaaaacccttaaggggggggaaacaaaccccccccggggggcccccccttaacccccgggggaaaccccccgaaacacccgggggttttttatacaccccc

SEQ ID NO: 63975 - DNA, 679 bp, Zea mays
  misc_feature: Ceres CLONE 1532651
  misc_feature: Encodes the peptide sequence at SEQ ID NO. 63976
  misc_feature (377)..(377): n is a, c, t, g, unknown, or other
  misc_feature (414)..(414): n is a, c, t, g, unknown, or other
  misc_feature (427)..(427): n is a, c, t, g, unknown, or other
acccgcggtggcggccgctctagaactagtggatcccccgggctgcaggaattcgtctcacccctagaaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcangggaggcatgcagatcttcgtcaagaccctcactggnaagactatcaccntcgaggtggagtcttctgacccatcgaacacggtcagggcaagatccaagaccaggagggatccctccgggaccagaagggcctcatttttgctggaaagcacttcgaggacgggcccaccctggccgattccaaatttgagaagggaaacccccccccctttggggtttggctcccgggggggggttgcaaattttcgggaaaaccttgggggggaaaaattaccccccttgggggggaagtttctgaaac

SEQ ID NO: 63976 - protein, 174 aa, Zea mays
  misc_feature: Ceres CLONE 1532651
  misc_feature (6)..(74): Pfam Name: ubiquitin Pfam Description: Ubiquitin family
  misc_feature (74)..(74): Xaa is any aa, unknown, or other
  misc_feature (91)..(91): Xaa is any aa, unknown, or other
MQIFVKTLTGKTITLEVESSDTIDNVKAKIQDKEGIPPDQQRLIFAGKQLEDGRTLADYNIQKESTLHLVLRLXGGMQIFVKTLTGKTITXEVESSDPSNTVRARSKTRRDPSGTRRASFLLESTSRTGPPWPIPNLRRETPPPLGFGSRGGVANFRENLGGEKLPPLGGKFLK

SEQ ID NO: 63977 - DNA, 602 bp, Zea mays
  misc_feature: Ceres CLONE 1532652
gcggtggcggccgctctttactagtggatcccccgggctgcaggtttcgtctccccctagaaaaaatcccagatcaggattagccgaccacccgccgaaggccagagagaaatatctcatcttctctccaccggatcggttcaatcggagagcgaggagagaaagggagggtggtgcgtcgaggggggccgagattttgcggttggagccaaatagggtatgagctgcttcgcgcaccgccgccgctccgacgtcgcccgccggcaggacggcctcctcgtcttcgtctgcttcctctcgattcccatacgtacccagtagtgtttattttaattagtagtaagtggtagtagccatctctttggaaactgcgctccgcctttgcgggttccgggggcccttttgcggttttcccggcccctccttttccccccaaaactccccccctttatttttttcccccttcccccggcaaaaacccggggcgctggggtttggatcccccaaggggcccccaaaaattggggaggcccttttcgcccccccaccctttggagagaggggggggggaagttgccccccccatggggtcgtttggcccc

SEQ ID NO: 63978 - DNA, 680 bp, Zea mays
  misc_feature: Ceres CLONE 1532653
  misc_feature: Encodes the peptide sequence at SEQ ID NO. 63979
  misc_feature (400)..(400): n is a, c, t, g, unknown, or other
aagctggagctccccgcggtggcggccgctctagaactagtggatcccccgggctgcaggaattcgtctcacccctagaaaaatatgaatgacacctggagcaccggcggtgtggcctacccgcagccggtgcgcctgtgggatcaccgcaccggcaggagagcgagcttcaccaccaacttctcgttcgccatcagcggcgagcgtacctacaaccgtgcggatggcatggccttcttcatcgggtccttccgctcagccgtgccgctagactcaggcggtggttttctcgggctcatcagcaacatcactccaccgccgctgtcgactgtcggcgtagagttcgacacaaacaggaactcatgggatccccaggacgccggggaggattttggcatcnacgtcaacaacatcacctccatcgtcgtttacaagtcgctgggacaagatttcccaaacccgctctctggtaccatgtcggcaggcgtcaactaccatgggagctcccaggttttatcccgttagcctccgggtgggccaacggaaatgttcatgaccctccaaacgtcggtcgaccttaaaggcgcctggaatgccacagtaatgcaccctccgggttttcggggggcaccgggaatacactttaaagcccaccccctcttgtcttgggccttccaacg

SEQ ID NO: 63979 - protein, 146 aa, Zea mays
  misc_feature: Ceres CLONE 1532653
  misc_feature (1)..(146): Pfam Name: Lectin_legB Pfam Description: Legume lectin domain
  misc_feature (106)..(106): Xaa is any aa, unknown, or other
MNDTWSTGGVAYPQPVRLWDHRTGRRASFTTNFSFAISGERTYNRADGMAFFIGSFRSAVPLDSGGGFLGLISNITPPPLSTVGVEFDTNRNSWDPQDAGEDFGIXVNNITSIVVYKSLGQDFPNPLSGTMSAGVNYHGSSQVLSR

SEQ ID NO: 63980 - DNA, 423 bp, Zea mays
  misc_feature: Ceres CLONE 1532657
acccgcggtggcggccgctctagaatagtggatcccccgggctgcaggaattcgtctcacccctagaaaaaaccggagacgtagcggaccagcagccggacggccgtataaaacataccaaggccgcctcgctcgctcagcatacggaggcagccgccggtaagccgcgcgcgcgtgcagtcacccatccgtccgtccgtccgtccgtcgtccgccgtccaccgccagcgcgcgctcgccaccgcacccagctagcagcacaagaaaagtctggtgggcgtcggcggcgggcggcggcggcccgggcttgccacaagtccaaatcccttgggacgggcccaaaaaagcagtttgaaaggcgcgaagcgaagcaaagcttaggcgccgcccccttccgttcgcccttaccgagcccttaccgac

SEQ ID NO: 63981 - DNA, 641 bp, Zea mays
  misc_feature: Ceres CLONE 1532662
  misc_feature: Encodes the peptide sequence at SEQ ID NO. 63982
  misc_feature (508)..(508): n is a, c, t, g, unknown, or other
gcggtggcggccgctctataactagtggatcccccgggctgcaggaattcgtctcacccctagaaaaaccggcgcccgcaatcgcccattccattccactttccaccatggattccctctgcgtccaccatacctcgctaccactctccccgccccaccaggtcaccgtccccgaaccctctcgcgcgctgcccccatcctcgagcctccccgccctgccgtcctcctccaaccatgtcagcgcgctccctcgacccgcggcggcttccttcgccttcgcgtgccactgcaaagcaccggtgcgggaccacgacgctgagctcctccgcgctctacggtccaacggcaacggcaccctccacggggacacagcactgccgcaagtgctcgactcgcgctccgacaggtacgggcggcgacggcagcagcaagaagtcgcgtttctgcgcccgggattgcgcgaagcggatcatggagctgcccgtggaagagcgggtgaaggtgctcnaactcttgcagcgcgacgacccggcgctcaccgtatccgattacaaagacatcctttcggggctggttccgggcgggaaaccacgcaaaggccgtcccttctttccgggccatggctgtccgccccaaaccca

SEQ ID NO: 63982 - protein, 135 aa, Zea mays
  misc_feature: Ceres CLONE 1532662
  misc_feature (92)..(92): Xaa is any aa, unknown, or other
MSARSLDPRRLPSPSRATAKHRCGTTTLSSSALYGPTATAPSTGTQHCRKCSTRAPTGTGGDGSSKKSRFCARDCAKRIMELPVEERVKVLXLLQRDDPALTVSDYKDILSGLVPGGKPRKGRPFFPGHGCPPQT

SEQ ID NO: 63983 - DNA, 663 bp, Zea mays
  misc_feature: Ceres CLONE 1532663
  misc_feature: Encodes the peptide sequence at SEQ ID NO. 63984
aagctggagctccccgcggtggcggccgctctagaactagtggatcccccgggctgcaggaattcgtctcacccctagaaaaaacctcacctccatctcctgctccatccgcacctacatctccaccaaccgacacggcgaggagatgaacgcgtcgcagttcatggagaagctgattctcggtctcgccgcctccgcctccccgtccggcggcggctcctggggcggtgggggtgtggatctcagcgatctgatgatcccgatcccccaggaggacagctaggaccatctccgtccccggggtagcactagcatcgtctacggcacatcaaacgacatgctaccctcctacgatttccagccgatccggaccggcggcgccaccgccgccgcccccgtgtctcacgcctcggggggatcgctcggctccaaggcaccctccgcctctgcctctggctgcgccgcctgctcatacaacctcaagagtgctggtatattggagccacatgtgctgaagacagttagtcctgaggaagactggagtaacttccctgcatgttactattgctgatgttgatcgatccctgaagaagtactctgataaccttttgcatgcactgtaaggtgtaagttcaaggctttcacgtatggacggcagatctc

SEQ ID NO: 63984 - protein, 45 aa, Zea mays
  misc_feature: Ceres CLONE 1532663
MNASQFMEKLILGLAASASPSGGGSWGGGGVDLSDLMIPIPQEDS

SEQ ID NO: 63985 - DNA, 596 bp, Zea mays
  misc_feature: Ceres CLONE 1532668
  misc_feature (248)..(248): n is a, c, t, g, unknown, or other
gcggtggcggccgctctagaactagtggatcccccgggctgcaggaattcgtctcacccctagaaaatttatcaccctgccccagtggcgccgctgaactcatcacccgaccacaaccacaggagtaaccatagcacagattgccaactcctttatgcacttaataatggatttttgtttttgcttctgaggtttatgaataaggtggtaagaaaaatggagcaattaagtaaaggtgcccccttttnacaaaagtggctttttcccccccccccagaaccggatcggccaataaaaccaggtgctttccaccccggaccaaaatggcgaaaatagggatccctccccccaaaaaaaaaaaaaaaaaaccggaaaccccccccggggggggacccccccaaattcccccccataagggagccgtttttccccccccccccctggggggccgttttttttaaaaacccggggggtgggggaaaaaccacccggggttctccccccaaatttaattccttgtgtaaaaaaaaacccccctttttttcacggggggggaaaaaaaaaaaaaaaaagccccccccccccccccccccccc

SEQ ID NO: 63986 - DNA, 620 bp, Zea mays
  misc_feature: Ceres CLONE 1532675
ccgctcttaactagtggatcccccgggctgcaggaattcgtctcacccctagaaaaacattatcatatacgcagtcgcgtagcaggtttccttatggttatcgcttgagctgagggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaagagcatacttaaagacggatcctgatttgcgttgattttggttgcttgagtaccgagtttgactgttcgagttgcgttcaccaagttcgctgagatgctttttttttgatactatggttttagaataccaatgtgaaaactctggtgctccaaaaaaaagtgcagttttggctaaactgaggtatttaaagagtgttgtaaaagttcaacaaaaaagtgcagttttggccaaactgaggtctgaaaaaaaaaaaaaaaaacgagacgctcgaggtacccaattcgccctatagtgagtcgtattacgcgcgctcactggccgtcgttttacaa

SEQ ID NO: 63987 - DNA, 873 bp, Zea mays
  misc_feature: Ceres CLONE 1532677
  misc_feature (1)..(1): n is a, c, t, g, unknown, or other
  misc_feature (20)..(20): n is a, c, t, g, unknown, or other
  misc_feature (34)..(34): n is a, c, t, g, unknown, or other
  misc_feature (36)..(36): n is a, c, t, g, unknown, or other
nttcgcccccgtttaatccncgcgggaaaatatnanaacacacccacccaaaaagggactccacgcggtggcggccgctctatactagtggatcccccgggctgcaagaattcgtctcacccctagaaaaagacttgttagaactgagcaaaccatcgttaagaatgactgcctggtgtgtcattccttaaaaaaattgccttgcactttgtgattactgtctcgttgctgtgtgtcattctatgacaaatcgtttgtcgcttgattgtgctttgtttgtaaacttgcttgtcgtgactagcacttgttatcccattttttgattggttctgtaaaaacaacctaggtttccttagaatgtataagattagtatatacaacaataataaccgcctacataacaacagagtggttgttggtctcggggtaaaaagaaagaaaaaaaaccccgccggccgtcggggagggcacccccatttttccccccttatagaagagagggggggaattttgcccccccccccccttaatatagggggcctgtgtgtttttttatcaacacaatcctcgtgctccctccggggaagaaaaaaaacacccgtgtgggggttttccccccacaaactttatatttctcgccctctttgtgggaagaaataaatccccctctctttttttctcccaccactcgtggggggttaattatttcccaaaatagaagctgcctcccccgacaacaatcgacgcccctctctaccacaataaaattttttctccccccccctcatatatgtgggggcaaatagaaaaaaaatttcatccaccctcataacatatttgtcttttgaaaaataaccaaccgcctctcaattt

SEQ ID NO: 63988 - DNA, 585 bp, Zea mays
  misc_feature: Ceres CLONE 1532679
  misc_feature: Encodes the peptide sequence at SEQ ID NO. 63989
  misc_feature (366)..(366): n is a, c, t, g, unknown, or other
  misc_feature (376)..(376): n is a, c, t, g, unknown, or other
  misc_feature (377)..(377): n is a, c, t, g, unknown, or other
  misc_feature (381)..(381): n is a, c, t, g, unknown, or other
ctctgaactagtggatcccccgggctgcaggaattcgtctcacccctagaaaaacggccaccgctgacgacgaggacgccaccgcggcggcgaccacggtgaggctcatgaaggagtggaccacgtggacgatgaagaaggcgaaggtggtggcgcactacggcttcatccccctcgtcatcgtcatcggcatgaactccgagcccaagccctccgtcttccagctcctctcccccgtctgatcggatcatgacagggcccggatgaggtcggtccgtagtagtttgtagctggtacttcatttgcttacatatgtccgagatcgagttgaagaaagtggatcatgctttctgggcgaatttgaanggattggttnnatanttttgtagtggcggatgtcttctatacatcggaatcaaaatgtcttggctaaaaaaaaaaaaaaaaacgagacgctcgaggtaccccaattcgccctatagtgagtcgtattacccgcgctcactggccgtcgttttacaacgtccggactgggaaaacccggcgtttacccaactaaattggcctgggagacaatcccctttt

SEQ ID NO: 63989 - protein, 44 aa, Zea mays
  misc_feature: Ceres CLONE 1532679
  misc_feature (2)..(41): Pfam Name: Tom7 Pfam Description: TOM7 family
MKEWTTWTMKKAKVVAHYGFIPLVIVIGMNSEPKPSVFQLLSPV

SEQ ID NO: 63990 - DNA, 619 bp, Zea mays
  misc_feature: Ceres CLONE 1532680
  misc_feature: Encodes the peptide sequence at SEQ ID NO. 63991
  misc_feature (526)..(526): n is a, c, t, g, unknown, or other
  misc_feature (619)..(619): n is a, c, t, g, unknown, or other
ggcggccgctctagaactagtggatcccccgggctgcaggaattcgtctcacccctagaaaaaaccgaaatcttccgtctccaaatcctcctagcgaattcaccacagcttctcaccaccgctaccttcgatggcacccaaggcggacaagaagccggcggcgaagaagcctgcagaggagcccgcgacagagaaggcggagaaggctccggcggggaagaagcccaaggccgagaagcgcctcccggcgggcaagtccgccggtaaggagggcggcgagggcaagaaggggaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattngtagcgttaatattttgttaaaattcgcgttaaatttttgttaaatcagctcatttttttaaccaataggccgaaatcggcaaaatcccttan

SEQ ID NO: 63991 - protein, 138 aa, Zea mays
  misc_feature: Ceres CLONE 1532680
  misc_feature: SWISSPROT Homolog: EC 3.2.1.23 Beta-galactosidase
  misc_feature (132)..(132): Xaa is any aa, unknown, or other
MAPKADKKPAAKKPAEEPATEKAEKAPAGKKPKAEKRLPAGKSAGKEGGEGKKGKKKKKNETLEVPNSPYSESYYARSLAVVLQRRDWENPGVTQLNRLAAHPPFASWRNSEEARTDRPSQQLRSLNGEWKXVALIFC

SEQ ID NO: 63992 - DNA, 652 bp, Zea mays
  misc_feature: Ceres CLONE 1532688
  misc_feature: SWISSPROT Homolog: EC 3.2.1.23 Beta-galactosidase
  misc_feature (279)..(279): n is a, c, t, g, unknown, or other
gcggtggcggccgctctataactagtggatcccccgggctgcaggaattcgtctcacccctagaaaaatagatgctgttttaccttcaacttatgctgttgtaccttcatatttggacttcttaagccttgtgtcggacgcctttggcattgtgatatgaaacatgagagattttgaagactatctctgaagttatgtggttctatatctagatgttgtttctgcttgttacttgcgttaaggaatttatgatatgtttgtcataaatttatgataaanaaaaaaaaaaaaaaaaaaaaaaaaaaaaaaaaaaaaaaaggaaaaaaaaaaaaaaaaccgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaacaataggccgaaatcggcaaaatcccttataaatca

SEQ ID NO: 63993 - DNA, 612 bp, Zea mays
  misc_feature: Ceres CLONE 1532697
  misc_feature: Encodes the peptide sequence at SEQ ID NO. 63994
  misc_feature (458)..(458): n is a, c, t, g, unknown, or other
  misc_feature (472)..(472): n is a, c, t, g, unknown, or other
ccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggcctgatcgccccaagtatcttggcccgttctccgagcagacgccgtcgtacctgaccggcgagttccccggcgactacgggtgggacaccgcgggcctctcggccgacccggagacattcgcgcgcaaccgggagctgggagtgatccactcccggtgggcgatgctgggncgcgctgggctgcntgttcccggaaatcctgggcaagaaacggcgtcaagttcgggcgaggcggtgtgggttccaaggcccgcgccgcaaatctttctcggaagggcgggctgggacttacttgggggaacccccaacccgggggccccccccc

SEQ ID NO: 63994 - protein, 111 aa, Zea mays
  misc_feature: Ceres CLONE 1532697
  misc_feature (16)..(106): Pfam Name: Chloroa_b-bind Pfam Description: Chlorophyll A-B binding protein
  misc_feature (65)..(65): Xaa is any aa, unknown, or other
MVRPDRPKYLGPFSEQTPSYLTGEFPGDYGWDTAGLSADPETFARNRELGVIHSRWAMLGRAGLXVPGNPGQETASSSGEAVWVPRPAPQIFLGRAGWDLLGGTPNPGAPP

SEQ ID NO: 63995 - DNA, 681 bp, Zea mays
  misc_feature: Ceres CLONE 1532700
  misc_feature: Encodes the peptide sequence at SEQ ID NO. 63996
gtcatacctagtggatctcccgggctgcaggatttcgtctcacccctagaaaaaaatcctaatccgcttgctctgccagcaagtcatttagaggcagcagcgccggcccctggccggcctcggctcagctggcgaaggccgtgaccgtgagaagccatgagcagggaacagcagatgccacggcggaggttcatcgccatccccttctcctccggctgccgctcccactccagcgtcgacgtcgtcgacaccgggcgcctcgccggcgacggcaagaagccccacccgcaaggggctgaagcaggggcggcggcggcggcggcgatgggttatggggagtctctggtggcgcggctcctgcggggggtcaagaacctgtcgcagatcttcgcggtgtaccaccaggaggaggaggaggacccggagaatggtaatcggcctcccttcgggccgtgaagaaggggggtcaaattcggctgggaacggggccccggagacccagaggcaaccccctgtttcttgggaatgagtccggtgccggccttcaaccggggccgctcgttttcttcctgggccccgggcggagatcctcgcagaggaagatggacccggtgggtcccttggcgggcgttttgttcttttcgcggatacttctagagttcttcccatgggggtcccccg

SEQ ID NO: 63996 - protein, 99 aa, Zea mays
  misc_feature: Ceres CLONE 1532700
MSREQQMPRRRFIAIPFSSGCRSHSSVDVVDTGRLAGDGKKPHPQGAEAGAAAAAAMGYGESLVARLLRGVKNLSQIFAVYHQEEEEDPENGNRPPFGP

SEQ ID NO: 63997 - DNA, 663 bp, Zea mays
  misc_feature: Ceres CLONE 1532707
  misc_feature: Translation starting site: 169
  misc_feature: SWISSPROT Homolog: EC 5.2.1.8 Peptidylprolyl isomerase
ccgcggtggcggccgctctattctagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatccccgatcgggagacgcagaggtcccgcggcttcggcttcgtcaccttctccacggaggaggcgatgcggaacgccatcgagggcatgaacggcaaggagctggacggccgcaacatcaccgtccacgccgacgggtaagtgccccgtgaacacgctcaagctgctcgcgtgcgtggacgcgctcaacggcctcgtgcacgccgtcatcgggaccaaggccagcgacacctgctgcccgctgctctccggcgtggccgacctcgacgccgcgctctgcctctgcaccacatcaaggccaaggcgctcagcgtcagcctcgtgctccccgtcgccatctcggtgctcgttaacgagtgcggcaagcatgtgccctcc

SEQ ID NO: 63998 - DNA, 715 bp, Zea mays
  misc_feature: Ceres CLONE 1532715
  misc_feature: Encodes the peptide sequence at SEQ ID NO. 63999
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
tgtggatcccccgggctgcaggaattcgtctcacccctagaaaancnncccctgcctgtaactaccaaaaaaaaaaaaaaaaacaatcagcttttatactcattccttcaccctctcccatctctcgcctcgcctccccacgcgagcgagcccaacacgcaaacggaacgcttccgcgcccctccgccttatccgatggcgtccctcaccaccacaacctcctcaccggccgccctcccggcggccaccaccgcccccgcggcttcgtccatatctccccacgccggatcgaagcggcggctcctcgcggggaacgacgcgccctggggggccaccgcggccacctccggggggcagggggattcgaccccccccccccattcaaccacgccctccgttcctccgggtttcccatgcaggaagaaacccgtccgcctacgcccccccgcaattattgaaaccattctggcaccccaatttggggaagggggttggcgtcatggggaggcgtttcaccgaaggcccaccccaggtccggaaaatgcacccctgctcccggaaacaaaaagggcgccctctaggagggctatgggggcccacaaggggtcgggcccccttttgatttttcaaaattaaatgtttcccatgaagaccttttgtgaccggggacatataccttcttgtttggcaaaaaatttcattggagccagatccg

SEQ ID NO: 63999 - protein, 146 aa, Zea mays
  misc_feature: Ceres CLONE 1532715
MASLTTTTSSPAALPAATTAPAASSISPHAGSKRRLLAGNDAPWGATAATSGGQGDSTPPPHSTTPSVPPGFPCRKKPVRLRPPAIIETILAPQFGEGGWRHGEAFHRRPTPGPENAPLLPETKRAPSRRAMGAHKGSGPLLIFQN

SEQ ID NO: 64000 - DNA, 727 bp, Zea mays
  misc_feature: Ceres CLONE 1532717
  misc_feature: Encodes the peptide sequence at SEQ ID NO. 64001
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (36)..(36): n is a, c, t, g, unknown, or other
  misc_feature (198)..(198): n is a, c, t, g, unknown, or other
  misc_feature (200)..(200): n is a, c, t, g, unknown, or other
  misc_feature (332)..(332): n is a, c, t, g, unknown, or other
  misc_feature (334)..(334): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (424)..(424): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (450)..(450): n is a, c, t, g, unknown, or other
  misc_feature (451)..(451): n is a, c, t, g, unknown, or other
  misc_feature (474)..(474): n is a, c, t, g, unknown, or other
  misc_feature (727)..(727): n is a, c, t, g, unknown, or other
nnnttaattnnnttgatatatcttgtttaagaccgnggcggccgctctattctagtggatcccccgggctgcaggaattcgtctcacccctagaaaaaatctccgcatttccatcttcccgtgggatcccagccgccgccgcaagaagaagagctcggggacttccaggtgtctctagaagatgccgaagcggatccncnagatcaaggatttccttctcaccgcgaggaggaaggatgcccgatcagtgaagatcaagaggagcaaggatgttgtcaagttcaaggtccgctgttcccagtacttgcacaccctagggggataccaccctnanaatgtttttctttttgaaccaatctcccccccccgggcttgaatttctttttcccccccaaaggggggaaagaaaaggggnnnnnnnnancctttnnnnnnttcctttcccctttnnccaaaataaaaaaaatttattcnacttcttgaacctctaacctattaaaaccttttcccttcttttatcttctcaatcctcaaattttccccaaacatccccccaatttccccacccctcacaaccctcccctcctctataaaaaaaaacacaccaatttcacctatccttttcttccccttcctcatttccccatacacctcccccctttttcccctctaccccccctcttcttactttctctctcctttcttatcattccactccccttcacan

SEQ ID NO: 64001 - protein, 64 aa, Zea mays
  misc_feature: Ceres CLONE 1532717
  misc_feature (2)..(53): Pfam Name: Ribosomal_L38e Pfam Description: Ribosomal L38e protein family
  misc_feature (6)..(6): Xaa is any aa, unknown, or other
  misc_feature (7)..(7): Xaa is any aa, unknown, or other
  misc_feature (51)..(51): Xaa is any aa, unknown, or other
MPKRIXXIKDFLLTARRKDARSVKIKRSKDVVKFKVRCSQYLHTLGGYHPXNVFLFEPISPPRA

SEQ ID NO: 64002 - DNA, 671 bp, Zea mays
  misc_feature: Ceres CLONE 1532718
  misc_feature: Encodes the peptide sequence at SEQ ID NO. 64003
tcacccgcggtggcggccgctctataactagtggatcccccgggctgcaggaattcgtctcacccctagaaaaaaattcattcatcatccatggaggccatgcccaggccaagtgtagctccctcgttgcagttgcagctccgcccgtgcccgaggaggccgctccggaagcactgcccaccgtcctccgtgccaagccggagggttgcttgctcggcctcggcggccgacgccgacgtggtcgacctcttcgacgccgctaagctcactgtggacaagttcgtgacgagcggcatggtggtggggctcggctccggccctgcgtccgccctggccatccagtacctcggcacgcgcctccgccggggctctctcacgggcatcaccgcagtgacctcgtccgcgctcagtgcgagcgaggcagacaaggcagggatacgggctaacagctaccaggaaggcacccagattgattttgctttcactgatgctgaagcgatcgaggagggcacgctggccgcagtcatcgggcggcggaagaccgagagcggagagccctctttcatggcggagaaggcgatggctaaatcagctcacaagcttgccttcatcactggaaacgacaagtacgtgacgacgggcgtcccagggttcttttcccggtctcgata

SEQ ID NO: 64003 - protein, 193 aa, Zea mays
  misc_feature: Ceres CLONE 1532718
  misc_feature: SWISSPROT Homolog: EC 5.3.1.6 Ribose-5-phosphate isomerase
MEAMPRPSVAPSLQLQLRPCPRRPLRKHCPPSSVPSRRVACSASAADADVVDLFDAAKLTVDKFVTSGMVVGLGSGPASALAIQYLGTRLRRGSLTGITAVTSSALSASEADKAGIRANSYQEGTQIDFAFTDAEAIEEGTLAAVIGRRKTESGEPSFMAEKAMAKSAHKLAFITGNDKYVTTGVPGFFSRSR

SEQ ID NO: 64004 - DNA, 648 bp, Zea mays
  misc_feature: Ceres CLONE 1532725
  misc_feature: Encodes the peptide sequence at SEQ ID NO. 64005
  misc_feature (150)..(150): n is a, c, t, g, unknown, or other
ccccgcggtggcggccgctctttactagtggatcccccgggctgcaggaattcgtctcacccctagaaaaagcctccgctcgccaccatcgtgtaggttaggctaggttcgaccagctagcggaaataggtggccttcaggttccatcantaccaggtggtggggagcgcgctgccgacgcccggagatgagcaccccaagatctaccgcatgaacctctgggccaccaacgaggtccacgccaagagcaagttctggtacttcttgaggaagttgtaaaaggttaagaagagcaaccgccaggtcctgaccatcaacgagatctttgagcgtaacccgacgacactcaataactactgcatctggctggggggccagagcagaacctgataccacaacatgtacaaggagtaccgcgacccgaccctgaatggcgctgtggagcacatgtacaacgagatggcctctcgccaccgcgtgaggtccccctggatccagatcatcaagactgcgaccgtgcacttcaagctctgccagagggtcaacgcttcccctttcccccaacagtgagaccatattcccccctcttcgcaccccagggtcttgccccccgaccaggcaagcttaaagaccccgtttcaaggcttc

SEQ ID NO: 64005 - protein, 56 aa, Zea mays
  misc_feature: Ceres CLONE 1532725
MYKEYRDPTLNGAVEHMYNEMASRHRVRSPWIQIIKTATVHFKLCQRVNASPFPQQ

SEQ ID NO: 64006 - DNA, 610 bp, Zea mays
  misc_feature: Ceres CLONE 1532729
ggcggccgctctttactagtggatcccccgggctgcaggaattcgtctcacccctagaaaaaagggccggacactacactaccgtttttcctttcggatcgtcccgtctgtctgtctgtctgcctccctccgctcacctcctctgattctgctcgctttcttccatcttggtgcagcctccaatcttactgctgagccatggccgctgcctaagaaggcccagagccactcaggtatcatactctgcgccctgagggtgagcatccactgcgacggttgcactaataatgagagagaacgtgctccacagcactcaaggcgtatacgaaacggacatagacacgctgcagcacagggtggcgggcatagtgaaactgctctgcagacgcgctcttcaagaaactcctcaagtccgggaagcacgcgcagccgtggccggaacctgctccagacccaccggccgccgacagcccgcccgggcccgacggatctcccggcagcgcaggcaatatagaaaaacaaatcgagacgctctaggtgcccaattctccctatagtgagtcgtattacacgccctcactgaccgtcgttttacaacgtcgagactggg

SEQ ID NO: 64007 - DNA, 814 bp, Zea mays
  misc_feature: Ceres CLONE 1532737
aggctcggccgatcgccccctacacaacgctctttatccccacccctttgtcctaaaactggagctccaccgccgtggcggccgctctatactagtggatcccccgggctgcaggaattcgtctcacccctagaaaaaacctgcgggctgcggcggtgagggccgcggcacaggcgcacagcggtgcctgccctgcccacaccaccacagatccgttttaaaaccccaggcgtctctcacgcttccgccgctttacaactccccaccccagccgatcccaacgcacactgcacccagtccggcggccgccggtaatggcggtgcacggcggccactacctgtcggcgttccttgcggagacggagtggtccaaccaggtcgtcctcccccccctggccgcccggcgaatgggtggcgcgggcttgcagcaccccggtgcaaatcagaaatgacgataaatcccctccccccccccacccacctacaaaattcaaacctctggtcttttcccccgcgcggttttcctctcaatttacctccctcgcgaagagacactataaaccacttatcaccccctagcagctcgcctcctccctttcccaatccacccgcctattttaataaaaaaaccatataaattttgtttggcacatccccagggccgcgattctctttttgtctctccgggatcccccccccacccatattctctattccgcctgccataaacacccccacccctcacatttttctctcccacaccccacgccaatacaccccatcccctctttttatcctcttcttcctccccccc

SEQ ID NO: 64008 - DNA, 684 bp, Zea mays
  misc_feature: Ceres CLONE 1532739
  misc_feature: Encodes the peptide sequence at SEQ ID NO. 64009
  misc_feature (409)..(409): n is a, c, t, g, unknown, or other
  misc_feature (410)..(410): n is a, c, t, g, unknown, or other
ccccgcggtggcggccgctctattctagtggatcccccgggctgcaggaattcgtctcacccctagaaaaagaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttgggaatgcagcccaaatcgggcggtaaactccgtccaaggctaaatacaggcgagtgctttcnntagagtgggttgggcttctcctccccctccggtttcgggtcggggtcgtgagggtccccgggggtcgggttcgtgggtgaacggatcgaaatggccgcctccgaatgttgaaaacccttgtttttttggggggctcccctggggccaggaaaaaccttccctcccaaaacctttttagaccttaggggagggccctcgggccaaagaaacctccctatggggaaacccaaaggccccccggttttgggttttccccctttcccccgggggaggg

SEQ ID NO: 64009 - protein, 32 aa, Zea mays
  misc_feature: Ceres CLONE 1532739
PRWRPLYSSGSPGLQEFVSPLEKDPRSVGTTR

SEQ ID NO: 64010 - DNA, 749 bp, Zea mays
  misc_feature: Ceres CLONE 1532740
  misc_feature: Encodes the peptide sequence at SEQ ID NO. 64011
tctgttctagtggatcccccgggctgcaggagttcgtctcacccctagaaaaaacgaagcaaagcaaagccaaagcaatctcaagtgaatcaaaccgccagacttcgcagtcctcctccccactaccagagcatgcgcgttgccgcgacccgagccgccgccgccgctcaccctccgagcgccttcctgctcctcctgttactcctcggttgcgcgtccctcgcgatcggaggagcagccatggccggccacgtcctcggcggcgtgaaggagaacccagccgcggccaacagcgccgagtccgacgggctcggccgcttcggcgccgatgagcacaacaggcgcgagaacgcgctgctggaattcgtgcgcgtgggcccccccccccgcaccaggtggttgggccgggacgcttgcaaccacctctcgcttctagggccttcctaagggccggaagggaaaaaagctcttcccgaggctccaagggcctgggggtcaaggcccttgggccctcgcttttcaaggggagcctcccgggaatttccgcccccccaggggggaaagcgccccccgtcttttatcacaacggcttaacacttggggccccccaagtaaaaggggggaacaaggaaccccttgttttggggcccggaggttttctcccttaaaagggaatccttttgggtccaaaaaagaggccgtgtaacccccgtgttggtggaaacacccccccccagagaaaggggccc

SEQ ID NO: 64011 - protein, 104 aa, Zea mays
  misc_feature: Ceres CLONE 1532740
MRVAATRAAAAAHPPSAFLLLLLLLGCASLAIGGAAMAGHVLGGVKENPAAANSAESDGLGRFGADEHNRRENALLEFVRVGPPPRTRWLGRDACNHLSLLGPS

SEQ ID NO: 64012 - DNA, 767 bp, Zea mays
  misc_feature: Ceres CLONE 1532745
  misc_feature: Encodes the peptide sequence at SEQ ID NO. 64013
tacgatggccagccgcgcctaacaatcacctttaatccctacaaatttctaaaaaaaccgcactccaccgcggtggcggccgctctattatagtggatcccccgggctgcaggaattcgtctcacccctagaaaaaaaaaatctcccgcaaagacaacggcgagccaaccaccaccagcgtcccgcgctagctgcggcaccgcatggctgccgtgaccagcaccgcctccatctgcccggccgcagccggcgccctctcttcgctgccgtccttcatcacgcgcaagcccaccagcggcagcaggaggttgcagcaggcagcagcgacgacagtctgccactgccgctctgctcaagtagaggaggggctgctgggccggagggacgccttattgctcggcatcgtcttctccgctgagacaccgccgctgctcgcccctgctggcgctctggcggacgaggccaccccccattcgcaagagggctttactacgtacgaggatgaggccaacaagttccagcattcaagttccccaaggctggctggtcggcgcccggtaaggcccgccgcatctagtctgtcacggggcgttcttaccccgaagcaggcccccccccctactcctaatgtcacgctttgccctttaccccggtaaccggggccggaactttaaccagcccctccaagtcccttttgagccgactgtccgaagcccctttcaccccaaacgggctttatggttgaaccaggaacctggacacacccg

SEQ ID NO: 64013 - protein, 150 aa, Zea mays
  misc_feature: Ceres CLONE 1532745
MAAVTSTASICPAAAGALSSLPSFITRKPTSGSRRLQQAAATTVCHCRSAQVEEGLLGRRDALLLGIVFSAETPPLLAPAGALADEATPHSQEGFTTYEDEANKFQHSSSPRLAGRRPVRPAASSLSRGVLTPKQAPPPTPNVTLCPLPR

SEQ ID NO: 64014 - DNA, 664 bp, Zea mays
  misc_feature: Ceres CLONE 1532752
  misc_feature: Translation starting site: 84
  misc_feature: Pfam Name: DUF477 Pfam Description: Domain of unknown function (DUF477)
ctccccgcggtggcggccgctctagaactagtggatcccccgggctgcaggaattcgtctcacccctagaaaaagcggcagcaatggagaccctcctctccccctccacattgttcacgctatcactccgtggctccagcaggagaccgtctctggctgctagcgtctcgtccagacccaccgtgtcatgctccagcgcgctcaagaggccacaggccggcgccgtcgctgcctcctcccaaggagacggcgtcggcaggaactggatgtcgttcctgcaccacggcctggcggcggccgcgctgtcgctggccatcggcctggccccggcgccggcgccggcggtggcgtcggagttcgacgtgctgaacgacggggcccccgaggactcctacgtggtggacgacgcaggcgtgctgagccgcgtcaccaagtccgacgtcaagcggcttgcccgcgacctggaggcccgcaagaacatccgcctcaacttcatcactgtccgcaagctcacgagcaaggctgacgcgttcgagtacgcggaccaagtcctggagaagtggtaccccacgatcgaggagggcaacaacaagggcatcgtggtgctcgtcacaagccagaaaggaggcgccgtcaccggggggcccgccttcatccaggccgt

SEQ ID NO: 64015 - DNA, 641 bp, Zea mays
  misc_feature: Ceres CLONE 1532757
  misc_feature: Translation starting site: 522
  misc_feature: Pfam Name: DUF81 Pfam Description: Domain of unknown function DUF81
  misc_feature (609)..(609): n is a, c, t, g, unknown, or other
ctccccgcggtggcggccgctctagaactagtggatcccccgggctgcaggaattcgtctcacccctagaaaaagttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactgtgcgggtggtggtcgccaccgtcgtcgggttcctcggttccgcgtttggcaccgtcggcggcgtcggcggaggcgggatcttcgtgccatgctcaacctcgtcgtcggcttcgacaccaaatccgccgccgcgctctccatatgcatgatcatgggggcctcggcgtcatcggtttggtaaacctccaggtgtcgcacccgaccaaggaggcgcccgtcatcgactacnagctcgcgttgctcttccagcccatgcttatg

SEQ ID NO: 64016 - DNA, 563 bp, Zea mays
  misc_feature: Ceres CLONE 1532759
  misc_feature (257)..(257): n is a, c, t, g, unknown, or other
tggcggccgctctagaactagtggatcccccgggctgcaggaattcgtctcacccctagaaaaaagagccggtcgaggcacgccactccgcagtgtcagtcactgccccccccatcacgccgcccgccctttctcggccgttgccgcgagctcgctccgacccaccgcctatggcgacggcgatggggcgcgatggccgccacctgcatggcctcgatgccggccgccgctacgttcccccgtgatctcggccgtcngacaacgccaagcggctgttccaagttgccccgcccgtggaaaaaggttgcttgcaaacccccctgcccggaggcgttcctggttccccccaaaagggtttcggactcccggaactcccaaaatggccctttccccgaacccccaccaattgtttttggggaatccccttgtaagggggggttggaaaaaggtttttccccctgaaaaaaaaaaaggggaaaacccccgtggcccttgggggcccccataccggggcctaaaatttccccgtggaaaaagtgtttcaaaaaaaaaaaccccccaaa

SEQ ID NO: 64017 - DNA, 1040 bp, Zea mays
  misc_feature: Ceres CLONE 1532770-R
acgattgggtactcgagcgtctcgtttttttttttttttttgaaaaagaaaagatagatcttattagcttgtcgacacatgacatacaacaaaagagcagaggggttgatgaatcgcctcggcagctaaccccacatggtattaagcacacgggacacatcttaggccccgtttcaatctcacgggataaactttagcttactgctaaactttagctatataaattgaagtgctaaagtttagtttcaattaccaccattagggggtgcttaaaataaccagcatataagagtagacttactctggcatggggaagtatgtgaagtagcttagttgtgttctgtgcattttcctcatgcaaataaaagataaaaatgggggcccccccgggggggttgggggggggagtagagttggtgggtgacgtattctatacccctacccaattattttaggcatgtctctgatgtgttcgaggcagagcttttcgtaaccgtttggagtaggtggggcggtggcagagagggtggggtagtcgggttctctttttatatggtttgttttttatttatgttgtactatctggtggcggctgttttcaggtatgattttttttttagtatagtttgggtggaagacaataaatagaggggaggcggacgagagatgtaatgggggggctagacgaaacgagagattcggggcgaatcgatgaagaaggtggggagaggagatgacgttcgtatgtctgtttccttggggccagtcggcaagggggtgtaggggtattgggggttatgttaatagagtatatcaccataatatgagggtgtcctaacgcaccagagcgattgcagtcagtgaattggccgaggcgcactgtgagagtgtggcgggttgaaggtatattgtctattatatatacacactatacagtccgatttatccgcgcggtgggtggtgtttgagtgattttagatcttgcagtgtggatgcgtatagaactgatcgtttcgttgcgggggacgctgtggaaggga

SEQ ID NO: 64018 - DNA, 657 bp, Zea mays
  misc_feature: Ceres CLONE 1532778
gcggtggcggccgctctagaactagtggatcccccgggctgcaggaattcgtctcacccctagaaaaaatatcagtctcctgatgagtaactacctgtgtgaggacatgcatgagatgcaagctcatagatatgcgcatgtcaattgtatggaggatattgactgggaaatcagtgtagctgaagctgtcatataacactcttgcgcggcgagcggtcactgaattcttgaagcagctcttatgactaggtcatggacgtacccagtgttgattatcatggcctgcaactaatctgccgttctgcaacagctttaagactgtgttacccgacagctcttgtaaatgcctcgcctaacatgcattcatggttccgcgccatgtgattataagctgacgattaccatctatcgacgctcatagcgctcgcagatcgttcatgtgatacagacatggtgttcgttattatttccgtaaaattccgcgttaaattttttgtcataccaaactcattttttttcgaggatgcgggaggaaccccgatatgtccctttattgatccaaaataacgcacccgcgacttggggctgagtgtttttctcccgttttggaaaggggaaaccccctggtggtataccacatttttacttcccaccttg

SEQ ID NO: 64019 - DNA, 653 bp, Zea mays
  misc_feature: Ceres CLONE 1532782
ccccgcggtggcggccgctctagaactagtggatcccccgggctgcaggaattcgtctcacccctagaaaaagcgaccccatgtcagtccggactacccgctgagtttcagcctatctctaagcggacgagattatacttccgaggattcccctagtgacggcgagcgaaccgggagcagcccagcttgacaatcgggcggcctcgccgcccgatttgttatctggagaggagtcctcatccactgacctggcccaagttctctggaaagggacgcctgggacggtgacagccccgtccagcccggaccctgtcgcaccacgaggcgccgtgcacgagtccggttgtttgggaatgcaacccagatcccgcggtagactccatcctaggctaactacaggccagagaccgatagcgatccagttccgcgaggcacagatgaccacgactttgaaaagacagtcaaagactgcttgacattgccgggagggaagcggatggaggctggcaactcgcaccgggcgtatgctgaacggctcctgctgttccgcctatctgctcgggtcgtggactcgttgtcgcccgcgacggctgccatagcccggtggcccgttgctcccccagaatccatcatcggcgcagacggtatccgct

SEQ ID NO: 64020 - DNA, 630 bp, Zea mays
  misc_feature: Ceres CLONE 1532783
  misc_feature: Encodes the peptide sequence at SEQ ID NO. 64021
ccccgcggtggcggccgctctagaactagtggatcccccgggctgcaagaattcgtctcacccctagaaaaataatagtgctgcctctgagctaacgcgctctcacctacgctcccactcactctgaccccagttcccgccggctattgcctctatggctgcgcctgcagccggcttggccgtcctgctgctcttcatcgccgccctgcccgtcctttatgccgatgacctcaacaccgacacacacgcgctgcaggcgctccgctcggccgtaggccactccccgctgccatcctggatcagcaccacgcccacgtgccacttgcacgccatcacctgcgagagcggccgcgtcgtcgagctccgcctcccaggggcagctctcatgaccaacctcccctccggcgtgctcggcaaactagtcatgctccacttcctgtacctcctgttcaactcgctcacggcgcccatcctcaactacctctcccgcctgtcccagctccaggcgatctacttcctgcataacagcttctgctggcgaggtccctgcgtcaattgtctagctgaagattctcgcgaagctggacatcacacggcaaccagttcagcggcaatagctcctccgacttc

SEQ ID NO: 64021 - protein, 158 aa, Zea mays
  misc_feature: Ceres CLONE 1532783
  misc_feature (26)..(63): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAPAAGLAVLLLFIAALPVLYADDLNTDTHALQALRSAVGHSPLPSWISTTPTCHLHAITCESGRVVELRLPGAALMTNLPSGVLGKLVMLHFLYLLFNSLTAPILNYLSRLSQLQAIYFLHNSFCWRGPCVNCLAEDSREAGHHTATSSAAIAPPT

SEQ ID NO: 64022 - DNA, 649 bp, Zea mays
  misc_feature: Ceres CLONE 1532786
  misc_feature (540)..(540): n is a, c, t, g, unknown, or other
ctccccgcggtggcggccgctctagaactagtggatcccccgggctgcaggaattcgtctcacccctagaaaaacctagaaaaatttcaaaccactcttcgcccccttcctctcctctcatccccttcccccctccactctctcgtgtgtggtctcgcccctgaggttcctgatcgcaccatctccctccggcgacagtccgccgccccgccccgcgcgctcgacgaggccgctccgggtggtgaagaggtgagtgtcctacttgtgattcgcccatagattggatccggtcatccgctgcataaaatgactcctccgctgaggggggaaccgttttgagagatgggtggggtgttgcctcagcttcctgtttagcgctgtggaaccgttgctctgggggcgctgctgaaaggtctcccctctcccttcgaagtgcgctgtgaaggtccatcttccggagatgtcgaccacgtgccaattcccccctggtggaagcccaaccgtgatttgggaatgaggccaggggaacccgaacctggngaaggcaaccgaaatcctgctggaaacctcgaagaaggagggcccccgaccgcccaaccagaaagaaagggcccacaccaggcccaatcccaattgcgtgggccccagt

SEQ ID NO: 64023 - DNA, 630 bp, Zea mays
  misc_feature: Ceres CLONE 1532788
  misc_feature: Translation starting site: 118
  misc_feature (336)..(336): n is a, c, t, g, unknown, or other
  misc_feature (403)..(403): n is a, c, t, g, unknown, or other
aaactggagctccccgcggtggcggccgctctagaactagtggatcccccgggctgcaggaattcgtctcacccctagaaaaaccccaatcctccgcactctgtaaccccgcccgcgatggaggccgcaaccgccgccaccgcggcgatgatgtggttccggaagggcctgcgcgtgcacgacaacccggcgctggacgcagcccgccgacacggggtccgcgctgcatccgcgcggctgtacccggtgttcgtgctcgatccgcgctccttcgcccggatcccgtcgcggcgtccccatgttccgcgcgcggcagggtcgcccgcaatccacttntcctggagatgctcagcgacctcgacgctcgtctcccccacctaggggcccgcctcctcctcctgcntgcccgcggaacacctcgcccgaccttggcctgcccggccctaaagaattggacaattggcagctgtgccttcaagtaccattacgacccgtaggcgctaggccgcgataagaaggtcacggattttggctttggcgtcggggcatcgtagtgcttcacgcccgtaatccacaccctcttcgacccagaagaattctaaagaaggaccggtggtcaagccgcctttg

SEQ ID NO: 64024 - DNA, 644 bp, Zea mays
  misc_feature: Ceres CLONE 1532789
  misc_feature: Encodes the peptide sequence at SEQ ID NO. 64025
  misc_feature (375)..(375): n is a, c, t, g, unknown, or other
taactggagctccccgcggtggcggccgctctagaactagtggatcccccgggctgcaggaattcctctcacccctagaaaaacactcgttctatctccttctccactgggccaactccgctctactccccaatcccaggcgaatccctcgtcttcttcgaccgcgtgtcggagcttcgtcttctctggcccccctgccctgatttgccgctccgctctccccccttccgccagaaaggggggaaattgatggcgaggctagtggctctggcatcggcggtggcggttctggtactcggcctcccctgtgcagaagcggaaccacagtgcacgcggcgccgcccgcccgcgccgccgcggccgcacagcgtgacnatcaccgagttcggggccgttggtgacggcgtcaccctcaacaccgtgtccttccagaacgccgtcttctacctgcgctccttcgccgacaagggcggcgcgcagctgtacattcccaggggccggtggctcaccggcagtttcaatctcaccagccaccttaccctcttcctggagagtggcgctgtcatcgttggcacgcaagacgtttcacagtgggcctgttgttgaacctttgccatcatatggacgaggaatgcaccctcccc

SEQ ID NO: 64025 - protein, 118 aa, Zea mays
  misc_feature: Ceres CLONE 1532789
  misc_feature: SWISSPROT Homolog: EC 3.2.1.82 Exo-poly-alpha-galacturonosidase
MARLVALASAVAVLVLGLPCAEAEPQCTRRRPPAPPRPHSVTITEFGAVGDGVTLNTVSFQNAVFYLRSFADKGGAQLYIPRGRWLTGSFNLTSHLTLFLESGAVIVGTQDVSQWACC

SEQ ID NO: 64026 - DNA, 682 bp, Zea mays
  misc_feature: Ceres CLONE 1532798
  misc_feature: Translation starting site: 183
  misc_feature: SWISSPROT Homolog: EC 3.2.1.23 Beta-galactosidase
  misc_feature (682)..(682): n is a, c, t, g, unknown, or other
ccgctctagaactagtggatcccccgggctgcaggaattcgtctcacccctagaaaaagatctatctctcagtattcacttgttccttctgttctttattttttaggtgctcctcaagatctctgctccaagtacaaggaaaaattcccatttgacgtccaggaagatgcatcttgtcgatcatgatcaagcccattctatttcctgaaaagtcaggaacctcgccagcttcaaaaatggtgtatgtaccacttagttttggacccctagtcggatactgttgtatttatctcaagttggacggttatgtacaatacagaccttagtagtgtgatgtccagaatggcagaatccaattcagatttgttcaatttgtttgaaaaaaaaaaaaaaaaacgagacgctcgaggtacccaattcgccctatagtgagtcgtattacgcgcgctcactggccgtcgttttacaacgtcgtgactgggaaaaacccctggcgttaccccaacttaatcgccttgcagcacatcccccctttcgcccagctggcgtaaatagcgaaagaggccccgcaccgatccgccccttccccaaacatttgccgccaaccctgaattgggcgaaattggaaaatttgtaaagcgtttaaaaatttttgtttaaaaaattcccccggttaactttn

SEQ ID NO: 64027 - DNA, 2573 bp, Zea mays
  misc_feature: Ceres CLONE 1532807
  misc_feature: Encodes the peptide sequence at SEQ ID NO. 64028
agtaaaccctctctctcgcagtctcgctccctctgtctccctcttagcgacgactgggcggccgtcgctgctggcctgctgccctacgccaggtgcccaagtcttcttcgggctcctcgtcgtagtcggcgacgaccaccaccaggtccctgttgtttttaagaaaaacaaaacaatggaggcaacattagcattctcccaggacagcccaccaatttcgataatttgtgcagcaaagtttgtgggtttacccctaaccatggatcctagccttgcttctggcttcgcacccaccctacgttttgcttctggagaatcactccatggtgtcaacccaatcctcctgtacattgccagcggtgcaacaattccctgcttctctgggaagaatgatattgagtttgggcatgttgttgaatggcttgaatatgtccccatctttctttcaggctctgaatttgaaaatgcctgcttatttgttgatggattcttggcctcccggacctttctggttggtcatggcctcacaattgctgacattgtagtttggtcaaatcttgctggaattggtcaacgatgggagagtctaaggaaatcaaagaaataccaaaatcttgtccgctggttcaacagcatagattcagaatacagtgacacactgaacgaagttttggctgcatatgttgggaaaagaggaattggaaaatctcctgcaccaagccttaaggaaaaggtacatgtttcaaaggatccatcagctccagaagttgatctccctggtgcaaaagttgggaaagtctgcgttcgttttgccccagaacctagcggttacctccatatcgggcatgcaaaggctgggctattgaacaaatactttgctgaaagatatcaagggcgcctaatagttcgatttgatgatacaaacccttcaaaagaaagtaatgagtttgtcgagaacgttttgaaagatattgagacgttggggatcaaatatgatgctgtcacatacacatctgattatttcccaaagttaatggaaatggctggaagcttgattaaacagggtaaagcatatattgatgacacaccgaaggagcaaatgaggaaagagaggatggatggtattgagtcaaggtgcagaaatagtaccgtggaggaaaatctgtcattatggaacgagatggttaatggaactgaaaggggtatgcagtgctgtgtacggggtaaacttgacatgcaggatcctaacaagtcactcagggatcctgtttactaccgctgtaatattgatcctcaccatcgtgttggttcaaagtacaaggtctatccaacatatgactttgcttgcccatttgttgatgcattggagggggtgacgcatgcccttcggtccagtgaatatcatgacaggaatgcacaatattatcgaatccttcaagacatggggttgaggagagtagaaatttatgaattcagccgattgaatatggtttacactcttctaagcaagcggaagcttctctggtttgtacaaaacaagaaggtcgaagattggactgatccacgttttcctactgtccaagggatagtacgtcgtggcttgaagattgaggcattgatacaatttatactccaacagggtgcttcaaaaaatctgaatctcatggagtgggataaactctggacaatcaacaagaagataattgatccattgtgcgcaaggcatactgctgtgctaaaagaccagtgtgtcatctttactcttacaaatggtccagagaagccatttgttcgaattttaccaaggcataagaaatttgtgggtgctggaaagaaggctacaaccttcgccaacagaatttggttagattatgctgatgcagcagccattagcaagggtgaggaagtaacccttatggattgggggaatgctatcgttaaagagatcaaggtggagagtggagtaattactgaactagttggagaattacatcttgaggggtctgtgaagacaacaaaattgaagatcacatggctagcagatatagaggagctagtccccctctcattggttgaatttgattatctcatcagcaagaaaaagctagaggaagatgatgacttcctcgagaatctcaacccttgcactcgacgagaaaacccagcccttggagatgcaaacatgatgaacctcaagcgtggagagatcatacagctcgagaggaaaggctactataggtgtgatgccccttttatcagatcgtcgaaaccggtggttctgtttgcgatcccagatggccggcagcaggccttgcttaactaggcatgatgaccacttttggcacatggaattcctgagatatcggagtcggcaatcaatattgttgcattatacactttgatactgtactgtgactgggcttactcatggtgtgccagatggccaggcctatcctgtcaacaaagcagcacagccattttgattttggtcgattatacttttaccggagcttaaaagtttcttatacttttctggcagtgcctttgctactttgcaaaaaaaaaaaaaaaaa

SEQ ID NO: 64028 - protein, 715 aa, Zea mays
  misc_feature: Ceres CLONE 1532807
  misc_feature (207)..(512): Pfam Name: tRNA-synt_1c Pfam Description: tRNA synthetases class I (E and Q), catalytic domain
  misc_feature (514)..(690): Pfam Name: tRNA-synt_1c_C Pfam Description: tRNA synthetases class I (E and Q), anti-codon binding domain
  misc_feature: SWISSPROT Homolog: EC 6.1.1.17 Glutamate--tRNA ligase
MEATLAFSQDSPPISIICAAKFVGLPLTMDPSLASGFAPTLRFASGESLHGVNPILLYIASGATIPCFSGKNDIEFGHVVEWLEYVPIFLSGSEFENACLFVDGFLASRTFLVGHGLTIADIVVWSNLAGIGQRWESLRKSKKYQNLVRWFNSIDSEYSDTLNEVLAAYVGKRGIGKSPAPSLKEKVHVSKDPSAPEVDLPGAKVGKVCVRFAPEPSGYLHIGHAKAGLLNKYFAERYQGRLIVRFDDTNPSKESNEFVENVLKDIETLGIKYDAVTYTSDYFPKLMEMAGSLIKQGKAYIDDTPKEQMRKERMDGIESRCRNSTVEENLSLWNEMVNGTERGMQCCVRGKLDMQDPNKSLRDPVYYRCNIDPHHRVGSKYKVYPTYDFACPFVDALEGVTHALRSSEYHDRNAQYYRILQDMGLRRVEIYEFSRLNMVYTLLSKRKLLWFVQNKKVEDWTDPRFPTVQGIVRRGLKIEALIQFILQQGASKNLNLMEWDKLWTINKKIIDPLCARHTAVLKDQCVIFTLTNGPEKPFVRILPRHKKFVGAGKKATTFANRIWLDYADAAAISKGEEVTLMDWGNAIVKEIKVESGVITELVGELHLEGSVKTTKLKITWLADIEELVPLSLVEFDYLISKKKLEEDDDFLENLNPCTRRENPALGDANMMNLKRGEIIQLERKGYYRCDAPFIRSSKPVVLFAIPDGRQQALLN

SEQ ID NO: 64029 - DNA, 645 bp, Zea mays
  misc_feature: Ceres CLONE 1532824
  misc_feature (163)..(163): n is a, c, t, g, unknown, or other
  misc_feature (174)..(174): n is a, c, t, g, unknown, or other
  misc_feature (175)..(175): n is a, c, t, g, unknown, or other
ccccgcggtggcggccgctctagaactagtggatcccccgggctgcaggaattcgtctcacccctagaaaaataacaggtgctgcttgcagccttggatatttgcggatgcggagtgaagttaccatggcatccttgctaagaataagaaagtaatgtggttnatgaggagatnngtgtaattttttgtggccgaatatttattttgcacattgatgtatattttgggctaaaaaaaaaaaaaaaccgagaccctcgaggtcccaattcccccttaaatgaggccttttaccccccctccctgggccgtccttttttcaacctcggacctgggaaaaaccctggggttccccaaaattattgccctttgggaaaaattcccccttttcccccggttgggttataaagaaaaaaaggcccccccccttttccctttcccccaaaattttccccccccccaagggggaaaagaaaaattttgccccccaaattttttttataaaaacccccccaaaaaattttttgttaaaaacccccccttttttttttaaaccaaccccccaaaaatggggaaaaaccctctttttatataaaaaaaaatacccccccaaggggggggggggggggtttcccccccttcaaaaaa

SEQ ID NO: 64030 - DNA, 644 bp, Zea mays
  misc_feature: Ceres CLONE 1532830
  misc_feature: Encodes the peptide sequence at SEQ ID NO. 64031
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnggaaagctggagctcaccgcggtggcggccgctctagactagtggatcccccgggctgcaggaattcgtctcacccctagaaaaaaccattcgaaagatccctccaggaaagatttttcttccctcctccgacgccccagcccaccaacacactctataaagcagccccccagtcacacacagaacgcacaagcgcaagcagggcaagaaaactccgcaggccagtctgcgcgagttggatggccttcttcttggccctcgtgtgcatcctcgtcttgctagccatcgcctcctacgtccagtacactcgctggcgaaaaggggaaaggccgcttcggcgccatggggaggtctgctcctttgaagctgcctccttgctcccatgggctggcctttactttgccaaagaccctcagcttttactccaggaaccccaaggtcctccttcgcttccaaaaagaaagaggtcccgcaaagatcctccagacccaccctctggggctgcccctttccttgatgcctggccaacccccgaggccggccccggtttccggcttg

SEQ ID NO: 64031 - protein, 106 aa, Zea mays
  misc_feature: Ceres CLONE 1532830
MAFFLALVCILVLLAIASYVQYTRWRKGERPLRRHGEVCSFEAASLLPWAGLYFAKDPQLLLQEPQGPPSLPKRKRSRKDPPDPPSGAAPFLDAWPTPEAGPGFRL

SEQ ID NO: 64032 - DNA, 654 bp, Zea mays
  misc_feature: Ceres CLONE 1532833
  misc_feature: SWISSPROT Homolog: EC 3.2.1.23 Beta-galactosidase
  misc_feature (557)..(557): n is a, c, t, g, unknown, or other
  misc_feature (654)..(654): n is a, c, t, g, unknown, or other
ggagctccccgcggtggcggccgctctagaactagtggatcccccgggctgcaggaattcgtctcacccctagaaaaattatattggcaaggttcattgcatggaataaattagttaggatttgccctattctaccagggcttgggaaatctgagcttgtgttgtgagtggcgtggtcaagtttgattatctctttttagttgtaatctcgtgatttccttcttttttttaaaaaaatatttatccttttgaatccgtgctagtatgcaaatttttggtccttttgtaccgaaaaaaaaaaacgaaaccgagacgctcgaggtacccaattcgccctatagtgagtcgtattactcgcgctcactggccgtcgttttacaacgtcgtgactgggaaaaccctggcgttacccaacttaatcgccttgcagcacatccccctttcgccagctggcgtaataacgaagaggcccgcaccgatcgcccttaccaacagttgcgcagcctgaatggcgaatggaaattgtaagcgttaatatattgttcaaattcgcgttnaattaatgttaaatcagctcatattctttaccaataggtcgaaatcggcaaaatcccttataaatcataagactagaccgagatgaggtgtgagtgn

SEQ ID NO: 64033 - DNA, 794 bp, Zea mays
  misc_feature: Ceres CLONE 1532837
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (45)..(45): n is a, c, t, g, unknown, or other
  misc_feature (54)..(54): n is a, c, t, g, unknown, or other
  misc_feature (712)..(712): n is a, c, t, g, unknown, or other
aaattttnnnnnnnnttttttttgttatttcagattaatgttttntttttgggnttaaaactggtactccccgcggtggcggccgctctagaactagtggatcccccgggctgcaggaattcgtctcacccctagaaaaacttcgcactcttctccccctcttctcttctcgtagacggcagatctccaggggtgtcgccgtctccggccacggcggccggcgctcggagcatcggtggggttcggcgcgaaagtgggcggtcctgtcccaaaaccagctgcaggagctggcgcagcaagagctgcttcaacctgccgtcttacactgtgcctgcgggaggggcccgaacttgcgccgcggttcaaggcggcggtgatcttctgcagggcacatgttcgagagccccgatcttctttcatcacgctcctccagggtgtatcacgccgcactctgaaggtcccacctcgactcgcttgaaagggtgcgggccttgtcatatactcgctgcagccgcccgccatccttggggatgaatccgcgaggttccactcacccacacctttcttaccgggcaggtagacctctaatcgtaaatcgcgccgcggcacttctcccccattgggagtataaaccacaaaccagaatcctgagcatttggggccttcccttggcgcggtgtcctcctccctgaccactcgttctgcgccttangatgggtttatcccccccctttctctgagataacaccccttgccttctggttatttaagtctgcatcgtgctggtgaaacaa

SEQ ID NO: 64034 - DNA, 677 bp, Zea mays
  misc_feature: Ceres CLONE 1532838
  misc_feature: Encodes the peptide sequence at SEQ ID NO. 64035
tccccgcggtggcggccgctctagaactagtggatcccccgggctgcaggaattcgtctcacccctagaaaaagctagtgctaccaagaacaggaaggaaacaccgccgccgccgcgccttccattccagtactcgcggaggaaaggaacaccagccagcgccatggtcacgtcgacgaccgccgccgccgtgctgtccccgccgtccgtgggcgggcttcgcctggcgccgtctccccgggcgcgcgtggcgttccgcgcggcgccggcgcggcggtccgtggcggcgcgcgcggagctgagcccgtcgctggtgatcagcctgagcacgggcgtgtcgctcttcctgggccgcttcgtcttcttcaacttccagcgggagaacgtggcgaagcaggtgccccagcagaacggcaagacgcacttcgacgccggggacgagcgcgccaaggagttctcgggcctgctcaagtccaacgaccccgggggcttcaacctcgtcgacgtcctccgcctggggctcgctcggccacatcgtcgccctactacattctcgccacctcccggaaagggatacgaacccaacctcttttctaacgggtgggtttgcaggcatggtttttgagccccgcctgttttttctactccccggtgggtgttgagcccctaaatcctgg

SEQ ID NO: 64035 - protein, 153 aa, Zea mays
  misc_feature: Ceres CLONE 1532838
  misc_feature (45)..(121): Pfam Name: PSI_PSAK Pfam Description: Photosystem I psaG / psaK
MVTSTTAAAVLSPPSVGGLRLAPSPRARVAFRAAPARRSVAARAELSPSLVISLSTGVSLFLGRFVFFNFQRENVAKQVPQQNGKTHFDAGDERAKEFSGLLKSNDPGGFNLVDVLRLGLARPHRRPTTFSPPPGKGYEPNLFSNGWVCRHGF

SEQ ID NO: 64036 - DNA, 614 bp, Zea mays
  misc_feature: Ceres CLONE 1532842
  misc_feature: Encodes the peptide sequence at SEQ ID NO. 64037
  misc_feature (422)..(422): n is a, c, t, g, unknown, or other
gcggtggcggccgctctagaactagtggatcccccgggctgcaggaattcgtctcacccctagaaaaaagaagagcctccgcctccgctggtactcgagctcttctacactccacgtctcctccagacgctcaccacacaagtccacaactaccaagtcccctaaacacagtcataacttcccagctcacccgcgctagttcgtcgcccgtctcgacatggagtgcgagaacgggacacgtcgccgccagcggcaatggtggcgtctgcctggccacgcccgcgccgcgtgctgaccccctgaactgggcgaaggcggccgaggacctggccgggagccacctggatgccgtcaagcggatggtggaggagtacaggagggcgctggtgaagatcgaggggcgcagcctgaccgtcgcccangtcgcaggcgtggccgcggccggcaaggcccgcgtgaagctcgacaagtccacgcgcggccgcgtcaaggccagcaacgattgggtcttggacagcatgatgagcgggaccgacagctacggggtcacagcgggctcggggccacctcccaccggaggacaaaggaggcgggccccccccagaaggagctca

SEQ ID NO: 64037 - protein, 204 aa, Zea mays
  misc_feature: Ceres CLONE 1532842
  misc_feature: SWISSPROT Homolog: EC 4.3.1.5 Phenylalanine ammonia-lyase
  misc_feature (140)..(140): Xaa is any aa, unknown, or other
GGGRSRTSGSPGLQEFVSPLEKRRASASAGTRALLHSTSPPDAHHTSPQLPSPLNTVITSQLTRASSSPVSTWSARTGHVAASGNGGVCLATPAPRADPLNWAKAAEDLAGSHLDAVKRMVEEYRRALVKIEGRSLTVAXVAGVAAAGKARVKLDKSTRGRVKASNDWVLDSMMSGTDSYGVTAGSGPPPTGGQRRRAPPRRSS

SEQ ID NO: 64038 - DNA, 659 bp, Zea mays
  misc_feature: Ceres CLONE 1532846
  misc_feature: Translation starting site: 143
  misc_feature: SWISSPROT Homolog: EC 3.2.1.23 Beta-galactosidase
  misc_feature: SWISSPROT Homolog: EC 2.7.11.1 Non-specific serine/threonine protein kinase
  misc_feature (636)..(636): n is a, c, t, g, unknown, or other
ctccccgcggtggcggccgctctagaactagtggatcccccgggctgcaggaattcgtctcacccctagaaaaaacaacacttgaaggctgtttcatccgaagtaaatatgatgttttattggagcttgcaaagaaccattgatggtgatcgttagtgagctactaccagggatgacactgaaaagttacctgtatagcatccggcctagccaactaaatacacacactgcaataagctatgcagtggacatagctcatgcactggactgtttacatgccaatggtataatacatagcgacctgaaacctggtaaggatgcttaagctaattgacttttggcattctacgctttgattctttagcacgagcaccttaagtatgagtttacaatctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaaatgcgaatggaaattgtaacggnaatattttggtaaaattcgcgtt

SEQ ID NO: 64039 - DNA, 880 bp, Zea mays
  misc_feature: Ceres CLONE 1532847
  misc_feature (19)..(19): n is a, c, t, g, unknown, or other
  misc_feature (37)..(37): n is a, c, t, g, unknown, or other
  misc_feature (41)..(41): n is a, c, t, g, unknown, or other
tgttttgtgtcgggggggncccccccacaccacgccnaaanaggaatttcttcttgaactccccgcggtggcggccgctcttttctagtggatcccccgggctgcaggaattcgtctcacccctagaaaaaaagtgacttgccgagacatagttatcattggttatctataatagctcaatcgacgcgtgcaatctgaaggctttgttatacgtggaaaggtcgtctatgtagcttcgtcatagatgatgtcggttggctcaaataagaaggttttgcatacgtggcaacttcctctatgtggtcttgtccccgcctctctttgcagactcatactaaaaacttagaccctcccacgttcccttctccaaactatagtatagccgtataaacaggcgcgtcactgcgacgcccgtttatacattcgtcgtagaaggggagcaaataccttggtgattaccccaacatattgttcggccttggtaggcacccccccccctttttcacattcgcttggtcgttctttccctataattaggaccccgctaacccaaatccggcccctgtccccaaaaactgttatggtgtttgacccctgccaagagctccaaaaatgccccaaatctggaccgcaaccggaatacatttccatctgtatccaaacaatcctcccctctgacaattctttctgacttcgacttcccaccactactatttctctctcctaaccaaccacaccatatagaataccgcggtaggattttcgctttaatagaatttcaagataaatattgaaccctagtctttggggtttttgtaatgcccccgatctgcccttctctgtgacctcttgcattcttcccttaagttggaaaaaaggg

SEQ ID NO: 64040 - DNA, 632 bp, Zea mays
  misc_feature: Ceres CLONE 1532852
  misc_feature: Translation starting site: 194
  misc_feature: SWISSPROT Homolog: EC 3.2.1.23 Beta-galactosidase
agatcccccgggctgcaggaattcgtctcacccctagaaaaaatctctgttgctgctgctgattcgcacgacgaacgcgagcagtgtcgaaccctaccaaatcacagatcccctcggtcggtcaccaaccatagcggctgtcaaatccccagatcaaatgcttattgggtgggtgcagagataaaattgttgcatgcttcctccctcgcaggccggtccaaggaaacctgctagctggttagtacgccattactctgctcatctgctgttttgctccagtgtcatcagcttgccaaaaaaaaaaaaaaaaacgagacgctcgaggtacccaattcgccctatagtgagtcgtattacgcgcgctcactgtccccccctttacaacgtcgtgactgggaaaaccctggcgttacccaacttaatcgccttgcagcacatccccctttcgccagctggcgtaatagcgaagaggcccgcacccgatcgccctttccaacagttgcgcagcctgaatggcgaatggaaattgtaagcgttaatattttgttaaatttcgcgttaaatttttgttaaatccacttcatttttttaaccaataggccgaaaatgggcaaaatcccttataaatcaaa

SEQ ID NO: 64041 - DNA, 631 bp, Zea mays
  misc_feature: Ceres CLONE 1532854
  misc_feature: Encodes the peptide sequence at SEQ ID NO. 64042
aagctggagctccccgcggtggcggccgctctagaactagtggatcccccgggctgcaggaattcgtctcacccctagaaaaagcaccgtacttcaccccccaccaaccttccccctcaaaaactatccacccctccacggctccacccctacccgccgacgagcgcgatcgattgattcggttcgagccgggcggaggaggaggagggagcgccgcggggcggggtgagcccaccagatccgactaccgcagcggctatgatgaagtcgctgctgccgcagagccagctgcggcgctcggcggcggggcccgcgcgggtcgtcggcgggcggcgccgcgggggcagacggggctatgtccgacggcggcggcgcggggccgcgggcgcccgcctcctccaccttctggttcctgctccacgcgctctgctgcctcatctcgctcttcctcggcttccgcttctcgcgtctcctcttcttcctgctcttctccaccaccgcgctctaccgctccagcacctcctcctcctcggccgcggtccttcgcgccaccaccacgaccaccaccgccacgaccaccaccacgacgactaccaacaccttcacgctctccttcgccgccgccaacact

SEQ ID NO: 64042 - protein, 92 aa, Zea mays
  misc_feature: Ceres CLONE 1532854
MSDGGGAGPRAPASSTFWFLLHALCCLISLFLGFRFSRLLFFLLFSTTALYRSSTSSSSAAVLRATTTTTTATTTTTTTTNTFTLSFAAANT

SEQ ID NO: 64043 - DNA, 625 bp, Zea mays
  misc_feature: Ceres CLONE 1532862
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaatatttattgggttaaagttggagggatgtgggttaagattggatggatgctcctgggctaagtggatttaatttttatccttggagaataatgaacacggaggtgtagccaaataataacgtgatatatatatttctttgcccctttgaagaagccccgcggccgcacacacaaaatgatgcagtacaaccgccgcaatcatcaccgccatcgtcggcttctccaagaacccaattccccactccttcaagaagattacgcccctccactggtacccgtttctcaaccttcttactgggaaaaccctgatgttccccaagttaatcgccttgtagcacatccccctattcaccaactggctgaatagcaaaaaggcccgcacctgatccccttcccaaactttgcacagcctgaatggcaaatggaaatttaaaagcttaatattttgttaaaattcgcgttaaatttttgtaaaatcgactcctttttttaacccataggccccaatcggcaaaatccttaataaatcaaaagaatagaccgagat

SEQ ID NO: 64044 - DNA, 639 bp, Zea mays
  misc_feature: Ceres CLONE 1532863
  misc_feature: Encodes the peptide sequence at SEQ ID NO. 64045
  misc_feature (423)..(423): n is a, c, t, g, unknown, or other
gctctagaactagtggatcccccgggctgcaggaattcgtctcacccctagattctttcttcggcgcagtatctcctaggtctgctagaaagcaatcgcccgcggtattatccatccaccacgctgcatctgcttctcacgccgcctcgccttcctcttccacccctcgccgtccgtcgtcctcagcgcttgtacgcttgcctcaaaacccctggcgccgtgctaaaaccctagccctcgaattccttcccctgcccgcgcggagcagacgagcctgagcccgtcctcctcgtccatggcgtcctcaggggccgccgctaacctctgggtactgcttggtctcggcatcgcgggcgttctcctggcggcgcggcgactgaggcgccctgcgcgccccgatcacggcgccctcgtcgcccgctngaagtttctccgcggccaaaccttcgcccgcgaaggggccccacccgctcaccggattctggtttccccatcgctgaacccattgcaggtgcaggggttaaattaaaattttccggcagccttttattggggcaagaaaccccaagtggaaaaggggctacacccccccgggggtttcccccccttggtggaaaggggggcgccctttgggggggg

SEQ ID NO: 64045 - protein, 77 aa, Zea mays
  misc_feature: Ceres CLONE 1532863
  misc_feature (43)..(43): Xaa is any aa, unknown, or other
MASSGAAANLWVLLGLGIAGVLLAARRLRRPARPDHGALVARXKFLRGQTFAREGAPPAHRILVSPSLNPLQVQGLN

SEQ ID NO: 64046 - DNA, 651 bp, Zea mays
  misc_feature: Ceres CLONE 1532877
  misc_feature: Encodes the peptide sequence at SEQ ID NO. 64047
tccccgcggtggcggccgctctagaactagtggatcccccgggctgcaggaattcgtctcacccctagaaaaagccactctccatctattcctcacgagcgattgcggcggcggaagtaagaggcgatggggcactccaacgtgtggaactcgcaccccaagaactacgggcccggatcccgcgtctgccgggtctgtgcgaaccctcatggactgatcaggaagtacgggctgatgtgctgcaggcagtgcttccgcagcaacgccaaggacattggcttcatcaagtaccgctgaagtcagctgggcgggctatctgaatgccatctcttggacagtgtagtagaagcgatgccacaattttaattactgtcatttagatcgtcccttcagaactctgctatttaagtccgccatgtttgtgatacacaacctaagctttgtttgttatactgattatgagttacctgtgctttgcttaaaagaaaccaaaaaaacgagacgctcgaagtaccaattcggcctatagtgagtcgtattacgcccgctcactggccgacgttttcaacgtcctgactgggaaaaccctgtgcgtaccccactaatcggcttgcagaaatccccctttccccagctgtggtataaccaaag

SEQ ID NO: 64047 - protein, 56 aa, Zea mays; identical to SEQ ID NO: 1999
  misc_feature: Ceres CLONE 1532877
  misc_feature (3)..(56): Pfam Name: Ribosomal_S14 Pfam Description: Ribosomal protein S14p/S29e

SEQ ID NO: 64048 - DNA, 1001 bp, Zea mays
  misc_feature: Ceres CLONE 1532882-R
cctcgagcgtctcgtttttttttttttttttgatgaaccacatcccatgaacgactgcgccacaatccagaaaatcattacagaacacacattatcattgaggaacttgaatatttgtaatggcaactatccataaactctcctgatggtaatttttctaagggtgagacgaattcctgcagccccggggatccactagttctagaacggccgtccactccctgtggaggctccagcttttgttcccattagtcatgattaattactcacttggcctaatcatggtcataactgtttcctgctgggaaaatgttatccgttcacaattgcccacaacatacgagccctaagcattaagtgtcaagcctggggtgcctaatgagtgagctaacttaaattggttgcgttgcgcttcactgcccgcaattccatgtcggggaaacctgtcctgcccaacttgccttactgaatccggccaacgcgtcgggggagaaggcggctttgcagaattgagggcgcatcttccagctttctctcggctcacgtggaatcggcttccgcctttgggacgtttggggaatcccgggtgagggggggagtctggcctttaaattaaaaggggggggtaaataccccgggtttgttccaaccggaagatcttgcgggggaatataagggccggtgaaaatacaaccatttttctagccgcaaaaaggggtcaatccaataagacggcccggggaacccctttaaaaaaagggccggcgagttgggttttggaacttttattcccagaaggggcgccacccccaccctctaaccaacccttgaatacaaaaggccaagccccctcagagtaggaaggtggggaagaaccatggccggggctttaaggagaaataaacccccattcccccccccctaaacggcggggtgttggcttaacccgtttcaccccctgtgcgccgtaccggaaaaccttgcgcgcgtgggggagggtg

SEQ ID NO: 64049 - DNA, 641 bp, Zea mays
  misc_feature: Ceres CLONE 1532883
  misc_feature: Encodes the peptide sequence at SEQ ID NO. 64050
acccgcggtggcggccgctctagaactagtggatcccccgggctgcaggaattcgtctcacccctagaaaaactcctcactccaccactgcccactcccatcccacgcgagcacaaccaccacctactccctactccctactctactccccccgcaagcacgcccagcgccatggccatggcggcagcgcgcacgggggcctgctactccgcctccgcttcctctcctctcctgcactactagcgggtccgctggcgacgatggcggcggtggcgagcagggagaggctctccccgggcgccgcgccgcaggtggacgcgggcaagtacgtgcggtacacgccggagcaggtggaggcactggagcgcgtctacagcgagtgccccaagcccagctcgctgcgccagcagcacctcatcagggactgccccatcctccgcaacatcgagcccaagcagatcaaggtctggttccagaaccgcatatgccgggagaagcagcgcaaggagtcctctcgtctacaaaccgtgaaccggaagctgagtgcgatgaacaagctgttgatggaggagaatgaccggctgcagaagcaggcttcccgtctcgtctttgacaacgggtatatgaagaatcgactccac

SEQ ID NO: 64050 - protein, 127 aa, Zea mays
  misc_feature: Ceres CLONE 1532883
  misc_feature (20)..(80): Pfam Name: Homeobox Pfam Description: Homeobox domain
MAAVASRERLSPGAAPQVDAGKYVRYTPEQVEALERVYSECPKPSSLRQQHLIRDCPILRNIEPKQIKVWFQNRICREKQRKESSRLQTVNRKLSAMNKLLMEENDRLQKQASRLVFDNGYMKNRLH

SEQ ID NO: 64051 - DNA, 697 bp, Zea mays
  misc_feature: Ceres CLONE 1532885
gctggagctccccgcggtggcggccgctctagaactagtggatcccccgggctgcaggaattcgtctcacccctagaaaaacgcgctcgcgctcgccttcgtgctcaggtactacgtctacgtcgacagggagtgcggcggcaaccccatgcgccgcagcgccaaggtgggcggcgaggactgcgccagcacctggccctggcccttccaggtctgaagcggaccatgagtttttggaagggaaatcaagcgtccagttgtgggggacgggatgcacaatgttgtgattcgtttatgtgtttattatgtggttttgcaatgtcatatttgtaacgctgttatatttatataattatatatgtgaaagttgctcagaatacattgacataaacgagacgctcgaggtaccccaactcgcccgatagtgagtcgtattacgcgcgctcactggccgtcgttttacaacgtcctgactgggaaaaacttgattttcccaacttaatggccctgcagcaaatccccccttccgccgcatggcttaatagcaaaaaagccccaaccccaattgcccttcccaacctttccccccccttgaatggcaaatggaaaatgccaaccctttaaatttttgtaaaatttccggtaaaatttttggtaaaacggccaattttttttaaccaaaatggcccaaaaaccc

SEQ ID NO: 64052 - DNA, 662 bp, Zea mays
  misc_feature: Ceres CLONE 1532894
  misc_feature (277)..(277): n is a, c, t, g, unknown, or other
  misc_feature (278)..(278): n is a, c, t, g, unknown, or other
  misc_feature (334)..(334): n is a, c, t, g, unknown, or other
tggagctcaccgcggtggcggccgctctagaactagtggatcccccgggctgcaggaattcgtctcacccctagaaaaatatttttttggttagttacttcatgtggaggccttgaagcttagaatgtttatgtatatatcttatggaaaggcttcacccttccaactattttaataagttatgcactttgggtactatcaggacttgtaataaatacatctctttctaccttgtaaaacttgagttctggaatgtaaagtgtactttgtaaaaaannaaaaaaaaaaaaaaaaaaaaaaaaaaaaaaaaaaaaaaaaaaaaaaaaaaacccantcaaaaaaaaacacactcccccaccaaaaaaataaaaaaacccccactggaaaaacctttgtaataaaaaaaaataagaggccttcgggggccccctttccccctaaatggggtgataaaaacgacgcccttgggggttgttttttaaaactgttggggggaaaaaacggcggttcccccaagtaaacccccttagaagaataccccttttgcccaattggggtaataaaaaaaaagccccccaaaatttccttttaaaaaatttttctttccttaaaggcaaaggaaatttgtaacccccttatttttgttaaaaacccgcgggaat

SEQ ID NO: 64053 - DNA, 805 bp, Zea mays
  misc_feature: Ceres CLONE 1532897
  misc_feature: Encodes the peptide sequence at SEQ ID NO. 64054
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (27)..(27): n is a, c, t, g, unknown, or other
nnnnnggttttcggnnngnattgtttncgtatttgtcttccccccttaacgttggagctccccgcggtggcggccgctctagatctagtggatcccccgggctgcaggaattcgtctcacccctagaaaaatcggggacgagggactgggagccaggatacttctgccgcgcggcgaccggtcgagcgaaatcgatctaccccaggtgcggcgggcgcggctttattctcaagattttttctgtgttctttagagagcagccatggacgagtggattcgccaaaccgaggtgtgggtgcaccaaaccgacagctggatccggcagcagcccccggagcagatctatgtagcggccgcggtggttgccgtcacaatcctgttgcttatcgtagcatcttgtctgaaatcgtctagaccaaacatcatagttctatcttgggcttagtggctagtgggcaaataccattatttactacccagccttccggatgggatcatcacattccaggaactgtttactttcatgggaaagaaaacagtggataccttttggggccgcctttcgggaccccacaaaaataaaagataatacgagcacgcttcgaaggtacccccatttccgcccctattgctgggggtcgtaattacggccccgcttccattggaccgtcggttttaaacaaccgccccgtacctggggaaacaccttggcgggttcacccaacttttactcgcgctttgatagaacatgcccctcttttcgcccccccctggctcttaaataaccgaaagaaggcccccccct

SEQ ID NO: 64054 - protein, 60 aa, Zea mays
  misc_feature: Ceres CLONE 1532897
MDEWIRQTEVWVHQTDSWIRQQPPEQIYVAAAVVAVTILLLIVASCLKSSRPNIIVLSWA

SEQ ID NO: 64055 - DNA, 649 bp, Zea mays
  misc_feature: Ceres CLONE 1532900
  misc_feature: Encodes the peptide sequence at SEQ ID NO. 64056
ggagctccccgcggtggcggccgctctagaactagtggatcccccgggctgcaggaattcgtctcacccctagaaaaaactcactcactcactcgctcacacagcaaatacccacagtccacagcaagaaccgaagatgttcggaaacatcggaaagatcccgatcatcggcgacctgacgggcagcaacaagaatgcgcacctcaagggcaacctggtgctcatgcgcaagaccgtgctcggcttcgacgtcaccagcatcgccggctccctcatggacggcctcggcgagttcctcggccgcggcgtcacctgccaactcgtcagctccaccgtcgtcgaccccaacaacgggaaccgcgggaaggtgggtcaggaggcgagcctggagcagtggctgctgcacccgccgccgctgctggccggcgaggaccagttccgcgtcaccttcgactgggaggtggagaagcacggcgtcccgggcgccatcatcgtgaagaacaaccacgcctccgagttcttcctcaagaccatcaccatcgacgacgtccccggccacggccccatcgtcttcgtcgccaactcatgggtgtacccgcagtacaagtaccgctacaaccgcgtcttcttctccaacgacacgtacctc

SEQ ID NO: 64056 - protein, 171 aa, Zea mays
  misc_feature: Ceres CLONE 1532900
  misc_feature (58)..(164): Pfam Name: PLAT Pfam Description: PLAT/LH2 domain
  misc_feature: SWISSPROT Homolog: EC 1.13.11.12 Lipoxygenase
MFGNIGKIPIIGDLTGSNKNAHLKGNLVLMRKTVLGFDVTSIAGSLMDGLGEFLGRGVTCQLVSSTVVDPNNGNRGKVGQEASLEQWLLHPPPLLAGEDQFRVTFDWEVEKHGVPGAIIVKNNHASEFFLKTITIDDVPGHGPIVFVANSWVYPQYKYRYNRVFFSNDTYL

SEQ ID NO: 64057 - DNA, 711 bp, Zea mays
  misc_feature: Ceres CLONE 1532902
  misc_feature: SWISSPROT Homolog: EC 3.2.1.23 Beta-galactosidase
  misc_feature (338)..(338): n is a, c, t, g, unknown, or other
  misc_feature (340)..(340): n is a, c, t, g, unknown, or other
  misc_feature (341)..(341): n is a, c, t, g, unknown, or other
  misc_feature (600)..(600): n is a, c, t, g, unknown, or other
  misc_feature (711)..(711): n is a, c, t, g, unknown, or other
tagctggagctccccgcggtggcggccgctctagaactagtggatcccccgggctgcaggaattcgtctcacccctagaaaagtgaaaagattaacgtgccttgtgttcttgtttcttctgcagttgggcagtcgtacgtggaaaacctggcttttggtgtaggaggaaggaatggaagtggtctgttgtacttaaagaaactagatgaagaagtcttgtataactgaaatttacctctcttgtgtgtgatgtattcaccttcgtcttgaaaattcttgagaacggtttcatcttgcaaaaaaaaaaaaaaaaaaaaaaaaaaaaaaaaagggaaaanannaaaaaaaaccgagacgctcgaggtacccaattcgccctatagggagtcgtattacgcgcgctcactggccgtcgttttacaacgtcgtgactgggaaaaccctggcgttacccaacttaatcgccttgcagcacatccccctttcgccagctggcgtaatagcgaaaaggcccgcaccgatcgcccttcccaacagtttgccccgcctgaatggcgaatggaaatttgtaagcgttaatattttgttaaatttcccgtnaaattttttgttaaatccgcctccttttttttaaccaataggcccaaaatccggcaaattccctttataaatcaaaaaaaaataaccccaaaatagggttttaagtgtttn

SEQ ID NO: 64058 - DNA, 642 bp, Zea mays
  misc_feature: Ceres CLONE 1532905
  misc_feature: Encodes the peptide sequence at SEQ ID NO. 64059
  misc_feature (249)..(249): n is a, c, t, g, unknown, or other
ccccgcggtggcggccgctctagaactagtggatcccccgggctgcaggaattcgtctcacccctagaaaaatccgcatttccatcctgtcgtgggatcccagccaccgccgctagaagaagagctcggcgattcccaggtcccgcgagaatatgccgaagcagatccatgagattaatgacttcctcctcaccgcgagcaggaaggatgcccgctcagtgaagattcggacgagtaaggatgttgtcnagttcaaggtgcgctgctccaagtacttgtacacgctctgcgtcttcgatgctgaaaaggcaaacaattgaagcaatctcttccccccggttttgacggttcaggaagtcctgaatgggaacctgggcaccccgaaattgaaactacccaagcctttttttttccggtgggcgaaagcgggcaaccccctgggcccttttgggaaccctacccctttttaaacccttcccccgttggaagcccccggggttttccttttttgggaagaaaccccttttccccccttcccggggggtaaaaaaaaaaaaaaaaaccggggccctcggggaccccctttttccccccttaagggggggggtataaaaccgcgcctccagggggcccgtttttttt

SEQ ID NO: 64059 - protein, 55 aa, Zea mays
  misc_feature: Ceres CLONE 1532905
  misc_feature (2)..(56): Pfam Name: Ribosomal_L38e Pfam Description: Ribosomal L38e protein family
  misc_feature (33)..(33): Xaa is any aa, unknown, or other
MPKQIHEINDFLLTASRKDARSVKIRTSKDVVXFKVRCSKYLYTLCVFDAEKANN

SEQ ID NO: 64060 - DNA, 645 bp, Zea mays
  misc_feature: Ceres CLONE 1532926
  misc_feature: SWISSPROT Homolog: EC 3.2.1.23 Beta-galactosidase
  misc_feature (531)..(531): n is a, c, t, g, unknown, or other
ctccccgcggtggcggccgctctagaactagtggatcccccgggctgcaggaattcgtctcacccctagaaaaaacgcagctgcgcggtgcacacaaagcgaactattctttcgccttttactaaagaataccgtgtgtgcgccgcaaatagcagcatacgctaatttttggagggatcctctattttagggggccccagtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatatttttgttaaaattcgcgttaaatttttgttaaatcagctcatttttttaaccaatagggcgaaatcggcaaaatcccttaaantcaaaagataaaccgagatagggttgagttgtgttcagtttggaacaagaatccctattaagaacgtggactccacctcaaagggcaaaaacgtcatacaagccgatgggccct

SEQ ID NO: 64061 - DNA, 653 bp, Zea mays
  misc_feature: Ceres CLONE 1532933
  misc_feature: Encodes the peptide sequence at SEQ ID NO. 64062
agctccccgcggtggcggccgctctagaactagtggatcccccgggctgcaggaattcgtctcacccctagaaaaaatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcag

SEQ ID NO: 64062 - protein, 122 aa, Zea mays
  misc_feature: Ceres CLONE 1532933
  misc_feature: SWISSPROT Homolog: EC 2.7.1.40 Pyruvate kinase
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQ

SEQ ID NO: 64063 - DNA, 639 bp, Zea mays
  misc_feature: Ceres CLONE 1532945
  misc_feature: Encodes the peptide sequence at SEQ ID NO. 64064
aagctggagctccccgcggtggcggccgctctagaactagtggatcccccgggctgcaggaattcgtctcacccctagaaaaaatactcccaactccaccgctggcaaaatcccccaatcctccgcactctgtaaccccgcccgcgatggaggccgcaaccgccgccacggcggcgatgatgtggttccggaagggcctgcgcgtgcacgacaacccggcgctggacgcggcccgccgacacggggtcggcgctgcatccgcgcggctgtacccggtgttcgtgctcgatccgcgctaccttcgcccggatcccgtcgcggcgtccccaggttccgcgcgcgccggggtcgcccgcatccgcttcctcctggagagcctcagcgacctcgacgctcgtctccgccgcctagggtcccgcctcctcctcctgcgtgcccgcgacgacgtcgccgacgctgtctgcgcggccctaaaggactggaacattggcaagctgtgcttcgagtccgataccgagccgtacgcgctggcccgcgataagaaggtcacggattttgcattggcgtcgggcatcgaggtgctcacgcccgtcagccacaccctcttcgacccagaagaaattataagaagaacggtgg

SEQ ID NO: 64064 - protein, 164 aa, Zea mays
  misc_feature: Ceres CLONE 1532945
  misc_feature (8)..(163): Pfam Name: DNA_photolyase Pfam Description: DNA photolyase
MEAATAATAAMMWFRKGLRVHDNPALDAARRHGVGAASARLYPVFVLDPRYLRPDPVAASPGSARAGVARIRFLLESLSDLDARLRRLGSRLLLLRARDDVADAVCAALKDWNIGKLCFESDTEPYALARDKKVTDFALASGIEVLTPVSHTLFDPEEIIRRTV

SEQ ID NO: 64065 - DNA, 638 bp, Zea mays
  misc_feature: Ceres CLONE 1532964
  misc_feature: Encodes the peptide sequence at SEQ ID NO. 64066
ggagctccccgcggtggcggccgctctagaactagtggatcccccgggctgcaggaattcgtctcacccctagaaaaaagtgcagcgcacaacgcaccgttcccggaactcacgatccctccgtctcgtctcgcagcaacctcatcctatccgtttcaccctcatccccatttaatatataccgttccgccgttcgtcccctccggccctctctccatccccgacccacgaccctccgccaccggccatcgcctgcatcagatctcccgcccgtccgttacatctcagcgcgacgcggccgcggccatgacgccatcctccgctctcgccctcgcgcaccacgccgcggcatccccgctcccgtcctccacgccgcggccctcccccaggtccagctctctgagcctgggcccgggctccgccgggctcgggccgcgccggctcgtcgcggcagcgcccccacgggcgttcttctcctcgtccccctaccagccgccccagccggaagggttctcgcagcaccgcgagtacggcctggtccccatggtcatcgagaccacctcccggggggagcgcgcctacgacatcttctcgcgcctgcttaaggagcgcatcgtctgcatccacggggccatcgc

SEQ ID NO: 64066 - protein, 110 aa, Zea mays
  misc_feature: Ceres CLONE 1532964
  misc_feature: SWISSPROT Homolog: EC 3.4.21.92 Endopeptidase Clp
MTPSSALALAHHAAASPLPSSTPRPSPRSSSLSLGPGSAGLGPRRLVAAAPPRAFFSSSPYQPPQPEGFSQHREYGLVPMVIETTSRGERAYDIFSRLLKERIVCIHGAI

SEQ ID NO: 64067 - DNA, 646 bp, Zea mays
  misc_feature: Ceres CLONE 1532965
  misc_feature (575)..(575): n is a, c, t, g, unknown, or other
  misc_feature (646)..(646): n is a, c, t, g, unknown, or other
tcaccacggtggcggccgctctagaactagtggatcccccgggctgcaggaattcgtctcacccctagaaaatctcatttaggaacaaacattcgcattcgcattcacattgttatcagttaaaaagtctatggaacggtaagcatgttaattagtcagtctgacgctgctgggtgacaggttggtaattaggctctgcatttagctgttttgtatggctgctgtcgccgccatacatgtatcatcttcttgtggttgtatggtacctaaccgcgtaaacatgtgaaccttaggccatgtattaattactccgctctaatgtttgtatgtgtattgtcaaacttgcagaaccttttgcctccatgaaaaaggagggaggtctgggtatctatgggtgcggggtacccatctccgcaccagcgcacccagccagaaacagcagtttgtttggatctcaaaaaaaaaaaaaaaacgagacgctccaggtaccccaattcgccctatagggaagccgtattacgcgcgcctcctgggccgtcgtttttacaacgccgtgactggggaaaaaccctggngtctccccaacttaatccccttgcagcaacatcccccttttccccgcgtggcggaaaaaccgaaaaaggcn

SEQ ID NO: 64068 - DNA, 407 bp, Zea mays
  misc_feature: Ceres CLONE 1532967
  misc_feature (285)..(285): n is a, c, t, g, unknown, or other
  misc_feature (290)..(290): n is a, c, t, g, unknown, or other
  misc_feature (291)..(291): n is a, c, t, g, unknown, or other
gctggagctccccgcggtggcggccgctctagaactagtggatcccccgggctgcaggattcgtctcacccctagaaaaatccttcaccctgctccgcctcgtctcgtatgacatacgcgcaccgtacgtaccagggtgagacgaggtgaggggtcggggttcgtgtggcgaacggcgtgttgagccacgcgcgcgtgcgcccgcgctctgtgacgcccgggacgttcttgggagagcgcgagcgaagttcttgtctcttctccgggccgggtcccttggccccnttttnnttatgattgaccctggtctttggccacccggaaaaaggccctgggcccccccccgtgggggggggggccggtttttgggccccccaaaaaaaaaaaccccccccgagggagggttt

SEQ ID NO: 64069 - DNA, 793 bp, Zea mays
  misc_feature: Ceres CLONE 1532975
  misc_feature: Encodes the peptide sequence at SEQ ID NO. 64070
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (43)..(43): n is a, c, t, g, unknown, or other
  misc_feature (44)..(44): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (705)..(705): n is a, c, t, g, unknown, or other
  misc_feature (723)..(723): n is a, c, t, g, unknown, or other
  misc_feature (724)..(724): n is a, c, t, g, unknown, or other
  misc_feature (730)..(730): n is a, c, t, g, unknown, or other
  misc_feature (733)..(733): n is a, c, t, g, unknown, or other
  misc_feature (754)..(754): n is a, c, t, g, unknown, or other
  misc_feature (758)..(758): n is a, c, t, g, unknown, or other
  misc_feature (763)..(763): n is a, c, t, g, unknown, or other
  misc_feature (786)..(786): n is a, c, t, g, unknown, or other
nnttttccccnccttnntttattgacctagcctaagctggctnnccctaaaacaaacacctggagctccccgcggtggcggccgctctagaactagtggatcccccgggctgcaggagttcgtctcacccctagaaaaagaaaaaaaaaacgcgcacaccaaacgcgcacgcggcgttcgttcctcggccgctctccctacccacgtccttctccccccacagatctccgcgggccgtgaggttccttgattcgccttctccggggctgccggatctccgcggcggctggggatgggcaactgctgcgtaacaccgaacggagccgccgacgccgggggcggccagaagcccagggagccgagagcgaaggaagggcaagaaagccgaacccgcttctctgatggggtacagccgcttcggcgctcgttcagctcccccgaggggtgggggggggctgccggagccctcggggcgcggtcacattgctggagctcgtcgcaggcttgccggccggaggcccgggccggcggcgcagtttgcgggggtcgcccacatcttgttggtgacaagccgcctgccttaagtggttattagtgcttaccaggcggccgttcccggatcgcgttagttggaaagatcttttgaaattatttnnnnnnnnnnnnnnnnnnnnccctnnnnnnannnnnnacaaaaaacacatntcccgacatgaggcgggnncacaanttnttatgctgcccatacaggtgnaatnggggnatggggggagttcaaggtttcgnggagtgt

SEQ ID NO: 64070 - protein, 100 aa, Zea mays
  misc_feature: Ceres CLONE 1532975
MGNCCVTPNGAADAGGGQKPREPRAKEGQESRTRFSDGVQPLRRSFSSPEGWGGAAGALGARSHCWSSSQACRPEARAGGAVCGGRPHLVGDKPPALSGY

SEQ ID NO: 64071 - DNA, 635 bp, Zea mays
  misc_feature: Ceres CLONE 1532978
  misc_feature: Encodes the peptide sequence at SEQ ID NO. 64072
agctccccgcggtggcggccgctctagaactagtggatcccccgggctgcaggaattcgtctcacccctagaaaatagaaaaaagctacggcacggccacggcgccacacactcggtgggtggcgtctgctcgtgctcgaatacgcggcggcagcgaggacgtcggaacttgcagccatggacgcggcggcgacggccgtgtcgtcgagcggcgacgctcccgttctcctccttgccctcgccgtctccctgctcctcctcgcggcggccgtctggtcctcgaggcggcgtggtcaggggcacggcaacggcaacggcgcgccgagcccgccgtcgcggccgctgctgggccacctgcacctgctcggcaagccgctgcaccgctcgctggcggcgctggctgccgcgcacggcgcggggggccagctggcgccgctcctgtccctgcggctgggcgcccggcgggcgcttgtggtgtccgaacccagcgtgcccgatgagtgctccaccgcgcacgaacccccgctggctggccggccgcgggtgctggcccggcaaccggctccgggtaccggtaccccgatcctgggtgtgggcgtcccacgggggacacctgggcccccgctccgccgggt

SEQ ID NO: 64072 - protein, 152 aa, Zea mays
  misc_feature: Ceres CLONE 1532978
MDAAATAVSSSGDAPVLLLALAVSLLLLAAAVWSSRRRGQGHGNGNGAPSPPSRPLLGHLHLLGKPLHRSLAALAAAHGAGGQLAPLLSLRLGARRALVVSEPSVPDECSTAHEPPLAGRPRVLARQPAPGTGTPILGVGVPRGTPGPPLRR

SEQ ID NO: 64073 - DNA, 565 bp, Zea mays
  misc_feature: Ceres CLONE 1532984
  misc_feature: Encodes the peptide sequence at SEQ ID NO. 64074
  misc_feature (565)..(565): n is a, c, t, g, unknown, or other
tggagctccccgcggtggcggccgctctagaactagtggatcccccgggctgcaggaattcgtctcacccctagaaaaaatctagctctcccgtttctgctcgcaagtcacacacacagctccggtagatccggccctcgcctctggctccatgaagagattagcttcagacggcagggatcgatactagcaagcaagcaagcatggcgcacgacttgtgcgaggacttggagctcgtcgccgacgacggcggcggcttcgatgactactactgggacgacgacttccatttccacgacgacggcttctccgcctcccctacgacccccggcagcggtggtgcgccccgccagcagcagcagatgggtgatatttcagcctcggactacaaagaaggcgaagacatgcagggggataccctggggaaagactcaactacacccagggaccagtatcgtcggatgaagctcaaagagtacaagagctaccagaacctcacgaggtcgcacagcggggctacaacaacaggaatgcaaacaagtgggagagaaaagacacattcctn

SEQ ID NO: 64074 - protein, 120 aa, Zea mays
  misc_feature: Ceres CLONE 1532984
MAHDLCEDLELVADDGGGFDDYYWDDDFHFHDDGFSASPTTPGSGGAPRQQQQMGDISASDYKEGEDMQGDTLGKDSTTPRDQYRRMKLKEYKSYQNLTRSHSGATTTGMQTSGREKTHS

SEQ ID NO: 64075 - DNA, 625 bp, Zea mays
  misc_feature: Ceres CLONE 1532992
  misc_feature: Encodes the peptide sequence at SEQ ID NO. 64076
ggcggccgctctagaactagtggatcccccgggctgcaggaattcgtctcacccctagaaaaaaccaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtgtcggccgactatgagggcaaaggagacacgacgaagctgggcgagctcggcgccaagctcacggggctggccccccgcgacgccatcctcgtggcgagcttcatcctgcacatgctcaacctcgccaacctggccgaagaggggcaaatcgcgcaccgccgccgcaacagcaagctcaaagaaagtggggtccgccgaacaagggctccccccccccccgaatcccgaactccaaggagacccctcaagcgccctcgtggcccaagggccggcaaagtcc

SEQ ID NO: 64076 - protein, 160 aa, Zea mays
  misc_feature: Ceres CLONE 1532992
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPRDAILVASFILHMLNLANLAEEGQIAHRRRNSKLKESGVRRTRAPPPPESRTPRRPLKRPRGPRAGKV

SEQ ID NO: 64077 - DNA, 648 bp, Zea mays
  misc_feature: Ceres CLONE 1532997
  misc_feature: Encodes the peptide sequence at SEQ ID NO. 64078
  misc_feature (618)..(618): n is a, c, t, g, unknown, or other
  misc_feature (640)..(640): n is a, c, t, g, unknown, or other
ggagctccccgcggtggcggccgctctagaactagtggatcccccgggctgcaggaattcgtctcacccctagaaaaagtctccttcctccacccactgcaaatgcaaaaaccctagccgcaactccctccgcctccacggttctcatccgcgacctatctctatctctccaaggcatcggccacgggctcgaaggtgatggcgggcggcggaaagaaggagaagggtgaggggctcgggcgcgcgctgatccggcagcggaacaaggcggccgcggccgctaaggaacggggcgaggcgctcgcctttggccgccgccgcgcgatgccgctcgagtctgtcattgacgtcagtgacatcgatgccgtgctccagcgggccgcagaggccgaccagctcgctgaggccgcgtccgtctcttccgactccgacctcgtcatcgacctggatgcgacgggggagacggaagacgacaggcggcggcttcgcaaggagcaggaggccctgcacgccagcagcctcagggtccccaggcgaccgccatggcatagtcagatgactgtggaggagcttgatgtgaacgagcgtcgggccttttctggtgtggcgcaggaatcnttgcagattggaagagatgatnagcttatc

SEQ ID NO: 64078 - protein, 150 aa, Zea mays
  misc_feature: Ceres CLONE 1532997
  misc_feature (148)..(148): Xaa is any aa, unknown, or other
MAGGGKKEKGEGLGRALIRQRNKAAAAAKERGEALAFGRRRAMPLESVIDVSDIDAVLQRAAEADQLAEAASVSSDSDLVIDLDATGETEDDRRRLRKEQEALHASSLRVPRRPPWHSQMTVEELDVNERRAFSGVAQESLQIGRDDXLI

SEQ ID NO: 64079 - DNA, 650 bp, Zea mays
  misc_feature: Ceres CLONE 1532998
ggagctccccgcggtggcggccgctctagaactagtggatcccccgggctgcaggaattcgtctcacccctagaaaaagcctgcctctccggactcccactcttcaagccacctaccttcctacacccaaataggagtacctacctgcgcagagcccacgacggctcggactccggcgtgtcgacaccgctcctgccggagcatcgaggctacattaccaagtagtaggaaaccatgggccctgcgccgagggagcccatgaagcatcgcgtgaaccgctgcctgctgcgcctctcggaccgggacacgtaggcgatggccgcgtcggagctgaactctatctctcgcgagctggactccgactagctgcccatgtgcgtggccggggtatccaactcgcgaccaacgacaggtcaccgctgccgaggctctcaatgcaggtgatggttgctcatccccggagagaaacggatgacttcttgtcccaaagtaagacccggatactggtcaggcggcctggttttctgatccaaacaggaccctggcactgaggaagaaaatctctccctggacagttcctcagaaagttacttttgcatggggggacctttttcctttcccggtttccgttgcaccaaatcccccttttc

SEQ ID NO: 64080 - DNA, 611 bp, Zea mays
  misc_feature: Ceres CLONE 1533000
  misc_feature: Encodes the peptide sequence at SEQ ID NO. 64081
agtggatcccccgggctgcaggaattcgtctcacccctagaaaaaaagcgcaccgcccgccgtcgaaggcgaagacctagttcccggtccgtcgcgatggctgccgtggcccgccgcggccccggggcgcgcctcctcgcggcgctcctcctgctggcgctggtcgtctccgggcactgcctggacgcgcaccaccgcgggctgaagcgccggcggcggaagcacgagatccattccccggtcaagactgtggtggtggtggtgatggagaaccgcagcttctaccacatcctcggctggctccgccgcacccgccccgacatcgacggcctcacgggccgcgagtcgaagcgcctcaacgcctccgaccccgcatctccggagatcttcgtcaccgacgaggccggctacgtagactccgaccccggccacggcttcgaggacatccaggagcagatcttcggctccgccgacacctccgcggtgccgcccccaatgtccggattcgcccacaacgcgcgcgggatgggcctcggcatgccacataacgtcatgagcagcttcaagcccgacgccgtcgcatctacgcctgactcgcgactacttcaccg

SEQ ID NO: 64081 - protein, 171 aa, Zea mays
  misc_feature: Ceres CLONE 1533000
MAAVARRGPGARLLAALLLLALVVSGHCLDAHHRGLKRRRRKHEIHSPVKTVVVVVMENRSFYHILGWLRRTRPDIDGLTGRESKRLNASDPASPEIFVTDEAGYVDSDPGHGFEDIQEQIFGSADTSAVPPPMSGFAHNARGMGLGMPHNVMSSFKPDAVASTPDSRLLH

SEQ ID NO: 64082 - DNA, 627 bp, Zea mays
  misc_feature: Ceres CLONE 1533003
ctggagctccccgcggtggcggccgctctagaactagtggatcccccgggctgcaggaattcgtctcacccctagaaaaagagctcatggtgttggtgaggccaagcaacacccacgggggctggggcaacaattagttgcttcgccctccgcatgatgcttgttactgacatatttaccctcacgcgaagaacccctaccttggctaatcctcctacgtatacgtctcttctcttcgcttaatcttggtcggtgatttgattctgctcttcttgggcgcattgcacagggtgctcggtctgcagctatcttacgtttaccagtcgtgtgtggtctatcggtttcgatatagtactactgctctgttataatctgcggggaggaggaagatgacggtgacgcctcggatcacggtgagcgacaggctgctgacggtgcgcggccgtacggtgctcaccggcgtgccggacaacgtgtcgtcggcgcccacgtcttcaccttcggcactctccgggactgccggttcctgtgcctgttccagttcatgctgtggtggatgactcagcggatgggcgtctccggccgcgacgtccctctggagacccatttcatgctcgtcaatgtcct

SEQ ID NO: 64083 - DNA, 672 bp, Zea mays
  misc_feature: Ceres CLONE 1533006
  misc_feature (400)..(400): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
aaatttggagctccccgcggtggcggccgctcctagaactagtggatcccccgggctgcaggaattcgtctcacccctagaaaaaacaacgcctcctccagtccttcttcgtaagccttcaaaccgacgaatttgagcaactgcacccagagcgcgatccattgccggggaagaagctacttgttgcgagcctcctctatggcgagctccgaccatggttccaccaccgcccccaggacgtgccgggcagctacggcctgccgctggtgggcgccgtgcgcgaccgcctcgacttctactactgccaggggcagggacagtacttccagtccccgcgtggagcgctccggctccaccgttgttttttttccccccccccgggggggggggggggggggcnctaacccnnnntttttttccgtcccctgaaccccaaaaattccccctggcccctcgaagggggggagggggaaaaaaaaaggaccggttcccggggcccttaatgggggtccccctcccctaccggggggggtacccggtctcgtcgtcccgggggcccccccgagcccccccgcccccatggggaaacgggctcgccttttccccccccgggcacccccgcagggggccatcgtgttccccccctttcccgccacaaaatgtccacccgcc

SEQ ID NO: 64084 - DNA, 652 bp, Zea mays
  misc_feature: Ceres CLONE 1533008
  misc_feature: Encodes the peptide sequence at SEQ ID NO. 64085
tccccgcggtggcggccgctctagaactagtggatcccccgggctgcaggaattcgtctcacccctagaaaaagttcagagtcacgtcgggagcggtgacatatgttgggtgactggctgactgccgcgcgaaaagagagggagagagagctagcgtggactgaacggagggcgcaacaaggacgagcacccgctcgcgcggggatggccacagcgagagccgttgccacaacggccgcggcgctggcggccgtgatgatggtggcgctcctggccccggccgtacctggggtcaaccgcacccagttcccgccagggttcctcttccgagccgcgacgtcagcgtacgagattgaatgcacgtacctggaggacggctaggatctctacaactgggatgtgttcacgcacacactcagtgcatgggtgatggaccgacgcactgaagacgtacccaacgaccactacgatcactacgtgcgaaatctggagatcctgcagacgctggcagtcaacacctacagattctccatctcatgggcgagggttctaccaagaagcctggtttggtggcgtcaatgcacgcaggtgtacctatctacaccagcctgatcgatgcgctcctgcagaaaagaatacacccattcgccac

SEQ ID NO: 64085 - protein, 92 aa, Zea mays
  misc_feature: Ceres CLONE 1533008
MLGDWLTAARKERERELAWTERRAQQGRAPARAGMATARAVATTAAALAAVMMVALLAPAVPGVNRTQFPPGFLFRAATSAYEIECTYLEDG

SEQ ID NO: 64086 - DNA, 642 bp, Zea mays
  misc_feature: Ceres CLONE 1533011
  misc_feature: Encodes the peptide sequence at SEQ ID NO. 64087
  misc_feature (561)..(561): n is a, c, t, g, unknown, or other
ctccccgcggtggcggccgctctagaactagtggatcccccgggctgcaggaattcgtctcacccctagaaaaaaggagcatctgcatctctggcccacctccgctccgcctactgctgctggtggtagggaggcggagaaggaggcccttgcgcccgcccgccggccggatcagagccgtagcaaccaccacccatgggggacgtgcacgaacctttggtgcgccgtaagatgaagaaggttttggtggactacttggtgaagttccgatggatcctcgtgatcttcgtggtccttcctatttcaactctgatctacttctacatcttcctgggcgacatgtggtccgccctgaagtcggagaagaagcgccggatgcagcacgactagaacgtgcacaacgtcgtgaagcggctcacgcacaggaacccgaacaacgacggtcttgtttgcacggccaggaagccctgcatcgctgttgacatgcgcaacgtgcactacaatcgtgcgatgcatttcgaggtcgacctttcttccttcaggaacatccttgagatcganaagagaggatggttgccaaggtcgagccccttgctcacatgggtcagataccagagctacctgcccaatgaaccttgccct

SEQ ID NO: 64087 - protein, 64 aa, Zea mays
  misc_feature: Ceres CLONE 1533011
MGDVHEPLVRRKMKKVLVDYLVKFRWILVIFVVLPISTLIYFYIFLGDMWSALKSEKKRRMQHD

SEQ ID NO: 64088 - DNA, 631 bp, Zea mays
  misc_feature: Ceres CLONE 1533012
  misc_feature: Translation starting site: 171
  misc_feature: SWISSPROT Homolog: EC 3.2.1.39 Glucan endo-1,3-beta-D-glucosidase
ccgcggtggcggccgctctagaactagtggatcccccgggctgcaggaattcgtctcacccctagaaaaaagcccacacttggcctggtcgcgttctgctgaagctcgacccgttccgcctaatcttctccaatccctttcttctggggtctgacggggtgacgaatcccatgggcgccgcggcgatgaagcccgcctccgctggggtgttgcctatctggctctgcctcgtctgctcttctagtacgcacccgtacatcggcgtcaactactgcgaggtggcggacaacctgccgtcggcggacgagacagctaggctgctcaagtcgacgtccatctccagcgtgcgactgtacagagtgtacgcggggctgatcctcgcgctggcgaaggccagcatctccgtggtggtgggctgtggcaaacggcgacatcccctcgctggccgcagtacccagcagccgcgtcccggtggctggccgccaacgtgatgcccttcgtgcaggagaacaccatctccgccgtggccgtcagcaactaggtgctggagtccagggacaccaccctgtgcgccgcgctgctcccgaccatgcagaacctccgagcctcgccactgcgacggggggcctcg

SEQ ID NO: 64089 - DNA, 636 bp, Zea mays
  misc_feature: Ceres CLONE 1533014
  misc_feature: Encodes the peptide sequence at SEQ ID NO. 64090
ctccccgcggtggcggccgctctagaactagtggatcccccgggctgcaggaattcgtctcacccctagaaaaaactgctgcggcagtaatggccgcctggttccacttccaccacggtgtgcactagcgctacaccgaggccaccttttcttggttccttcaacacgcctactccggcctccggatcgggcaccacgtctgccccctgctcccggaatctttgccaagcggcgccgctactgtccggcaaggcgaccccgtctctcggacggcgttgatctggcgggcggagtggcggcgcgatgggcatctcggcgaggtggctcaagtcgttagttgggttgaggaaggtggggcggcagcagcagcagcggcgaaaggatgatgcagatgttggtcgaatgaaaaccgatgtcgccgaccagtttcattttcagattcagcactctcaagatgacaatagcattgctgcacaagagattccagaggtttcttatggaaatgatccacctgaagatgattctaatgtaccttcatgcttcgagcctgctcgtagttcagctcatatgccattttgtcaaactgtagaagcccagatagagatctgggctgctacaattattcagacagcattt

SEQ ID NO: 64090 - protein, 111 aa, Zea mays
  misc_feature: Ceres CLONE 1533014
MGISARWLKSLVGLRKVGRQQQQRRKDDADVGRMKTDVADQFHFQIQHSQDDNSIAAQEIPEVSYGNDPPEDDSNVPSCFEPARSSAHMPFCQTVEAQIEIWAATIIQTAF

SEQ ID NO: 64091 - DNA, 673 bp, Zea mays
  misc_feature: Ceres CLONE 1533018
  misc_feature (371)..(371): n is a, c, t, g, unknown, or other
agctccccgcggtggcggccgctctagaactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgcccgcgccatgatgaacctgaacctgaagcagcctctggtgctgcccgcgcaccacagcaatgtcgtcggctcgcgcctgtcgtcgccgtcgccctccgcnggccgccgccagcaggaagaccgggcggcggcttgtcctcccggtccggcttccccggcggcccgtgcggctgccgaagaatcactgcaccgcccccgaagaaggcagcggcgcccggtcgtccctccccccgggaaaggaatgctaacggtgaccgcctccgggggaaggcttccccggcccttcggggaaaattgtcttctcagcggcgccgtcaaacaaacccgggcgaacttattccggacaaaaacctccttgctgggaaccccgtcaacctcccaaactccaacccaaaaaacggg

SEQ ID NO: 64092 - DNA, 645 bp, Zea mays
  misc_feature: Ceres CLONE 1533033
  misc_feature (206)..(206): n is a, c, t, g, unknown, or other
  misc_feature (208)..(208): n is a, c, t, g, unknown, or other
ctccccgcggtggcggccgctctagaactagtggatcccccgggctgcaggaattcgtctcacccctagaaaaaggctagttggcgattgcaacctgcttgtggattactacccccattttgttgttgatgttgatgtaatctgtttattaagacccagcattcccctacagcttattttgttgtacttactatatatctttaagntnagggtgccgaaatctcagttcacccgctattggaggtgaatttgccgtgtaatctttggatcaagtaaatggtttaatgccaaaaaaaaaaaaaaaacgagacgctcgaggtacccaaatttcccccctataagtggagtcgtattacgcgcgcctcacttggccgttctttttacaaaggtgggtggcgggggaaaaacccttggggttttccccaaatttaattccctttggaaaaaattcccccttttcgccgcgggggtaaaaaagcaaaaaaggccccccaccccattcccccctttcccaaacttttcccccccccctgaatggggaaaagggaaatttttaaacccttttaatttttttgtaaaaaaatccccccttaaaaatttttgtgttaaaaaaccgggcctcttttttttttaaaacagaaggag

SEQ ID NO: 64093 - DNA, 674 bp, Zea mays
  misc_feature: Ceres CLONE 1533043
  misc_feature: Encodes the peptide sequence at SEQ ID NO. 64094
tccccgcggtggcggccgctctagaactagtggatcccccgggctgcaggaattcgtctcacccctagaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatatgcctcctcctcaccttcctcggctacatccccggcatcatctacgccatctacgccatcaccaagaacaactagctagtcatccttgccgacgaccgatccatgtctctgtgtctgcgtctgttcatatgcctgatgccgacttgcgctgtatgtagttgcttgaattcaggcaggttttgctaccgtacccaccccatgcatcatctgtcaccgcgacccattaatcatagtgattaccaggtccgagatggattcaaaaaaaaaataaaaaacgagaccctcggagtacccaaatcccccctaaagtgattcgtattacgcgcggcccctgggccgtcgttttccaccccctggacgggaaaccccctgggggtttcccgggctaaacggcccttgagccatttccc

SEQ ID NO: 64094 - protein, 58 aa, Zea mays; identical to SEQ ID NO: 46528
  misc_feature: Ceres CLONE 1533043
  misc_feature (6)..(56): Pfam Name: UPF0057 Pfam Description: Uncharacterized protein family UPF0057

SEQ ID NO: 64095 - DNA, 645 bp, Zea mays
  misc_feature: Ceres CLONE 1533044
  misc_feature: Encodes the peptide sequence at SEQ ID NO. 64096
ctccccgcggtggcggccgctctagaactagtggatcccccgggctgcaggaattcgtctcacccctagaaaaaagccaccgaaatcttccgtctccaaatcctcctagcgaattcaccacagcttctcaccaccgctaccttcgatggcacccaaggcggacaagaagccggcggcgaagaagcctgcagaggagcccgcgacagagaaggcggagaaggctccggcggggaagaagcccaaggccgagaagcgcctcccggcgggcaactccgccggtaaggagggcggcgagggcaagaaggggaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaaga

SEQ ID NO: 64096 - protein, 132 aa, Zea mays
  misc_feature: Ceres CLONE 1533044
  misc_feature: SWISSPROT Homolog: EC 3.2.1.23 Beta-galactosidase
MAPKADKKPAAKKPAEEPATEKAEKAPAGKKPKAEKRLPAGNSAGKEGGEGKKGKKKKKNETLEVPNSPYSESYYARSLAVVLQRRDWENPGVTQLNRLAAHPPFASWRNSEEARTDRPSQQLRSLNGEWKL

SEQ ID NO: 64097 - DNA, 647 bp, Zea mays
  misc_feature: Ceres CLONE 1533047
  misc_feature: SWISSPROT Homolog: EC 3.2.1.23 Beta-galactosidase
  misc_feature (567)..(567): n is a, c, t, g, unknown, or other
  misc_feature (647)..(647): n is a, c, t, g, unknown, or other
ctccccgcggtggcggccgctctagaactagtggatcccccgggctgcaggaattcgtctcacccctagaaaaagaatgaccttttgcgttcgtcgtctccccaaaaggacctcccaagacctggcatctccagcgaatgcgatgccgggaaccaccggtcgtgcgtcctctctcctcgtgcgcttcgcccgtctccacagttggtgcaggttcaaacatggacctctgcgcatcaaagaaaagccggacaccagatcttccaagaactaaagattttctcagattatcagcagcgttttaggttgtagaatcctctctgtgtaattatatataactgctcaactcttctgaaaacattttatgtaaatataacaaggtagcttcaaatattgcaacaaacatattaccttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgncagctggcgtaatagcgaagaagcccgcaccgatcggctttcccaacagttgcgcagcctgaaatggcaaatgaaattgn

SEQ ID NO: 64098 - DNA, 641 bp, Zea mays
  misc_feature: Ceres CLONE 1533049
  misc_feature: Translation starting site: 186
  misc_feature: SWISSPROT Homolog: EC 3.2.1.23 Beta-galactosidase
ctccccgcggtggcggccgctctagaactagtggatcccccgggctgcaggaattcgtctcacccctagaaaaaaaaaccagcactactcatccgtcgccccacggaagtttcggcggcgccggcgtgctcgtgatctcgaccaaggcgtgcctccgctccggtcacccgtcgctccacgcaaccatggtaagcgagcctcttctcgtctggttatggctcgcaagcggacgtaggtgcaagcacggtagcggtggattcggatctggctgcaagcacggtagcgctggattcgattgtttttttgtttagagatgggttaagagcgtaggtttggctgttgactagggctactgttgttttggctggttgcccgtgctggattgcatctgataaattgcaatttgacatcacctctttaatacaaaagaaagaattgctttttaaaaaaaaaaaaaaaacgagacgctcgaggtacccaattcgccctatagtgagtcgtattacgcgcgctcactgggccgtcgttttacaacgtcgtgactgggaaaaccctggcgttacccaactttaatcgcttgcagcacatcccccttttcgccagctggcgtaatagcgaagaagccccgcaccgatcgccct

SEQ ID NO: 64099 - DNA, 649 bp, Zea mays
  misc_feature: Ceres CLONE 1533050
agctccccgcggtggcggccgctctagaactagtggatcccccgggctgcaggaattcgtctcacccctagaaaaactctcctcacctgtggagctccccacagcccgtaactacctgcccccagtccccgccgccccgccccgccccgccccgcctgaccccagtccccgcggtttatccaccacgacaccaccacctctccaccgctgggccggatcgatcgggatcgcgccgccgccgccgccgccctccgcactcgcgggatcctgctcctaccatgcagcagcgctgcgcccttgcccgaccgcgccggcccgccgaaccgcgcgtcccgctccccgacgaccaccccttcgttgccgtcttctccttccttttcatccccacctaaaccaacctcctcgcagcgtaattctgccagtatctcctcatcttctctcgtcgccgggagagcgaacggatcgccgcgtgctcggccgacgggatgagccgggaggcgcagaaactcgattgcgccgccggcggcggcggcgtcgggataggggtcttgtcgctggacctgctgggccaggtgctggaccgcctacgggagccgcgggaccgcaaggcgtgccgcctcgtcagccgcgccttcgagcgctccgaggc

SEQ ID NO: 64100 - DNA, 685 bp, Zea mays
  misc_feature: Ceres CLONE 1533060
  misc_feature: Encodes the peptide sequence at SEQ ID NO. 64101
gcggtggcggccgctctagaactagtggatcccccgggctgcaggaattcgtctcacccctagaaaacacctgtttaattctgtactgcatgcgtgtgtaatttgatggttcacaataatgagtccctctccggaccttggtagctgcttgcttgtggtgagtgagagtgtgagactgagggagaagaggtggtgtgggcgtggggctacgtcgagagaggcgtgttcctgtactcgcttcgttttctctgcatgcgtgtataattgtgttcaataataagtgagagcggtgtgatgtgtggctccccttgtcaggctcatgtgtatccgtattgaatcctggcaccatgactgactgaggatctggatgtctatgaagcaccgtgtatctatcatcaccccccgcaaaaaaaaaaaaaaaaaacgagacgctcgaggtacccaattcgccctatagtgagtcgtatttacgcgcgctcactggccgtctttttacaacgtcgtgactggggaaacccctggcggttcccaactttaatcggcctttggagcacatcccccttttcgccagcttggctaaatagccgaaaaaggccccccaccgattccgccttttcccaaacagtttgcgccagcccctgaatggggcaaaatgggaaatttgtaaagccgtttaatatttttg

SEQ ID NO: 64101 - protein, 32 aa, Zea mays
  misc_feature: Ceres CLONE 1533060
GGGRSRTSGSPGLQEFVSPLENTCLILYCMRV

SEQ ID NO: 64102 - DNA, 671 bp, Zea mays
  misc_feature: Ceres CLONE 1533062
gggggtttgtgcgggcccccctacgaaaaaacaacgagggttggttttccccccttcatagccgccctatttatctcagccggtgccgacgcactttcctacaggatcccccgggctgcaggaatgcgtctccccctagaaaaagctgggtattaatcgattcggatcgccgaacttctcggatatgaagactagatcttcgaccctcatcgtagataacaagtgaaaactaaaagctgataaaatgaacctagtgtaagacaagtgaattggcctcctagaattttagggccaaaattccttagaatttccaaggaaaaaaggggcccctttaaaaccccggggggaaaggtttaaaaaaggttttttttggggcccccttaaagggggggttcccccccccttcaaacctaattattttaaaaagcccccttttttttttccccgggccccaaaaaaaaaaaaaaacgcctggggggtccccccttttttttcggaaaaaaaaaattttttttgtgtaatcacaaaaaaaacccccttttttttttccccccccccttttttgggaactattttccccccccccccccaaacaatcaaaaaaactctcccgcgggggtgcgcgtgttataccacctcccccctttctttgtttagagaaagaaaacttc

SEQ ID NO: 64103 - DNA, 722 bp, Zea mays
  misc_feature: Ceres CLONE 1533064
  misc_feature (1)..(1): n is a, c, t, g, unknown, or other
  misc_feature (2)..(2): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (291)..(291): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (299)..(299): n is a, c, t, g, unknown, or other
  misc_feature (300)..(300): n is a, c, t, g, unknown, or other
  misc_feature (440)..(440): n is a, c, t, g, unknown, or other
  misc_feature (445)..(445): n is a, c, t, g, unknown, or other
  misc_feature (446)..(446): n is a, c, t, g, unknown, or other
nngggctcgcagcgtcaacaagtggcagnannngnntngtggatcccccgggctgcaggaattcgtctcacccctagaaaaaaaaaaagtcttgtgcatggaggctgctgtttgttctctgtatcgtaggtgtctacgtttgcgaggaaattgtatccggtgtttctctttcttcaaattaaacacgcacatgcagctgccgtnnnnnnnnnnnnnnnnnnnnnnnnnnnnnnnnnnnnnnnnnnnnnnnnnnnnnnnnnnnnnnnnnnnnnnnnnnnnnnnnttttcccnttnnnngnngggggggggggggttttgtttttttttttgggcgcgtttttccaccccccggacccttttattttccccccccccccggggagggggggctctcccatattcccccctttccccccctcttgtttaaaaaaaaaaaaaanccaanncaaatttttctttgccaaagattgttaaaggtttattggggaaatggatactttcaccttccccatttttcgtatacttcgccctcccctttttgctttaatccccccccttgccccttcccaaagatcccaaaacccgctaaaccccttgtaatactccaatgtaagtcccctctttctgctttcttccccccccccatcctcctaaaaactccttattttctcccacattcgcgttccccccgttttacgcctgaccccttattccgccttttg

SEQ ID NO: 64104 - DNA, 783 bp, Zea mays
  misc_feature: Ceres CLONE 1533068
  misc_feature: Encodes the peptide sequence at SEQ ID NO. 64105
  misc_feature (783)..(783): n is a, c, t, g, unknown, or other
tatatttatttaacttattcctaccccctccattcttttcctcctttcataactacactttatttccccgcggtggcggccgctctagaactagtggatcccccgggctgcaggaattcgtctcacccctagaaaaagcattttctcaataccttgaacaactaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcactccagaagagcacaaccatgtaccaaccttcccacttaaaggtgttgctagttcaataagtcaatactatatataccttctgcttgtcaccatatagtctaaaggcccaagctcaaataacagatgctgcttgcaaccttggatatttgtggagtgaacgccttgttgatagcatatgcataaaaaagtaacgtaattatcccgcagatgtttaaccactctggccaatattctcatgcaaataatgaatgcatggcacaccttttaatggttaagtagtcggcccgcctacaccgtaataaaaataactccactctcccccctttgtttccgcccctatattctctctctttatttgcgagtttttttaatatagaaatccccgccttacatatcggtgtcgctttacctcccttaan

SEQ ID NO: 64105 - protein, 82 aa, Zea mays
  misc_feature: Ceres CLONE 1533068
MSHAQPLRLQAQWKHVDIQDNQANAMKEPGTSGGYGSPMKDDKNKDVDTIASNFIKLKHRAWALQKSTTMYQPSHLKVLLVQ

SEQ ID NO: 64106 - DNA, 639 bp, Zea mays
  misc_feature: Ceres CLONE 1533069
  misc_feature: Encodes the peptide sequence at SEQ ID NO. 64107
ctggagctcaccgcggtggcggccgctctagaactagtggatcccccgggctgcaggaattcgtctcacccctagaaaaactccaccacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacgggccactaccgccccgccaactgggccgccgccgtcgaccccgccgacctccgcgccgctcacctcgcccgcacctacgcccgggcctgagcggccccggctcccttcaccctgctccgcctcgtctcgtatgacatacgcgcaccgtacgtaccagggtgagacgaggtgaggggtcggggttcgtgtggcgaacggcgtgttgagccacgcgcgcgtgcgcccgcgctctgtgacgcccggaac

SEQ ID NO: 64107 - protein, 95 aa, Zea mays; identical to SEQ ID NO: 58232
  misc_feature: Ceres CLONE 1533069
  misc_feature (1)..(89): Pfam Name: LEA_3 Pfam Description: Late embryogenesis abundant protein

SEQ ID NO: 64108 - DNA, 827 bp, Zea mays
  misc_feature: Ceres CLONE 1533073
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
tcgcccctgtcggccgcgcccccccacggctggtnnnnccctcccaaacccctcgcaactcccgcggtggcggccgctctagactagtggatcccccgggctgcaggaattcgtctcacccctagaaaatggacaaaatcatcagctcccgaaatccaaattgaaacagttgcaggcgattctgagctcgggttttgttccggggacggattcctgtgccggcggacgggatgtcaggccctctcgaccgatttgctaggccatgctttgaagggtttgtacatatccatgaaaggaaacacagcacatctgatgcagaccactcagaaggagacaagaatactctgattgggtctttccacaacaaacaacattaaacgcgagacgctcgggggtaccccaatttcgcccgatagtggagtcgttattaacccccggatcacctggccccacggtttttatcaaattgtgggactcggcaaaaacccgggggccgtgtcccccatctttatcatccccctttgccggcaacacaccccccttttatccccccggcctggccccttttttggcgcacaaacgccccccctaccctgatctgggcctcttcggtacaaagcgtaggcaccacctccacaaaagggtgcatagggcgaaaattgcgaaaccccttaacaaaccagggtctaaaaaattgccgggtaagaacttctccgtcgaggcaccacctccgactgagattaaatgtatatacggttggaaatttgcgccaaacagccccctaaatatagaaccaaaacaccccccccagctttgtgggctccccc

SEQ ID NO: 64109 - DNA, 703 bp, Zea mays
  misc_feature: Ceres CLONE 1533078
gcggtggcggccgctctagaactagtggatcccccgggctgcaggaattcgtctcacccctagaaaaaataaagtaaacgagatctatggcaaatatttcccggtgccagcacctgcacgatcaacctaccaagtggcggcgctgccactgaatgcccggattgagattgagtgcatcgctgctctctaatcagatcatccaaccactcattaaatcatcaataagcacccaggaatttgtggtagaggtacctgtaccagttcagtgtctgaaaactgcgggtaacaaaactttgtgtcccggataagtgatgtgtgtgtgtgtgtgagtgaacagtgcatctagtacgagaattgttgcgtgggttgttacttggattcttcgctctttagaccacaaggaccctggggtcaacctcaatagcctactgtttttttccccaaaagaatgaaatggcttcccacaaaaaaaaaaaaaaaccgagacgctccgagggtccccattctcccctttagtgggcctaaattcgcggcccccactgggccgcccgtttttacacggccgggcttgggaagaacccttgggcgtaccccaacataaatcgcctttgggacaaaatccccccctttcgccaggtggggggtaaaaaacgaaagaaagcgcccccccccaaataccccttcccaaaaagattgccgcgga

SEQ ID NO: 64110 - DNA, 640 bp, Zea mays
  misc_feature: Ceres CLONE 1533085
  misc_feature: Encodes the peptide sequence at SEQ ID NO. 64111
  misc_feature (525)..(525): n is a, c, t, g, unknown, or other
  misc_feature (538)..(538): n is a, c, t, g, unknown, or other
  misc_feature (541)..(541): n is a, c, t, g, unknown, or other
  misc_feature (542)..(542): n is a, c, t, g, unknown, or other
  misc_feature (549)..(549): n is a, c, t, g, unknown, or other
ccccgcggtggcggccgctctagaactagtggatcccccgggctgcaggaattcgtctcacccctagaaaaagtgtgtcaaatcgaacgcacatgcggcgcgactccctttcacggcctccccgcgtctcagcctacacgtccgagccgccagccgtgcgctttaagtgagcgcacccacgaaaagcagccaggcagcggagccggagagaagaagcagcagtagcagcagggccgtcaacaccatggtcggtgggcgcgaccgccacgaagctcctcccgtcggcggccgcggccgcgcgccgcccatcgatgctccacctcgcggccgtcgccgtcctctgctcgctgtcctacctcctcggcatctggcaccacggcggcttctccgcggggcccgccgccggcgactcctcctcctcggtctctatcgccaccgccgtctcctgcgccacccccgccccgacgaccgcctcctcgtctccccccgcgggaccgctcgacttcgccgcgcaccacacgcganggggtggaaaganccnnaaaaggnccccttccgccatcgcaactacgaagcatgcccccgcctagttactcccgagtacacgcccctgcgaggaacgtgggagcgttccctttgt

SEQ ID NO: 64111 - protein, 92 aa, Zea mays
  misc_feature: Ceres CLONE 1533085
  misc_feature (72)..(72): Xaa is any aa, unknown, or other
  misc_feature (76)..(76): Xaa is any aa, unknown, or other
  misc_feature (77)..(77): Xaa is any aa, unknown, or other
  misc_feature (80)..(80): Xaa is any aa, unknown, or other
MLHLAAVAVLCSLSYLLGIWHHGGFSAGPAAGDSSSSVSIATAVSCATPAPTTASSSPPAGPLDFAAHHTRXGGKXXKRXPSAIATTKHAPA

SEQ ID NO: 64112 - DNA, 619 bp, Zea mays
  misc_feature: Ceres CLONE 1533093
  misc_feature: Encodes the peptide sequence at SEQ ID NO. 64113
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
ctccccgcggtggcggccgctctagaactagtggatcccccgggctgcaggaattcgtctcacccctagaaaaaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggccccagnnnncctcgcgaattgtccagagtgctacgaggtgtccgccgactatgagggcaaggagacacgacgatgctgggcgaagctcgcgccagctcacggggctggcccccgcgaacgcatcctcgtggcaagctccatctgcaatgctcaacctcgcaacctggcgaagaagtgcaaatggggacccgccgccgcaacaacagtccaaaaaagtgggtcccccaaaaaaggctccccccccccccagtcccaaattgaggggaaccctaaagccctccgggtcaaaggtgggaaatcccccc

SEQ ID NO: 64113 - protein, 156 aa, Zea mays
  misc_feature: Ceres CLONE 1533093
  misc_feature: SWISSPROT Homolog: EC 4.1.1.31 Phosphoenolpyruvate carboxylase
  misc_feature (57)..(57): Xaa is any aa, unknown, or other
  misc_feature (58)..(58): Xaa is any aa, unknown, or other
MASTKAPGPGEKHHSIDAQLRQLVPGKVSEDDKLIEYDALLVDRFLNILQDLHGPQXXSRIVQSATRCPPTMRARRHDDAGRSSRQLTGLAPANASSWQAPSAMLNLATWRRSANGDPPPQQQSKKVGPPKKAPPPPSPKLRGTLKPSGSKVGNPP

SEQ ID NO: 64114 - DNA, 657 bp, Zea mays
  misc_feature: Ceres CLONE 1533097
  misc_feature: Encodes the peptide sequence at SEQ ID NO. 64115
  misc_feature (507)..(507): n is a, c, t, g, unknown, or other
  misc_feature (510)..(510): n is a, c, t, g, unknown, or other
ggagctccccgcggtggcggccgctctagaactagtggatcccccgggctgcaggaattcgtctcacccctagaaaaagagatcagagccccggcgaggtcgcaccgcaccagccatcgtctccttccttccttcctatactaccatccaaccagctgcccagcgcaacgttacctgcccgacatccgacaagccagtccatccggcagcgagcaaaggtctgagatgggttccgtagacgcggcgatcgcggtgccggtgccggcggcggaggagaaggcggtggaggagaaggcgatggtgttccggtccaagcttcccgacatcgagatcgacagcagcatggcgctgcacacctactgcttcgggaagatgggcgaggtggcggagcgggcgtgcctgatcgacgggctgacgggcgcgtcgtacacgtacgcggaagtggagtccctgtcccggcgcgccgcgtcggggctgcgcgccatgggggtggggcaagggcgaccntgntgatgagcctgctcccgcactgccccgagttcgccttcacttttccctgggcgccgcccgccctgggcgccgccaccaccacgggccaccccgttctacaccccgcacgaagtccaccgccaggcggaaagcggccggcgccagctt

SEQ ID NO: 64115 - protein, 94 aa, Zea mays
  misc_feature: Ceres CLONE 1533097
  misc_feature: SWISSPROT Homolog: EC 6.2.1.12 4-coumarate--CoA ligase
MGSVDAAIAVPVPAAEEKAVEEKAMVFRSKLPDIEIDSSMALHTYCFGKMGEVAERACLIDGLTGASYTYAEVESLSRRAASGLRAMGVGQGRP

SEQ ID NO: 64116 - DNA, 637 bp, Zea mays
  misc_feature: Ceres CLONE 1533104
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaatggctggtgtatcaaggttgagtttgtcttgtttccacacacagtatcaggaaggtccgaggccctggttctctgcctctctgcccgctgctgtgttcagctgcggcatctcgttcagaacgagatgagcaaactgtgtgagtgtgtgtgtggcccaaacacgcagtgtgttcgaataagtttatctgtactacgctgaatccataagtttctctgtcgaaaaaaaaaaaaaaaagcgagacgctcgaggtacccaattcgccctatagtgagtaatattaggcgcgctcactgtacgtcgttttacaacgtcttgcctggcaaaaccctggcgttacccaaattaatcgccttgcagcacatccccctttcgccagctggcgtaatagcgaagaggcccgcaccgatcgcccttcccaacaaatgcgcagcctgaatggcggatgaacatggtcagcgttaatattatgtgacaattcgcgttaaattcttgttaaatcagctcattttttcaaccatggggtcgagttcggcccaatctcggataaatcaaacga

SEQ ID NO: 64117 - DNA, 457 bp, Zea mays
  misc_feature: Ceres CLONE 1533105
  misc_feature: Encodes the peptide sequence at SEQ ID NO. 64118
  misc_feature (190)..(190): n is a, c, t, g, unknown, or other
  misc_feature (191)..(191): n is a, c, t, g, unknown, or other
ccgcggtggcggccgctctagaatagtggatcccccgggctgcaggaattcgtctcaccccctagaaaaactacaaactttttggcaaaagattattgaggatcctgagagcttaactttgtaaggtcacttgaagagttatgatcttatctatatgcccataagtagtcttattgcagttggagtctanntgtgaatccatttttgtaccttgacattcaaagaaatcctcccaatttttttttgacccgggttttttttccccagggttggggaattggtggggggagaaattttcttgtgtttttcaaaaaaaaaaaaaaaacaaaaaacccccggggagagcccccattcccccccaaaaaagagaattaaaatacccccccccctcggggcgcctttttttttaaaaaccccccgttggggggagaaaaaaaaacttgtgtttttccccaat

SEQ ID NO: 64118 - protein, 40 aa, Zea mays
  misc_feature: Ceres CLONE 1533105
RGGGRSRIVDPPGCRNSSHPLEKLQTFWQKIIEDPESLTL

SEQ ID NO: 64119 - DNA, 642 bp, Zea mays
  misc_feature: Ceres CLONE 1533106
  misc_feature (301)..(301): n is a, c, t, g, unknown, or other
ctccaccgcggtggcggccgctctagaactagtggatcccccgggctgcaggaattcgtctcacccctagaaaaaaagctagctaggtatctacgacttaattaactaatagctggaggagtattaattaggttgatctgctccacttggtatatatatagatgttatatatgaagctaattatattaggcatgtgacgagcatctgctagtaataagctcctatatataaagtggatgcttattttgtatctctacttgagttgtatacactaatatatatactttaatttgattttgcngctgaaaccatatataaattgatccacgatgaatagatatgatactatatatatttataaaaaaaaaaaaaccgagcccctcgaggcccccatttcccccttaggggagtcgtattcccccccccccgggcccactgttttacaacttcgaaactggaaaaaccttggagtcccccatttaaatccctttgcagcatatcccccttcccccagttggccaaataacaaaaaggcccacaacgaatcccctttccaaatatttgcccacctctaaaggccaaagggaaatttgaacctttaaatttttgataaaatccgcgaaaaattttggaaaaacccgc

SEQ ID NO: 64120 - DNA, 693 bp, Zea mays
  misc_feature: Ceres CLONE 1533108
  misc_feature: Encodes the peptide sequence at SEQ ID NO. 64121
  misc_feature (394)..(394): n is a, c, t, g, unknown, or other
  misc_feature (401)..(401): n is a, c, t, g, unknown, or other
  misc_feature (402)..(402): n is a, c, t, g, unknown, or other
  misc_feature (409)..(409): n is a, c, t, g, unknown, or other
  misc_feature (469)..(469): n is a, c, t, g, unknown, or other
tggagctcaccgcggtggcggccgctctagaactagtggatcccccgggctgcaggaattcgtctcacccctagaaaaactcagtgttctcgactcgaccgccgccgtcccagttcgcttcgcgtcacccagagctcgtcggcctccgtccccgcgagaagcgagagcatggacacccaggtgaagcttgctgttgtggtgaaggtgatgggcaggaccggctccaggggtcaggtgacccaggtcagagtgaagttcttggatgaccagaaccgtctcatcatgaggaacgtcaagggccctgttcgtgagggtgacatcctcaccctgctcgagtctgagagggaggcccagaggctgcgctgaagccctggtggccttggatgtaattctngtaattnntgtctangtttgtcgaacttgccgtgtgacctttcacacatctgctttgagatttactcagcctggnattgcagttttaaaaaaaaaaaaaaaacgagacgctcgaggtacccaattccgccctaaagtgagtcgttatacgccccgctccctggccgtcggttttaccacgtcgtgacttggaaaacccctggcgtttccccatttaaaccgccttggaggcaatccccccttttcccgggtggggtaaaaccgaaaaggcccgccccgtattcccccttccccaagggt

SEQ ID NO: 64121 - protein, 65 aa, Zea mays
  misc_feature: Ceres CLONE 1533108
  misc_feature (1)..(65): Pfam Name: Ribosomal_S28e Pfam Description: Ribosomal protein S28e
MDTQVKLAVVVKVMGRTGSRGQVTQVRVKFLDDQNRLIMRNVKGPVREGDILTLLESEREAQRLR

SEQ ID NO: 64122 - DNA, 716 bp, Zea mays
  misc_feature: Ceres CLONE 1533109
ctccccgcggtggcggccgctctagaactagtggatcccccgggctgcaggaattcgtctcacccctagaaaaacatcgggaaccgccgccgacgccgcaggaggagacgcatcgaggttagcacgcgaaaaagcgaccatgagggccaagtggaagaagaagcgcatgaggaggctcaagaggaagcgcagaaagatgaggcagagatcccagtaggcagatcgagatggattgtggacctgatgacatgcgtgggtacatacatttcttcggatgcgttgggtgtgcctgtgggagagatgtcaaactggccttggggtcacgggcccgccatcaagttggaacgtcttggcctggcccttcagaaggccactttttcctggggtctaggttggattttaaaaccccgcggttttgcccctaaaaaaaattccaacaggtcctttttttggacccttttttgggggggggcttttttttggcggaaaaaatccccgcccccccccttttggggccccaaaaaaaaaaaaaaaaaaacagaaacccttccggggggccccccttttcccccctataaggggagcgctatattacccgcccctccctggggggcgttttttttaaaccccccgtggtgtggggaaaaaccccccgggttttacccccaattttatgcccctttggagagaaatccccccctttttttcgggggggg

SEQ ID NO: 64123 - DNA, 798 bp, Zea mays
  misc_feature: Ceres CLONE 1533115-R
  misc_feature: Pfam Name: Lon_C Pfam Description: Lon protease (S16) C-terminal proteolytic domain
tttgggtacctcgagcgtctcgtttttttttttttttttgggctatatgtacatacatttataataaagtcacccaagcccaatggacgtgtgatgtttctcgatgtctttagttttgacaaccttgttgtagctatatttccctggattagattacatgcatacatacatatatacacccacgacagagaaaccaaccagcgtaattcctccctgatttctgttgcatctgtgcataaacatcaacagctggtgtcgagaaactatgcaatgagtcccagcaggtgaacgagcagatcttctgactgctctccgaattctgaccagtatacacattcagatgcgaagcctaacaaaaatgggcgtgtcaagacctgtgctggcaagagagctaggctcttattctgactgttgaccattcgtggtactgttgacgatgatcctccgaagcaaatatccatagcaaaggcgagttggatgctataacttggagcgtgatttaagtggacatccgccttcgaaagcatggtcgagtacgtcctcgatgtgtttcacaagcagaatctccatgccagagagaatcggtgaatggacctcttgataagtccttcagggttccttttcagggaaaaataactcctcttggatccataaacgatggtgccggcaaaggtaccttgggccctttaaaacccccccaaaggggggaaaatacaatggccccctttaaaaagtcaatccccttcccgggtcaatataaaaagattttctggcgcctcgggaaaaatttttttgggg

SEQ ID NO: 64124 - DNA, 690 bp, Zea mays
  misc_feature: Ceres CLONE 1533115
  misc_feature: Encodes the peptide sequence at SEQ ID NO. 64125
  misc_feature (690)..(690): n is a, c, t, g, unknown, or other
ggagctccccgcggtggcggccgctctttaatagtggatcccccgggctgcaggaattcgtctcacccctagaaaaactctccagtttttttgtgtctgctttgccgtacgctggtgcgcctctcccctcctgagctcctctctacggctccaactcacctcggcctccacctgtattggtgacatggtggactctccggtggagctggagaaccagctcgccatactgactgtccgcaacaaggtgctcctccctggagccatcgttcagatccgatgcaccaacctcattagtgtgaaattggtggagcaacagctctggtagaaagaagataaaggactgatcggggtacttcctgtgcaggactcagaggggaaactattgggtcttcgctgtcacctgctgtgggcacgtgattcacgtggaggatgcagtaaggccgtcggttctgcaggagagtcatcaaagcggcacctaaaaaatgggaaggaccccattcagcggcacaccaagggacttgctgccagacctttacaccgtttcagacgggtggagaagccaagtggaatggttacgtacctggttgatcttgaaggtctatgtacgttcaccgttcaggaactcaatgcactacgaccattaaattatgctcctgtttcccgccttgacatgacaaacactgaattggn

SEQ ID NO: 64125 - protein, 46 aa, Zea mays
  misc_feature: Ceres CLONE 1533115
MVDSPVELENQLAILTVRNKVLLPGAIVQIRCTNLISVKLVEQQLW

SEQ ID NO: 64126 - DNA, 639 bp, Zea mays
  misc_feature: Ceres CLONE 1533116
  misc_feature: Encodes the peptide sequence at SEQ ID NO. 64127
  misc_feature (422)..(422): n is a, c, t, g, unknown, or other
  misc_feature (457)..(457): n is a, c, t, g, unknown, or other
ctccccgcggtggcggccgctctagaactagtggatcccccgggctgcaggaattcgtctcacccctagaaaaatccggggcgacttgacttccctctgcaacctcagaacccagccaatccgctgatctcaactgccaggcactccgatccggcgacgatggaggggagcgccgactccttcgggtccttgacggcgccgcttgcctggcacgacttcctcgagcgcatgcgccagccttccgccgccgagttcgtcaagtccattaaaagctttattgtgacattctcaaacagagctcctgatccagagaaggatagtactgctatccaggagttcctggaaacatggaaggggctttcagagcccacaccccttgggctggcagttcagaggaagaactagagagtgctggtgagggnacttgagaatatgttatgacaaagctgtttaatcnggtattcgcatcagtcccagagatgtgaagagtgatgaagaactttttgagaaaatgtctttgctacagcaatttggtaggcctgaaaacttgggatttaaacccgaggtttcaaccgaaaactcctggctggcccccaaaaagggcctgccaaaaaaaaaactggtttaaagcccccaggg

SEQ ID NO: 64127 - protein, 81 aa, Zea mays
  misc_feature: Ceres CLONE 1533116
MEGSADSFGSLTAPLAWHDFLERMRQPSAAEFVKSIKSFIVTFSNRAPDPEKDSTAIQEFLETWKGLSEPTPLGLAVQRKN

SEQ ID NO: 64128 - DNA, 695 bp, Zea mays
  misc_feature: Ceres CLONE 1533119
  misc_feature: Encodes the peptide sequence at SEQ ID NO. 64129
  misc_feature (421)..(421): n is a, c, t, g, unknown, or other
  misc_feature (422)..(422): n is a, c, t, g, unknown, or other
  misc_feature (472)..(472): n is a, c, t, g, unknown, or other
  misc_feature (558)..(558): n is a, c, t, g, unknown, or other
tggagctcaccgcggtggcggccgctctagaactagtggatcccccgggctgcaggaattcgtctcacccctagaaaaaacgcactcgagctcgagccctcgcccgctcagtcacaaagcctcagatctcagtcacctgcgccgccgcttcgttcgtgtggaggggagaagacaggaaatggcggcgactgagggcgtgctcttggggatgggcaaccccctcctcgacatctccgccgtcgtcgatgacgccttcctgacaaagtatgacatcaagctgaacaatgccattctcgctgaggagaagcacttgcctatgtatgacgagttggctagcaagagcaatgttgaatatattgccggaggagccacccagaactctatcagggttgcccaatggatgcttcaaactcctggtgcnnacagttacatgggatgcattggaaagggacagtttggtgagggaatgaangaaaaacgctcagctgcaggagttactgctcattactacgaggatgagactgctcctactggcacatgtgctgtatgtgttgtggntgggtgaaaggtcattgattgcaatctgtcagcggcaaactggttacaatctgagctcttaagagacaaagaactggggcctaggtgaaaaggcaaatactctcccttgctggatttcccctaacgtggcccctgat

SEQ ID NO: 64129 - protein, 128 aa, Zea mays
  misc_feature: Ceres CLONE 1533119
  misc_feature: SWISSPROT Homolog: EC 2.7.1.20 Adenosine kinase
  misc_feature (82)..(82): Xaa is any aa, unknown, or other
  misc_feature (98)..(98): Xaa is any aa, unknown, or other
  misc_feature (127)..(127): Xaa is any aa, unknown, or other
MAATEGVLLGMGNPLLDISAVVDDAFLTKYDIKLNNAILAEEKHLPMYDELASKSNVEYIAGGATQNSIRVAQWMLQTPGAXSYMGCIGKGQFGEGMXEKRSAAGVTAHYYEDETAPTGTCAVCVVXG

SEQ ID NO: 64130 - DNA, 721 bp, Zea mays
  misc_feature: Ceres CLONE 1533120
  misc_feature (610)..(610): n is a, c, t, g, unknown, or other
caaagctggagctcaccgcggtggcggccgctctagaactagtggatcccccgggctgcaggaattcgtctcacccctagaaaaacgtcccgcatcgtttcctcctccttttccccgttcgtcccctggattggcgtctacccggcgcgacccggaccgaatcctaagtccgcctgccgccgccgccgtctcccgttggaaacggtaaaacctccctcctcctggtccgtttcgccggcgtcgggtccaagcggccgcgcggtttcgccgccggcgccgatctgagcgccgccggcgttgaccccacccgattcgctccgggctgctgctggggcccttcttctcagatgtggagttcctccacctgcagattataccgcaactgtttgaggagtcctgatccggactagctaagggctcatgctgtgcacgacctgatactacggattttgcgccttctagaggcatgattcttaaatcggagtcttactgtttaaaccatagtttgctttcgttttgaactgtgggtgaatttccattcctgcagaacgtgaagtcggtttaggccaggcctgtttgatccgtgttcatatatgtatatgttaatggnatggaggatacagaacgctgttgcttgcgatctgattaaggctttttttttttgttttgcttgctattctgattcccttttcagagtttggagtaaagaaacgacctttgc

SEQ ID NO: 64131 - DNA, 704 bp, Zea mays
  misc_feature: Ceres CLONE 1533123
  misc_feature (704)..(704): n is a, c, t, g, unknown, or other
ctggagctcaccgcggtggcggccgctctagaactagtggatcccccgggctgcaggaattcgtctcacccctagaaaaactactctccctcaaactgtaaacactgcttcaccagttcgctgcttctcctcgtcctcacaggcgcgtcgatccggagggcgcctgccgccgccggcgggaacggaggcccgagcaggagcgggactggggacggcgaatctggagcccggcggacctgcattgccgcgggaccgccgcgcgtaggcagatctccccccgtcccctgccgcggcaccggcacggcacggcatggtggctgccgcgcggcggccaccgcgccagatccggcccgcccctcgcgcccgccgctcacgccggcgctcgacaagcccaactccgccgccgcgcggaggaactcgcgctccaacaagcccgtgtcctcgaggtacctgcccgccgccgcgtccccggcatcgtccacctcgtcgtcttcctcgtcctcgtcccgccgctccctctccgcgcagcgcgcccggtcatctaccccgccgccgcagcactccacgtcgcccaccaccaccgcgtcggcagcggcaaccgccaccgccaccgcgaccacgatgcggagcctctccgtgtccgtccagggggagtccttctttctaaagacgtcgcgcgcgccgcgggcttcgtccgcgtcctn

SEQ ID NO: 64132 - DNA, 672 bp, Zea mays
  misc_feature: Ceres CLONE 1533129
ctggagctccccgcggtggcggccgctctagaactagtggatcccccgggctgcaggaattcgtctcacccctagaaaaaagcggatgggggctggcgacgcgcaccggccgtatgcggaacggctcctgctggtccgccgatcggctcggggcgtgtaccgttgtcgcccgcgccggcggccaaagcccgggggccctaggcgcccccggcagccgtcgtcggcgcggacggtatccgcgcgcctctggcgcgcccctcggggcgctgcgctgcaacggcctgcgagctccccatccgacccgtcttgtaacacggaccaaggagtctgacatgcgtgcgagtcgacgggttcagaaacctgagatgcgcaaggaagctgacgagcgggaggccctcacgggccgcaccgctggccgaccctgatcttctgtgaagggttcgagttggagcacgcctgtcgggacccgaaagatggtgaactatgcctgagcggggcgaagccagaggaaactctggtggaggctcgaagcgatactgtcgtgcaaatcgttcgtctggaaaataatccccaattaccgacatcgacgccgacggcgatgtccctccgcaagcgccagcgctcggcgagcagctcccgcctcaccgccttctgctcgccaccgtcccctcc

SEQ ID NO: 64133 - DNA, 717 bp, Zea mays
  misc_feature: Ceres CLONE 1533132
  misc_feature: Encodes the peptide sequence at SEQ ID NO. 64134
  misc_feature (463)..(463): n is a, c, t, g, unknown, or other
ctggagctccccgcggtggcggccgctctagaactagtggatcccccgggctgcaggaattcgtctcacccctagaaaaaaccaacaagagtagtagtcggagccgtccgtagtagctagcgtacgtacgtgtgaccgattcagcgaggtcgccgtttgtgtgtcgatatatatggcgaggtcgccgtttgttccgatggatcaggggaaagagcaaggcgccggacgaggagcggccggcaataataaggagcggcagcagcaggagcaggagcaggaggaggtgctgctggtgcacagccaggtgcggcggatcaagaaggaggacgaggaggccttcagggagcgcctcctgaagctgcgcctgctggagacccggcccagcgccggcggcgtggcctggcgagccccgcgctccctgtcgccgctccgccgtgccggcagcgccatcatcccggtcccngtgagcgagtgactagtagcgagcatccgtcgacacgcggttctctcggctgcccgcgcgcccgccgccggttgtagattcgctaggcgcgtacgtagcgagcgtgaccagtgtcttggttgggggtgccgctagtgagtgagcctgcccgtgctctgcgcctgcgcgcgcgaaaatatgggatccgagcctgtaaaacggccaccggtgtatagtaggcagcagcatcgccatgtgtggccgtggttcgtggt

SEQ ID NO: 64134 - protein, 100 aa, Zea mays
  misc_feature: Ceres CLONE 1533132
MARSPFVPMDQGKEQGAGRGAAGNNKERQQQEQEQEEVLLVHSQVRRIKKEDEEAFRERLLKLRLLETRPSAGGVAWRAPRSLSPLRRAGSAIIPVPVSE

SEQ ID NO: 64135 - DNA, 624 bp, Zea mays
  misc_feature: Ceres CLONE 1533135
  misc_feature: Encodes the peptide sequence at SEQ ID NO. 64136
  misc_feature (133)..(133): n is a, c, t, g, unknown, or other
  misc_feature (158)..(158): n is a, c, t, g, unknown, or other
  misc_feature (174)..(174): n is a, c, t, g, unknown, or other
ctccccgcggtggcggccgctctagaactagtggatcccccgggctgcaggaattcgtctcacccctagaaaacttatccaaccttggagggagtaaaagcgttcctgtaaaagatgtgaaatctggtgtagncagtgatgcattaaagcccaatggnaagtgctgttcagctngtgctgatgctgatgtatatgatccctgatcacctcttggggacatgagcaccgagaagcatcatctactggctttataaataaagatggtggaaccgggatatgctgaatcatccggcctttgaatggggcaagacctttcaaacagggttttggctccgaagggtccccaaaatggaaacctccggtttggggggcaaaaaccctcaaaagaaaacccccgggggttttcccccgctttaaattccccccccgggttttcctggggaaacccaaaaagggtttttttgggaagggggggtttcccccggggggcaaaaaaaaaaccggcggggagggggaacccaggggggccccccctttttaaaaatattggggggggtggggggggggaaaaaatataaacgggcccccaaaaaaaacccccccacttttttttggggagggggg

SEQ ID NO: 64136 - protein, 66 aa, Zea mays
  misc_feature: Ceres CLONE 1533135
  misc_feature (44)..(44): Xaa is any aa, unknown, or other
  misc_feature (58)..(58): Xaa is any aa, unknown, or other
PRGGGRSRTSGSPGLQEFVSPLENLSNLGGSKSVPVKDVKSGVXSDALKPNGKCCSAXADADVYDP

SEQ ID NO: 64137 - DNA, 627 bp, Zea mays
  misc_feature: Ceres CLONE 1533137
  misc_feature: Encodes the peptide sequence at SEQ ID NO. 64138
ctccccgcggtggcggccgctctagaactagtggatcccccgggctgcaggaattcgtctcacccctagaaaaaaagctgtctcagaatggagccggtggagcctcagcagcaagtggagctcaaccgcctgaatgccagctccaggccaggcaccaatggcgggagtgcaagaacagagaaagaagaggaagtagacgactgccccatcgaggaggtccggctgacggtgccgatcaccgacgacccggcattgcccgcgctcacgttccggacatggttcctggggctcctctcctgcgcgctgctggccttctccaaccagttcttcggctaccgccagaacccgctgtacatctcctcgctgtctgtgcagatcatggtgctgcctctcggcaagctcatggacgcgtgcctccccaccaggccgtcctggtcatgggccggtcatttctccgtcatccggggccccttcagactcgatgagcacgtcctcatcacgatcattcgcatcacgggttccaactccgcctacgcggtcggcatcatcaacatcggcaagggcctacttacactgggaagatccacccggtgagccgccttggctgctcaccctgacaacgtaatt

SEQ ID NO: 64138 - protein, 168 aa, Zea mays
  misc_feature: Ceres CLONE 1533137
MEPVEPQQQVELNRLNASSRPGTNGGSARTEKEEEVDDCPIEEVRLTVPITDDPALPALTFRTWFLGLLSCALLAFSNQFFGYRQNPLYISSLSVQIMVLPLGKLMDACLPTRPSWSWAGHFSVIRGPFRLDEHVLITIIRITGSNSAYAVGIINIGKGLLTLGRSTR

SEQ ID NO: 64139 - DNA, 1014 bp, Zea mays
  misc_feature: Ceres CLONE 1533137-R
  misc_feature: Encodes the peptide sequence at SEQ ID NO. 64140
ggtacctcgagcgtctcggatgtctacttttttttaaaagataccgtatcacttaaggtttgccagtagccgcgataacattgaaccgaccgactatcacgaggtccaaaaaaataaccaccacaaaagtaccaaccaaccacaaataaagtttaagcggacacaccgcaccaactgacgataactctcggcagcaactgggccagccagcaactgcagcacactcaagactgacaacaaaccgcttagtccaccctcctcgatcttggggccagggccgccgctgccggcaggggcgtcctcgtccatgccgacagcgacgcccatgtcttcacccgcgccctggtacatcttggcgatgatggggttgcaaaagactctccagctccttccattcttggtcctcgaaactcggtccgcctcggccaaacttggtttgccgtccaacccaacctaaaaggcccccggtccaatgggcgtccctccgatcctttctttctcttggtccatcggaccgggcaaaccttttggaaacccaaaacctttccccgggccccttggaatccggggtgtgccccacttttttttttaaaagaaaaaaaaacttccccccccccccccaaagtttctttttggggcgccccccacaaacctttcttttttctttgtggggcgccccctccccaaccccccccaaaaaaaaactggtgtagatttcgtcccacgaaggaggtccccactaaaaaacacacaacttttcccccgcaaaaatcccgcccctcccctttgtggaaaaaaaaacacggcccccacttgtcccccttgtaggggaaaaaattagaaaaaccccgtggtcccccctctcccccccccagttgttttcttgtgtccccccgggaaaaaaaaaaactcttcagagaaagcccctcgtggcggcccaacaattcaaaaaacacccacgggtgtaattctgtggggccacccacaccggggtgtgaagaggggggaaaatcc

SEQ ID NO: 64140 - protein, 43 aa, Zea mays
  misc_feature: Ceres CLONE 1533137-R
MSSPAPWYILAMMGLQKTLQLLPFLVLETRSASAKLGLPSNPT

SEQ ID NO: 64141 - DNA, 725 bp, Zea mays
  misc_feature: Ceres CLONE 1533142
  misc_feature: Translation starting site: 269
  misc_feature: Pfam Name: Nol1_Nop2_Fmu Pfam Description: NOL1/NOP2/sun family
  misc_feature: SWISSPROT Homolog: EC 2.1.1.29 tRNA (cytosine-5-)-methyltransferase
  misc_feature (658)..(658): n is a, c, t, g, unknown, or other
  misc_feature (686)..(686): n is a, c, t, g, unknown, or other
aagctggagctccccgcggtggcggccgctctagaactagtggatcccccgggctgcaggaattcgtctcacccctagaaaaacctccccggcgccccttcccctgcccaccacctcccctcgctggtgtcggccctggccccagcgaccacctcctcggctactgcttctgcggggttgatctcccccctcccggggagaaaattttcatgaattcttgaagcgagagaacgaagttggcaacataactaggcaagaggctgttagtatggtcccaccactgtttctgaatgtgcaacctgatcatcatattcttgatatgtgtgccgctccaggatctaaaactttccagttacttgagatgattcaccagtcaacgaagcctggactgcttccaaatgccctggtggtagctaatgatgttgatgtgcaaagatgcaatcttcttattcaccaaaccaagagaatgtgcacagctaacctgattgtgacaaatcacgaagcacaaaactttcctgtggcgatgggactgtccgtaaggctcctgatatgtggaggaagtggaatgctggtatggggaacggacttcatcacctgcaagtggaaattgctatgcgtggtatgagcttgctcaaagtgggtggggaaggatggtttnattcgacatgttcaatgaaccctgttgnaaacgaaggcgttgttgctgagattttgcggagatgtgg

SEQ ID NO: 64142 - DNA, 700 bp, Zea mays
  misc_feature: Ceres CLONE 1533147
ctccccgcggtggcggccgctctagaactagtggatcccccgggctgcaggaattcgtctcacccctagaaaatactcaactgtaatatccatgctgctccaactcatgtaatccttttgttctggcgaagcagggcgttccttcgtctatagcctgaattcgtttcctttggtagcctgaaaaaaaagaaggtgtttggctgcattgcctgctactatctcttacgacctcccttctacttgcctgatcctaaaacgttttcgtcggtgtctgatctgaatagagtaagcaatgagccggatctgtcggttcacgctgattaatgtggttctcttgctaccaaaaaaaaaaaaaaaaacgagacgctcgaagttacccaatttcccccctatagtgaggtcccaataacccgccgctcactgggccggtcgtttttacaaccgtccttggactgggaaaaaacccctggcggttaccccaccttaattccccctttgcagccaaattccccccttttccgccagtttgggcgtaataaccgaaaaaaggccccccccccgattccccctttcccaaaaagttgcccccacccctgaatgggtaaaatgggaaattggcaacgcctttaatttttttttgtttaacaattccccgattaaaatttttttgtttaaaacccgccctcctttttttttaaac

SEQ ID NO: 64143 - DNA, 620 bp, Zea mays
  misc_feature: Ceres CLONE 1533148
  misc_feature (235)..(235): n is a, c, t, g, unknown, or other
  misc_feature (244)..(244): n is a, c, t, g, unknown, or other
  misc_feature (261)..(261): n is a, c, t, g, unknown, or other
  misc_feature (262)..(262): n is a, c, t, g, unknown, or other
  misc_feature (288)..(288): n is a, c, t, g, unknown, or other
  misc_feature (332)..(332): n is a, c, t, g, unknown, or other
  misc_feature (333)..(333): n is a, c, t, g, unknown, or other
  misc_feature (335)..(335): n is a, c, t, g, unknown, or other
  misc_feature (389)..(389): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
ggagctcaccgcggtggcggccgctctagactagtggatcccccgggctgcaggaattcgtctcacccctagaaaaaatcctccttcgcctgctcgctagtcgctagccgctccccccaacaaacaaccctaatccgtgaccgtggacacgccgcaagctccatcgcgcgaatagattggggggattcaatagaggctacgcggggattggtcgcgctcgagatctcagcacccntcgcgcctngaaatcttttctattgnnttgtcgtggttcaggtgatgagattncttggggagcgcgactcgctcggtcctgagaatgctgcggctanngnggggggtgtggccgcagcgtccatctctcctcccacagggactccctctccggncgctgcgggcggagcttcctcttcgggcaacacgtggtttctcctctccacttaacccgggcgcgcctcctgcaaaccaaggaacccttcgcgctcccctcccgtttttctccgcgcccattaaaccggggtcccctggcggtgccggggnnntcgccctgacgggcaaggcctgcttcaaaaaggcaacttttccatggctgcccggcggcttatttctttgggccaaat

SEQ ID NO: 64144 - DNA, 649 bp, Zea mays
  misc_feature: Ceres CLONE 1533149
  misc_feature: SWISSPROT Homolog: EC 3.2.1.23 Beta-galactosidase
agctccccgcggtggcggccgctctagaactagtggatcccccgggctgcaggaattcgtctcacccctagaaaaacccctagaaaaagaaggcctgaggttgctgctaccttccgagattggtgtggttgctgagaacccaatagatagggatgtctaaatctggagagaagtgccgttgagagtgtatgcggattgtatgtccattgtattcggagtataagaccgaataaaaagatcgcagctgtgtttggctgtgggattgtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccacagttgcgcagcctgaatggcgaatggaaattgtaagcgtttatattttgttaaaaatcgcgttaaatttttgttaaatcagctcatttttttaacaataggccgaaatcggcaaaatcccttataaatcaaaagaatagaccgagatagggttgagtgttgttcccagttggaacaagagct

SEQ ID NO: 64145 - DNA, 714 bp, Zea mays
  misc_feature: Ceres CLONE 1533155
  misc_feature: Encodes the peptide sequence at SEQ ID NO. 64146
  misc_feature (370)..(370): n is a, c, t, g, unknown, or other
  misc_feature (390)..(390): n is a, c, t, g, unknown, or other
  misc_feature (391)..(391): n is a, c, t, g, unknown, or other
  misc_feature (404)..(404): n is a, c, t, g, unknown, or other
aaagctggagctcaccgcggtggcggccgctctagaactagtggatcccccgggctgcaggaattcgtctcacccctagaaaaagttacgaacccgtgggatctggagagagccctctccgtttcacacttggctcgctcgctcgcacgcacgcactgacaacctgggtggccgccaccgcacaccctcttcgcctctcgctccccgtcgtcggtgagccgcgcccgtccagccgcccaccctctcaccgatggcttcggcggccgcgaggggcgccgcggtgcgctcccctctcctcgtccaccaccgcgtccccctggtacatcccagcgggggaggctcgctccgggtcggctggccccgggatgcncccggacgggaggggcggcnngcggtggcccggntggggctagggttttcgcgcgctactcccaggcccaggacttctccacacgcctccaagatagagctggtgaactgcctaaggtagtcgaggaccttatcaaacatcgattagcaaggggccccaggtgctttcaggatggcccaagggacccaacctgccttggggtccgcggggaagtggtttaattaccttccaaaaacggcccaatactcccgccttcccgggaattccaccccaaagccccgtgggttttgcttcccccctttacccaaaaagggttttgagcccccggggggccccttaaaaaa

SEQ ID NO: 64146 - protein, 79 aa, Zea mays
  misc_feature: Ceres CLONE 1533155
  misc_feature (47)..(47): Xaa is any aa, unknown, or other
  misc_feature (52)..(52): Xaa is any aa, unknown, or other
MASAAARGAAVRSPLLVHHRVPLVHPSGGGSLRVGWPRDAPGREGRXAVARXGLGFSRATPRPRTSPHASKIELVNCLR

SEQ ID NO: 64147 - DNA, 866 bp, Zea mays
  misc_feature: Ceres CLONE 1533156
  misc_feature (26)..(26): n is a, c, t, g, unknown, or other
  misc_feature (27)..(27): n is a, c, t, g, unknown, or other
  misc_feature (390)..(390): n is a, c, t, g, unknown, or other
  misc_feature (391)..(391): n is a, c, t, g, unknown, or other
  misc_feature (481)..(481): n is a, c, t, g, unknown, or other
  misc_feature (483)..(483): n is a, c, t, g, unknown, or other
  misc_feature (489)..(489): n is a, c, t, g, unknown, or other
  misc_feature (527)..(527): n is a, c, t, g, unknown, or other
  misc_feature (767)..(767): n is a, c, t, g, unknown, or other
ttatctttgtttgctcactttccaannctcccctcctaactcccatacaaactcgagctccccgcggtggcggccgctcttcaatagtggatcccccgggctgcaggaattcgtctcacccctagaaaaatacctttctcggccttttggttaagatcaagtgtagtatctgttcttatcagttcaatatctgatatgtgaactatgtgttcacttcgatattaaatttattttttgtgggggagggtccgtatagtagcttgctacttggtcctcgtgtgtcgctcgggagttgcaatttgtgagcgagccaggggcttctccaaccaccctcaaatcaaatttcgtgttctctgcttaaacggtttacagtattttgtttttcgcttnnttccgcttgtctgaattttgttgtttttccgtgttcagagtgagttagttcgggttatgtgtgtttggccgtccctaccccccaaaaaancntaattnccaatcagaaaaaagttctctttttccccccgtctaangaagggacaaacaaccaccataaacgttttctaggggtattccatgttttagccccaaccctaattgaggttgtgttattaaatgtgatgacaacaagtagagtgcggttagtcagttaccaaaaacttcccagaacgtggggcacaaaaaccctgcgctatttaacatcacgcaaccattcttaccatggccaatttataacctcccctattttcccccgcccgggattaaataggggngataaagagttccgaaataagatgctccctcctgaccgcagctttgtgctccttatctgtagatgtgtttattaagacacctagtatacactcttcaca

SEQ ID NO: 64148 - DNA, 630 bp, Zea mays
  misc_feature: Ceres CLONE 1533158
  misc_feature: Encodes the peptide sequence at SEQ ID NO. 64149
  misc_feature (385)..(385): n is a, c, t, g, unknown, or other
  misc_feature (432)..(432): n is a, c, t, g, unknown, or other
  misc_feature (433)..(433): n is a, c, t, g, unknown, or other
tccccgcggtggcggccgctctagaactagtggatcccccgggctgcaggaattcgtctcacccctagaaaaaacgaatccctgttctgcgctcaacgccgcaccgaacctgactcaggcactcaccagtcaccaccgctatgggcggcgaccatggcggtgggcacgccggcggtgacttccgccagaaggtatggagcatgacgggcggaccctactgccgcccggtccactggcgccataacaccgccatcgccatgttcggcgtcttcctcatctgcattcccatagccatgaagtccgccgagctcgagcaacgcccgcatcacccagtccggccaatcccatctcaactgtggtgcaaaaactttggcaaggaatactngaggacccttccagtagcatgaagcgcggacacccttgcttttgccnntcttttgatctctttctcttttggctcattcatgttatatgataaataaaaataaatattgaactcaaaaaagaaaccgtggattccaaaaaaaaaaaaaaaaccagaacccttcgaggaccccattccccccataagggaaccgtatttcccccccctccttgcccggcttttaaaaagtgggggattggaaaacc

SEQ ID NO: 64149 - protein, 88 aa, Zea mays
  misc_feature: Ceres CLONE 1533158
  misc_feature (82)..(82): Xaa is any aa, unknown, or other
MGGDHGGGHAGGDFRQKVWSMTGGPYCRPVHWRHNTAIAMFGVFLICIPIAMKSAELEQRPHHPVRPIPSQLWCKNFGKEYXRTLPVA

SEQ ID NO: 64150 - DNA, 649 bp, Zea mays
  misc_feature: Ceres CLONE 1533161
  misc_feature: Encodes the peptide sequence at SEQ ID NO. 64151
  misc_feature (591)..(591): n is a, c, t, g, unknown, or other
ggctccccgcggtggcggccgctctagaactagtggatcccccgggctgcaggaattcgtctcacccctagaaaaaccccaattcccgtccatcagctcgcaccagcgaccagagcagcagaccaagcaagcgcgagggagagaagagacgaagaagaaaagaaaagccggagctctgccgagcttagtccgcggaggcggcgaccggcgacgcgtaaccatggagcgggcggaggaggcgcagcccgccgccgagcggagggcgccctcgacggcgccgtcggcgcgggtgtcgatctgggagtcggtacgcgcgtgcggggtgtgggggaaggagctggacaaggccgagctgtggaggcaggtcgtcatgccacgctacctgcgccgggccgtcgcggccgccgtcaaggccaaggacgaggccgccggcgtggcggtggcggcggcggccgcggaggaccgcgcgggggaggacgccgacggcccggcggtggcgccccgtgggtggggtgtcgtcactcgcgcagtggcgggcgccacgggcccgagctcaaagtgcggctgcacgagctcatcaccgaggagcanggtcttgatccttcaggtgtgaagcttcagattttgttcacaatgttttgaggtgttt

SEQ ID NO: 64151 - protein, 130 aa, Zea mays
  misc_feature: Ceres CLONE 1533161
  misc_feature (124)..(124): Xaa is any aa, unknown, or other
MERAEEAQPAAERRAPSTAPSARVSIWESVRACGVWGKELDKAELWRQVVMPRYLRRAVAAAVKAKDEAAGVAVAAAAAEDRAGEDADGPAVAPRGWGVVTRAVAGATGPSSKCGCTSSSPRSXVLILQV

SEQ ID NO: 64152 - DNA, 698 bp, Zea mays
  misc_feature: Ceres CLONE 1533162
  misc_feature (432)..(432): n is a, c, t, g, unknown, or other
tccccgcggtggcggccgctctagaactagtggatcccccgggctgcaggaattcgtctcacccctagaaaaatgaaggatgtctcgccgctctgtgctgctgctgcctcatagacgagtgctgctgcgacccgtcggtgatattcgtgagctgatccgagggcagtccgcagcacatgccatgcccacgtcccagcccaagagacatgtcccatgcctccgtgtgtgttcgcatgcccctcgcgcctctgttggcgacacattatgtttttttttttgcccctggggggggggggggaagtccagcccgtgttttgtgcattccaaaataggggttaaagatgaaaaatttttttcccccccccccgggggaaagtaaggggggccttttttttttttcaacccacttttatggcttcacaataatctaanaactacgttgaggggggtcggaagatagagacgcaccccgcccctcccccgcttgtcagggtattatttatggagtccttattggcgccctccgttgttttgacggttcgcgaactatcgcgagcgctggtatagcgattctcgctgcgcccccccgcttgtcgcgcccttagtgagcgatggcccgttgtctcctccgtgccgcgcggcgcgctcccccgctcagctgcccgctccccgcccgcccccctccgcacctccgcggg

SEQ ID NO: 64153 - DNA, 687 bp, Zea mays
  misc_feature: Ceres CLONE 1533165
  misc_feature (279)..(279): n is a, c, t, g, unknown, or other
tggagctccccgcggtggcggccgctctagaactagtggatcccccgggctgcaggaattcgtctcacccctagaaaaaacagcgcgcggcctagctcgccttgcggaaccgcatcacgcacgccagcagctagccaagagcagccagcagatggaaaacacggcccccgccgccgccctcggcacgatccagatcgcccggcaccggacgagcgccctcaagctgtgctaccacctggcagtctccaacgcgatgtatctccctctaggccccgcggncgccggcggcggcgcaatggctctcccgcccaagcgcggccgaacctcccgggctcggcccggtccgggggcgccgccaaaccggccccttgccgtgggcctcccgggccctggggccgggggtctccaaaaggggttactgatggggggccccccgccggggggggacccctgggggaaattcgggggggtaaaaacccccggggggaaaaaaaactgggggaacccgggggaaaaattttttggggcaatccaagagggggggggggggtgtttacggggggaaaaaaccgggggttttcccccaaaaaaatctcgggaggcccccggcgcctggaagggggcaccccctttccccaggggggggggtgaaattaccgccccccccccggggggggggggggaagg

SEQ ID NO: 64154 - DNA, 723 bp, Zea mays
  misc_feature: Ceres CLONE 1533179
  misc_feature: Encodes the peptide sequence at SEQ ID NO. 64155
cccccgggctgcaggagttcgtctcacccctagaaaaaatgtttcggttgcgtcaggtcagcctccctctccggatcccccatctgctccgccgccggccaacgcatcgctccccttggcagccaggatgacagaagcaccatttctgccacgtgagaggctcttcaagctgcaacatcatttccagaacatgaccaagcacacctacctgaaagggcgctacgatgtgatcacctccgttgccatccctcttgcacttgctgcctccagcatgttcatgattgggcgtggagtttacaacatgtctcatggaatttggaagaaaggagtgatctacccacgggttaactagttttgtttagttggcccccccagtcccattccaaactatgaaagccttcctttgcttggttaaataatacttgttcaaagaaaaaagtccaactaaaaaaaaaaaaaaaaaaaacgagaacgcctcagggggacccaaatttcccccctaaaggggggtccaaatagccggcgcgctccctgggcccgtcttttttaaaaacgttccggagatggggaaaaaaacctggggggttttccccaactctaaatcgcctttgggagaaaaaacccccccttttcccccctctgggggaaaataaccacaaaagggccctcccccatatacacccttttacccaaaaattgagccaaaaccgggaagggggagaa

SEQ ID NO: 64155 - protein, 74 aa, Zea mays
  misc_feature: Ceres CLONE 1533179
  misc_feature (9)..(62): Pfam Name: COX7a Pfam Description: Cytochrome c oxidase subunit VIIa
MTEAPFLPRERLFKLQHHFQNMTKHTYLKGRYDVITSVAIPLALAASSMFMIGRGVYNMSHGIWKKGVIYPRVN

SEQ ID NO: 64156 - DNA, 455 bp, Zea mays
  misc_feature: Ceres CLONE 1533180
  misc_feature: Encodes the peptide sequence at SEQ ID NO. 64157
  misc_feature (383)..(383): n is a, c, t, g, unknown, or other
  misc_feature (420)..(420): n is a, c, t, g, unknown, or other
ccgcggtggcggccgctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaacaaaaggaaggtgaagagcagcaaacaggcggcggcggccaaaaagtgacgtacagtacgtggtggagtggtatgggagccttccatgcatngaggtgaatcccatggccatggttatgaaatctaagnccctttccctttcctgggaatccttcccatggtgg

SEQ ID NO: 64157 - protein, 51 aa, Zea mays; identical to SEQ ID NO: 19222
  misc_feature: Ceres CLONE 1533180

SEQ ID NO: 64158 - DNA, 665 bp, Zea mays
  misc_feature: Ceres CLONE 1533181
  misc_feature: Encodes the peptide sequence at SEQ ID NO. 64159
  misc_feature (325)..(325): n is a, c, t, g, unknown, or other
  misc_feature (326)..(326): n is a, c, t, g, unknown, or other
tggcggccgctctagaactagtggatcccccgggctgcaggaattcgtctcacccctagaaaatagagatggagaggaagcttgcaaaaaagctcaagttgaagaaaggaaagttgggaggtcctgatgatggtatggatgacctttttgcggaccttgggtttggtggtgactttggttcagatgatggtgaaacaaaagcatatgattggaatgtggtggaggacactaatttagacaagagaaaaggtaaaaagaaaaataaggagaaaaaggatgacacagtgatggaggaaccagatgacattgatgaagagaatggtcnnggaaagaagaaaaaaaagaagaaggatcgtatggagaaagaggaactggttgatgtaggtgaaagagactccccataaaaaaaaaaaaaaaacgagacgctcgaggtacccaattcgccctatagtgagtcgtattacgcgccctccctgggcggccgtttacaacgtcgtgactgggaaaacccgggctttccccaacttaacccctttgaaaccatcccccttttccccggtggggtaaaaaccaaaaaagccccccccgtttcccccttcccaaaaatttgccccccccgaaagggcaaaagggaaattgtaaaccttaatattttttgaaaaaat

SEQ ID NO: 64159 - protein, 111 aa, Zea mays
  misc_feature: Ceres CLONE 1533181
  misc_feature (86)..(86): Xaa is any aa, unknown, or other
MERKLAKKLKLKKGKLGGPDDGMDDLFADLGFGGDFGSDDGETKAYDWNVVEDTNLDKRKGKKKNKEKKDDTVMEEPDDIDEENGXGKKKKKKKDRMEKEELVDVGERDSP

SEQ ID NO: 64160 - DNA, 686 bp, Zea mays
  misc_feature: Ceres CLONE 1533186
  misc_feature: Encodes the peptide sequence at SEQ ID NO. 64161
ctccccgcggtggcggccgctctagaactagtggatcccccgggctgcaggaattcgtctcacccctagaaaaaactcctaaccctcgcccgagtcagatctatctgccccgcgccaccgtcgccatgccgttcactcctggtccctactctggcgtcagcaccctcgcccttgtagcgagggcatcggtcttctgcttcggtgtcgtctacggtagcatcaagctctcaatcctcaaggcaacagagcctaaaaatgaagaagcgcatgctcatcactaaggacgacagggctgctacatgttaatttctatggaaggatgatatagaactgtggttgcactctttctccatacatgcaatttaatttatgatttgtggacatcttgctgtaacacacctgctgacttatcttagttttgtgtcataaaaaattcttaaccaatgacttgaaatcacgaaaggcaaaattccaaaaaacccccttttgttttggaaaagaaaaaaaaaagaggggcccccgaagggacccaattttccccaaatagtggcgccgtttttaaaggccgaatcgccgggacgttccgtcttaacaccccttctcgaacagagaaaaaaccccctgcgcttttaacccgaacattaaaatcccccccttggcaagcaaacaatccccccccttttcca

SEQ ID NO: 64161 - protein, 51 aa, Zea mays
  misc_feature: Ceres CLONE 1533186
MPFTPGPYSGVSTLALVARASVFCFGVVYGSIKLSILKATEPKNEEAHAHH

SEQ ID NO: 64162 - DNA, 703 bp, Zea mays
  misc_feature: Ceres CLONE 1533188
  misc_feature: Translation starting site: 117
ctggagctcaccgcggtggcggccgctctagaactagtggatcccccgggctgcaggaattcgtctcacccctagaaaaatagcgtccactagctactagctagctagcatcagtcatggaggatggcgccgagaaggcgacgacaccggattcttcttcttcgcaagcggcaccgccagcgctgagcgcggtgtacgtgaataggcccctcgtggcgggcaaccgcgccatggccgccgtccacgtcgcgctggtcgccacggtcatcggccagcgcgccctggcgctgctctctgctggaaccagcagcgcgtcgtccgcgtcccggtccctgcaggtgcagcacgtggccatggcgctggccgacctgacgctgctgttcctgtgggcgctgtcgcagtcggggctgtggcgtcccgtgacgcgtgccgcgttccggggccggctgctggcggcggtgccccgcggcgcgctcccgcgcgtggacgtgctggtggtgacggccgacccggacaaggagccgcctcctcggggtggtgaacccggtgctgtcggcgatggcgctggactaccccggcggcaagctgagcgtgtacctgtcggaccaacgccgggtcgccgctcacgctgctccccgcccgtaaggcctaaccctttcctgccagggcctgggggccttctcgcaggaggcctcagtggagg

SEQ ID NO: 64163 - DNA, 586 bp, Zea mays
  misc_feature: Ceres CLONE 1533190
  misc_feature: Encodes the peptide sequence at SEQ ID NO. 64164
  misc_feature (195)..(195): n is a, c, t, g, unknown, or other
  misc_feature (196)..(196): n is a, c, t, g, unknown, or other
  misc_feature (202)..(202): n is a, c, t, g, unknown, or other
  misc_feature (215)..(215): n is a, c, t, g, unknown, or other
  misc_feature (218)..(218): n is a, c, t, g, unknown, or other
  misc_feature (225)..(225): n is a, c, t, g, unknown, or other
  misc_feature (235)..(235): n is a, c, t, g, unknown, or other
  misc_feature (239)..(239): n is a, c, t, g, unknown, or other
  misc_feature (264)..(264): n is a, c, t, g, unknown, or other
  misc_feature (515)..(515): n is a, c, t, g, unknown, or other
  misc_feature (522)..(522): n is a, c, t, g, unknown, or other
ccccgcggtggcggccgctctagaactagtggatcccccgggctgcaggaattcgtctcacccctagaaaaatcctctcgctcgccaggagaagcagccgccgttgctgctgccgcgtccacagaatggggggtttcgtgaagactcataagaccatgcgtatttcaacgtttcaagtgaaatttcagagaagcnnggctgncagacagactacnggnccagatnaggctgattnaccnagacaaacaagtacacccacccaantacagatttgttgtgcgatttacaacaaagaaatccctgccaaatcttttctgctatttaaagcggggaaatggttcttgctccgcccaccccctgagattcccccaaatggccttgaaattgggctggacaaattttgacgttcccccttggcccgggggaattttttttttttggggcgcccccccccccccggggtgggggtaaaaaaaaaaaaaaccacccccgggttgttgttttttttttttttntaagaanaaaaatttttttttatggaggggggtgtgtttttttttttttttccccccccccccccccccct

SEQ ID NO: 64164 - protein, 92 aa, Zea mays
  misc_feature: Ceres CLONE 1533190
  misc_feature (24)..(24): Xaa is any aa, unknown, or other
  misc_feature (26)..(26): Xaa is any aa, unknown, or other
  misc_feature (34)..(34): Xaa is any aa, unknown, or other
  misc_feature (37)..(37): Xaa is any aa, unknown, or other
  misc_feature (47)..(47): Xaa is any aa, unknown, or other
MGGFVKTHKTMRISTFQVKFQRSXAXRQTTGPDXADXPRQTSTPTQXQICCAIYNKEIPAKSFLLFKAGKWFLLRPPPEIPPNGLEIGLDKF

SEQ ID NO: 64165 - DNA, 708 bp, Zea mays
  misc_feature: Ceres CLONE 1533191
  misc_feature: Encodes the peptide sequence at SEQ ID NO. 64166
  misc_feature (208)..(208): n is a, c, t, g, unknown, or other
  misc_feature (231)..(231): n is a, c, t, g, unknown, or other
  misc_feature (238)..(238): n is a, c, t, g, unknown, or other
  misc_feature (571)..(571): n is a, c, t, g, unknown, or other
ctggagctccccgcggtggcggccgctctagaactagtggatcccccgggctgcaggaattcgtctcacccctagaaaactctctgtcgcggagccgccgcaacccagcgtcccccgaagtctaaccctagatccggaccggccatggcgtcccgccgggtcgtctcctcgctccctcgctcccgcgtccgcctgcgggccgcctcgnccgctgctccacgcccgcgcgcngccacgnaccggccgtccccgggcgggtacctctttcaacgggctggcgcctacgcctcttcccgcgcggggcccaaggggggaccctggcaccccggcgcccgccacccggaaaaaccgggggccgccagatacccgaacaagtttcccgggcctgggggcatttggccaatgtggccagggggacagcggccccccctttaaaagggcctttcatgaagggctccccccccattcttcccgggggttttagggggtttaaaaaaaaaattctcccctttggtttaagggggggcccccaccctttttggaaaaaaatatggggggcccccaacctccntttctttttttttttataacgggggccccccccccccaaaaggagtgttgttcccccgggcgaaaaggggctttcaaaaaaaggggtcccccccccaaacagggcccgttttgggggggggtccccccttgggaaca

SEQ ID NO: 64166 - protein, 96 aa, Zea mays
  misc_feature: Ceres CLONE 1533191
  misc_feature (22)..(22): Xaa is any aa, unknown, or other
  misc_feature (32)..(32): Xaa is any aa, unknown, or other
MASRRVVSSLPRSRVRLRAASXAAPRPRAATXRPSPGGYLFQRAGAYASSRAGPKGGPWHPGARHPEKPGAARYPNKFPGPGGIWPMWPGGQRPPL

SEQ ID NO: 64167 - DNA, 647 bp, Zea mays
  misc_feature: Ceres CLONE 1533192
  misc_feature: Encodes the peptide sequence at SEQ ID NO. 64168
  misc_feature (464)..(464): n is a, c, t, g, unknown, or other
ggatcccccgggctgcaggaattcgtctcacccctagaaaaactccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaagtctaccgccgccgctgggtcatccacgtcgagcggatcacccgcgagaaggtgaacggctccaccgtgaacgtgggcatccacccctccaaggtgatcgtcactaagctgaagctcgacnaggaccgcaaggcgctcctggaccgcaaggcccggggccgcgccgcccgacaaggctaagggcaagttttatgccgaggaacgtcactgccgccgccggttgtgggggtcggcatccggggccctcttccccacggaaaatcaactagggctttttcccggttcatctgaatgggttgtccca

SEQ ID NO: 64168 - protein, 130 aa, Zea mays
  misc_feature: Ceres CLONE 1533192
  misc_feature (51)..(82): Pfam Name: KOW Pfam Description: KOW motif
  misc_feature (112)..(112): Xaa is any aa, unknown, or other
MKRNPRVTSSRRKCRKAHFTAPSSVRRVLMSAGLSTELRHKYNVRSIPIRKDDEVQVVRGTYKGREGKVVQVYRRRWVIHVERITREKVNGSTVNVGIHPSKVIVTKLKLDXDRKALLDRKARGRAARQG

SEQ ID NO: 64169 - DNA, 732 bp, Zea mays
  misc_feature: Ceres CLONE 1533194
  misc_feature: Translation starting site: 362
  misc_feature: Pfam Name: DIE2_ALG10 Pfam Description: DIE2/ALG10 family
  misc_feature (708)..(708): n is a, c, t, g, unknown, or other
aagctggagctccccgcggtggcggccgctctagaactagtggatcccccgggctgcaggaattcgtctcacccctagaaaaaatcagagactgaccagagccgagacgaaggatgctgtctgctgtgcactccggcggccggaccacggcgagtccgggacgtagatgtcgccccgcccctccggatcgtgttgctcgggaaattgcttccgagtagttcccgacgccgcgggcctctaagccgctgcctccgacagtctcgtgagtccttgactcttgagaatcgagggaacgcatttaccgacaccagactggatctgaagaggcgctgacgaattggagggccgcgcaagcctggggatgggaaggctggtcgtcccggccgccgtggacgtgtgggcgttccacattgccgctttggtgaactccgtagtgccagagccgtacatggatgacatcttccttatttcacaagcacaggagtattgcctgtggagatttctgagaatgggatcccatgatcaccacccctcctggtctgtattatgtttcactagcataaatagcttctgtctttcctgttgcctggatgtgtcgggtagcaaaggagtctgatgttctttgctccacagcaggtctgagatcaactaatgttatcttgaggatggtctgcgctgttcttattcatgacctgcttctgtgctccnatcaggaattggacaacgaatgca

SEQ ID NO: 64170 - DNA, 631 bp, Zea mays
  misc_feature: Ceres CLONE 1533202
  misc_feature: SWISSPROT Homolog: EC 3.2.1.23 Beta-galactosidase
ctccccgcggtggcggccgctctagaactagtggatcccccgggctgcaggaattcgtctcacccctagaaaaaacttacctggacggggtcgacgagcgatcatcaaggctcgtggcctaggccaatggcccacattgcacttggtgggtgcgttggcttaccatctccccaagtgggagagtggacgtcataatttgtgatagagggggtatgcgttcgcgcggccctgctcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatacaccgagatagggttgagtgttgttccagtttggaacaagagtccactattaaaga

SEQ ID NO: 64171 - DNA, 699 bp, Zea mays
  misc_feature: Ceres CLONE 1533204
  misc_feature: Encodes the peptide sequence at SEQ ID NO. 64172
  misc_feature (650)..(650): n is a, c, t, g, unknown, or other
  misc_feature (699)..(699): n is a, c, t, g, unknown, or other
ctggagctccccgcggtggcggccgctctagaactagtggatcccccgggctgcaggaattcgtctcacccctagaaaaaaccggccccattcctccacccgccactataaatctctctgcttccgaccagccttgcttcgcccgttccagcgacgcactactgcggcgaaatcccgctcccgcgttccccatcctccggccgcctcgcttcggcctccctccggaaggtgtcttaaatcatggcgactggccaacttttctcaaaaactacccaagcattattctacaattacaagcaacttcccatccaacggatgcttgattttgacttcctctgtgggagagaaacaccttctgttgctggaataatcaatcctggttctgatggttttcagaaacttttctttggacaagaggaaattgctattccggttcatcccacagttgaagctgcatgcagtgcacacccaacagctgatgtatttatcaactttgcatccttccggagtgctgctgcttcttcaatgtcagctttgaagcagccaacaataagggttgtagccattatcgctgagggtgttcctgaatcagatgccaagcagctaattagttatgcacgtgctaataacaaagtcatcattggacctgncacagttggaggaatttcagctggtgctttcaagattggtgataccgcn

SEQ ID NO: 64172 - protein, 153 aa, Zea mays
  misc_feature: Ceres CLONE 1533204
  misc_feature: SWISSPROT Homolog: EC 2.3.3.8 ATP citrate synthase
  misc_feature (137)..(137): Xaa is any aa, unknown, or other
MATGQLFSKTTQALFYNYKQLPIQRMLDFDFLCGRETPSVAGIINPGSDGFQKLFFGQEEIAIPVHPTVEAACSAHPTADVFINFASFRSAAASSMSALKQPTIRVVAIIAEGVPESDAKQLISYARANNKVIIGPXTVGGISAGAFKIGDTA

SEQ ID NO: 64173 - DNA, 634 bp, Zea mays
  misc_feature: Ceres CLONE 1533208
  misc_feature (307)..(307): n is a, c, t, g, unknown, or other
  misc_feature (308)..(308): n is a, c, t, g, unknown, or other
  misc_feature (388)..(388): n is a, c, t, g, unknown, or other
ctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccnngacctgtcgcaccacgaggcgcccgtcacgagtcgggttgttggggaatgcagcccaaatcggggcggtaactccgtccnaagctaaaaaaaaaaaaaaaacgagacgctcgaggtacccattcgccctatagtgagtcgaattacgcgcgcttactgcccgtcgttttacaacgtcgtgactgggaaaaccctgcggttcccaatttattggctttgaagcaaatcccccctttgcccaggttggctaaaaacgaaaaaaggccgccaccgattgcccttccaaaaattttgccccccccggaatgggaaaagggaaatttgtaa

SEQ ID NO: 64174 - DNA, 726 bp, Zea mays
  misc_feature: Ceres CLONE 1533213
  misc_feature: Encodes the peptide sequence at SEQ ID NO. 64175
  misc_feature (351)..(351): n is a, c, t, g, unknown, or other
  misc_feature (445)..(445): n is a, c, t, g, unknown, or other
  misc_feature (726)..(726): n is a, c, t, g, unknown, or other
acccgcggtggcggccgctctagaactagtggatcccccgggctgcagggattcgtctcacccctagaaaaaaaccgaggaacctcccactctcgccaccgtgtggtccagacgaccagtgctctaacccaaccaggaagcaccaggcagcggaagctcgcgctgggatcggctaccaacaataatatcgttccccgcctccctcacctctgaacgagaacgcgaacgcgccctgtgatcactaccccacagcatgtgctcaggacctcgcaagccgtccacaccccctctgccggcggcgacggccaaggactcctcggcgatggcggtgctgctggagctggcgggggnggacgacgtcgtggggttcaggcgcgccgtggagggcgacaaagccccagccttggacgacgcgggtcaatggtacggcccgtccgccgcgggncgcggccgcctccgcctgcgcctcgagggcgcgcactccggccatggtggccgcgctctacagcagcacggcggtgctggaatacatgctgtcccgccacgccggcagatgccgcgcagccccccccccacggacggagccacggccgctccaactggaggcgggccagggggcgcccgggccgcctttcccggccccccacctggttcatagggctctgggggcgtccgccggacgccgctcgcttttcgtacgggggcttcccaacgcggacaaacctn

SEQ ID NO: 64175 - protein, 134 aa, Zea mays
  misc_feature: Ceres CLONE 1533213
  misc_feature (33)..(33): Xaa is any aa, unknown, or other
MCSGPRKPSTPPLPAATAKDSSAMAVLLELAGXDDVVGFRRAVEGDKAPALDDAGQWYGPSAAGRGRLRLRLEGAHSGHGGRALQQHGGAGIHAVPPRRQMPRSPPPTDGATAAPTGGGPGGARAAFPGPPPGS

SEQ ID NO: 64176 - DNA, 665 bp, Zea mays
  misc_feature: Ceres CLONE 1533227
  misc_feature: Encodes the peptide sequence at SEQ ID NO. 64177
  misc_feature (661)..(661): n is a, c, t, g, unknown, or other
ctccccgcggtggcggccgctctagaactagtggatcccccgggctgcaggaattcgtctcacccctagaaaaaatgcctcccaccccctcatcacttgcattgagcaccacgtcgtcgagctatctgaccacaagtgctactaagctagccaccacctcctataggagtataggctataggcctatagctaccagagccgccagctgccagagctgtagctcagctagctagtaggagagtaggaggtcgtctggttgttggctgctgtgccattgcgacggcgcgcggccggcgggccggggagcgacagcgcgagtcggagacagacagagaggttactactctgcttgtacgtgcactacaaataaagtacagatggtgacggccaaggaggccgcggcggcggcggcggcggccatggacgctagcaagtacgtgcggtacacgccggaacaggtggaggcgctggagcggctctactacgagtgcccgaagccgagctcgctgcgccgccagcagctggtccgcgactgccccgtcctcgccagcgtcgacccaagcagatcaaggtctgggtccagaaccgcaggtgccgggagagcagcggaaggagtcgtcccggctgcaggcggtgaaccggaagctgacggccatgaacnagct

SEQ ID NO: 64177 - protein, 96 aa, Zea mays
  misc_feature: Ceres CLONE 1533227
  misc_feature (95)..(95): Xaa is any aa, unknown, or other
MVTAKEAAAAAAAAMDASKYVRYTPEQVEALERLYYECPKPSSLRRQQLVRDCPVLASVDPSRSRSGSRTAGAGRAAEGVVPAAGGEPEADGHEXA

SEQ ID NO: 64178 - DNA, 807 bp, Zea mays
  misc_feature: Ceres CLONE 1533228
  misc_feature (296)..(296): n is a, c, t, g, unknown, or other
  misc_feature (304)..(304): n is a, c, t, g, unknown, or other
  misc_feature (323)..(323): n is a, c, t, g, unknown, or other
  misc_feature (327)..(327): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (343)..(343): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (394)..(394): n is a, c, t, g, unknown, or other
  misc_feature (395)..(395): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (410)..(410): n is a, c, t, g, unknown, or other
  misc_feature (411)..(411): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (472)..(472): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (503)..(503): n is a, c, t, g, unknown, or other
  misc_feature (508)..(508): n is a, c, t, g, unknown, or other
  misc_feature (510)..(510): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (537)..(537): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (545)..(545): n is a, c, t, g, unknown, or other
  misc_feature (546)..(546): n is a, c, t, g, unknown, or other
  misc_feature (548)..(548): n is a, c, t, g, unknown, or other
  misc_feature (552)..(552): n is a, c, t, g, unknown, or other
  misc_feature (553)..(553): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (577)..(577): n is a, c, t, g, unknown, or other
  misc_feature (578)..(578): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (591)..(591): n is a, c, t, g, unknown, or other
  misc_feature (608)..(608): n is a, c, t, g, unknown, or other
  misc_feature (609)..(609): n is a, c, t, g, unknown, or other
  misc_feature (618)..(618): n is a, c, t, g, unknown, or other
  misc_feature (623)..(623): n is a, c, t, g, unknown, or other
  misc_feature (624)..(624): n is a, c, t, g, unknown, or other
  misc_feature (626)..(626): n is a, c, t, g, unknown, or other
  misc_feature (631)..(631): n is a, c, t, g, unknown, or other
  misc_feature (633)..(633): n is a, c, t, g, unknown, or other
  misc_feature (653)..(653): n is a, c, t, g, unknown, or other
  misc_feature (657)..(657): n is a, c, t, g, unknown, or other
  misc_feature (660)..(660): n is a, c, t, g, unknown, or other
  misc_feature (665)..(665): n is a, c, t, g, unknown, or other
  misc_feature (669)..(669): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (688)..(688): n is a, c, t, g, unknown, or other
  misc_feature (690)..(690): n is a, c, t, g, unknown, or other
  misc_feature (709)..(709): n is a, c, t, g, unknown, or other
ttatctccctccctcccttcataaatattttcctttcccttcttataatataaatttgaactccctgcggtggcggccgctcttttactagtggatcccccgggctgcaggaattcgtctcacccctagaaaaatatgaatgctttatgttgtgctttcaagttgataacttgtggcaacaggagattttgctttacgtaggcaatatattgagaagctactcttactcatccaccatgaataatctttgctgcattgaaacttcatgtacgcaaacaatgcaaacgttgtacttntttcaagnaattgagtagatgaagttntacntctgctgnnnccgaangttgaaggcggtacttgctggattggtaaaatttccgggcttnnnngtttnngttgnnnntggttgnnttttggggggggggggggggnnnattcgggtgtgtttgttgtttttgttttgttcccccgnccgcnnnnnnannnnnngnnnnnannnnggnctgtngntgnnnnnnnnnnagacgannngggganannnnttnnanaatnngnnnannnaaaaannncnnntggnnggaagaannntanatttattcccaattggnngtaatttgntattnnanggcgncntaacagaataggtcggtttntccnccnctgtngtgntaaggnnngccggttgttncntacgcaatactctatgagntgtaataaaaatatctgctttgccttctcccattagaaactgatgaggatgaaatactattattattttttgaaaagaagatacacacgtgacataca

SEQ ID NO: 64179 - DNA, 576 bp, Zea mays
  misc_feature: Ceres CLONE 1533236
  misc_feature (279)..(279): n is a, c, t, g, unknown, or other
  misc_feature (285)..(285): n is a, c, t, g, unknown, or other
  misc_feature (291)..(291): n is a, c, t, g, unknown, or other
  misc_feature (297)..(297): n is a, c, t, g, unknown, or other
  misc_feature (339)..(339): n is a, c, t, g, unknown, or other
ctccccgcggtggcggccgctctagaactagtggatcccccgggctgcaggaattcgtctcacccctagaaaaatctatgtcatgtgggctcatctcttccttatcgacgctgtggccgcccagccgcccacgttgcctcctccctgagacaatccccacgccaccgcgcaccggagacgaacctgaggagagaaaatctgcgcccgtcagtgtgctcgcctacttctacgctccgctcgttccccaaatagttcctcggcttcgctcccttccctccntgctcnggctcnggtcgnacacagtaagaaaagatggcgctgccatccatgagtcttgcngcaaagggtgtgcttccttcctaacaacgtacctcggggggtggtcaccaaaagccgggtttaatgacccgcttccttgaaggccaaaaaccgcgatgcccgaaagggagtccctaaaacttgcccttggggaacctttggaattggactggcccccccttgttgggggcctaaaaaaccccccccctaaagagcaagggggttccgccccccgggaatgcctttttccggggtccc

SEQ ID NO: 64180 - DNA, 693 bp, Zea mays
  misc_feature: Ceres CLONE 1533237
  misc_feature: Translation starting site: 253
  misc_feature (532)..(532): n is a, c, t, g, unknown, or other
  misc_feature (539)..(539): n is a, c, t, g, unknown, or other
  misc_feature (545)..(545): n is a, c, t, g, unknown, or other
ctggagctcaccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagccctgctgcgtcgccgcccatgaagctccccatcatcgggcacctgcacctgatgggggaacatcccctangtgtccntggccngggtcggcaacaagtacggcccggacctgatgctgctccgcctcggcgcgtgcccaacggggttggtcttttcccccgcggtccccaaggcggtgttccgaacctaaaacaatttttcccccccggcccggcccccgggggccaaaat

SEQ ID NO: 64181 - DNA, 710 bp, Zea mays
  misc_feature: Ceres CLONE 1533242
  misc_feature: Translation starting site: 225
ctggagctcaccgcggtggcggccgctctagactagtggatcccccgggctgcaggaattcgtctcacccctagaaaaaactctctctcgcgtcgggcacgcagtcgcacaagtagtgaactcaaacgggatctcctgctctgcctccctcgtcttcctctgcccgtgcgcgtttcagagcacgtacggagagggcgagcagcagcttgcggccgggcaccatcatggaggacgtcacgccgggtgcggagccgtgggaggggtacgtggactggaggaaccggccggcgaccaggtcccggcacggcggcatggccgccgcctccttcatcctcgtggtggaggtgctggagaacctggcgttcctggcgaacgccaacaacctggtgacctacctgatggggttcatgcactactcgccgtcgcagtcggtcacggcggtcaccaacttcatgggcacggccttcctgatcgcgctcctcggcggcttcctctacgacgccttcttcaccacctacaccatctacatcgccagcgccttcatcgagctcatggtacgggctggtgatcctgactgtacatgcacggacgcagtcactgatgcttgcgcagtgcgccaagccgggtgcttcgtgctacgccgtgtcgggcgccaactatgcgatgctgtgctcgggtctgtacatcacagcactgggcgtgggcaggat

SEQ ID NO: 64182 - DNA, 721 bp, Zea mays
  misc_feature: Ceres CLONE 1533248
  misc_feature: Translation starting site: 515
  misc_feature (536)..(536): n is a, c, t, g, unknown, or other
  misc_feature (626)..(626): n is a, c, t, g, unknown, or other
aaactggactcaccgcggtggcggccgcccagaacaaggggacccccgggcggaaggaatcgtctcaccccagaaaaagggggagagaggccgaagggggaaccaggaagttgacgaccaagcgcgacaccgagtccggaaggcgaaggctcaaccccgtcggtggtggcgcgaatccgccgcccctagccgccgccccctgtcgtatgcctcctccgctccgccggggaattcggtggcggcgccttcgttggatccatcttcggatatggacaaggcttgatcaccaagaagggttttaagggctcattcagcaatgcagggtcctctgccaagacttttgcaattctctctggcgttcagagtttggttttgtgcttgttgcgaaggctacgtggcaaggatgacattgtcaatgctggtatagctggttgttgtactggcctcgctttgggctttccaggggcgcccaggcttgctccaagctgtccaccttcgcgcattctcatgcatcatggagggctcaataagcacangctgcaatggctccacgcttggagggactgccgcgatggcgtgcatgagaaaaatgtgtgttctgcccccgttcacgcttccacctattnctgatgcatctgatgctttagcttcatgcctgcctagcgttagtaaagcctaagcactagactacacaaatagagggcgtgagcgattgccaaaa

SEQ ID NO: 64183 - DNA, 680 bp, Zea mays
  misc_feature: Ceres CLONE 1533251
  misc_feature: Encodes the peptide sequence at SEQ ID NO. 64184
  misc_feature (680)..(680): n is a, c, t, g, unknown, or other
tcccccgggctgcaggaattcgtctcacccctagaaaaatctgtgcttgcataataaatcgaagaaatcctgacaccaatcgaactgaagatcctgaaacgcacgttaataccgttgacgtccgcttcacccagctcgattttcagtcttgtaataataattgagaactccaatgaactgagagttactaatcgctccatgagtctgaagcgtgcaaaaatttaggtcgcagctacacaaatttacacgctgttctatattctatattctatattatatttaggtcgcaactacccgtgaatctcctattttgaaaaggtccccgccccgcttatttcgggcgatatttctatattatatttgttgaaccaacaagcctgcttttaattgctttccgaactcatggttagataattggtttacattttcctacaattccgtactgggactaaatttgctttggggactagaagggtaaaaaaaaaaacggatacgcttcgaaggggaccccaatttcgcccctaataggggacgtcgttattacgcgccggctaaattggggccggcgtttttacaaaccgtccgtggacacgggcaaaaccccagggacgttacccacaaacttaaaacgcactttggaagaaatattccccccttttgcggcgggatgggggcgtaan

SEQ ID NO: 64184 - protein, 53 aa, Zea mays
  misc_feature: Ceres CLONE 1533251
PRAAGIRLTPRKICACIINRRNPDTNRTEDPETHVNTVDVRFTQLDFQSCNNN

SEQ ID NO: 64185 - DNA, 648 bp, Zea mays
  misc_feature: Ceres CLONE 1533253
  misc_feature: Encodes the peptide sequence at SEQ ID NO. 64186
  misc_feature (396)..(396): n is a, c, t, g, unknown, or other
  misc_feature (397)..(397): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (541)..(541): n is a, c, t, g, unknown, or other
agctccccgcggtggcggccgctctagaactagtggatcccccgggctgcaggaattcgtctcacccctagaaaaagtccttgaaaacctcaagacagttcttgaaagagaaggaacactcgacaagatcccaagctcgatctgccaggccctggaacccaatgaccagaacaagaagaaggctggcaactggatccagaggctgtcatacgctcaacctgctttctccggacctccacccccaaagttactctagttacacgtcttcttgttcttagcagcttggtatctggtactccagatagcaagtgtgtaaattgaatctttcttggtttcgctgggagaccagagatttcttcatggtatatactcggatacagtacatacatcattttnntggggggagtgggagcacagtaaatacttggtttggctatcttaacaaattctatcttgatgatacattagactatgggagcgatatatatgggcctgttttgattnnnnnnnnnnnnnnnnnnnnnnnnnnnnaaacccaaanaaaaaaaaaaaaaaaagggaagagaaaaaaaagcggggcgctcgagtacccaattcgccccaaaggggagtcgtattaccccgccccacctggcccgtcgttttaca

SEQ ID NO: 64186 - protein, 84 aa, Zea mays
  misc_feature: Ceres CLONE 1533253
APRGGGRSRTSGSPGLQEFVSPLEKVLENLKTVLEREGTLDKIPSSICQALEPNDQNKKKAGNWIQRLSYAQPAFSGPPPPKLL

SEQ ID NO: 64187 - DNA, 648 bp, Zea mays
  misc_feature: Ceres CLONE 1533256
  misc_feature: Encodes the peptide sequence at SEQ ID NO. 64188
  misc_feature (306)..(306): n is a, c, t, g, unknown, or other
  misc_feature (316)..(316): n is a, c, t, g, unknown, or other
  misc_feature (405)..(405): n is a, c, t, g, unknown, or other
  misc_feature (406)..(406): n is a, c, t, g, unknown, or other
ctccccgcggtggcggccgctctagaactagtggatcccccgggctgcaggaattcgtctcacccctagaaaactcaatttgatcaaccgccatccattctcctcctccgttgcagctgcggcatccatccagtagtccgaccaatccatggcttcagcgttcgggaccgcctccacttgcggcattaaacatgcacctgccggcgttgcgcttgctgcgcccatgaagcacctttccctcgtctcgccctcgctggtttcgcttccgcgcaagatgaggcccgcgaggaaagtacacttcagggntaacgctgcnaaggagctgcattttcacaaggatgggctcgctatcaggaaaatgcaaaatgggggtcaacagcttgcagatctccgtcgggttactcnntggacaaaggggcgaaatgtaatcctcgaaagcaagtatggctcacctaaaattgtcaatgatggtgtcctgtgggcaaaggaggtggacttgaagaccctggtgaaaaaatttgttgcctaattggggccgcccagcctgctgctaaaacaaatgacatggctgggggatgggacaaacccttccggttgtcctggcccaagggatgattacgggagggggtaaagggttgaaaccccccg

SEQ ID NO: 64188 - protein, 126 aa, Zea mays
  misc_feature: Ceres CLONE 1533256
  misc_feature (53)..(53): Xaa is any aa, unknown, or other
  misc_feature (86)..(86): Xaa is any aa, unknown, or other
MASAFGTASTCGIKHAPAGVALAAPMKHLSLVSPSLVSLPRKMRPARKVHFRXNAAKELHFHKDGLAIRKMQNGGQQLADLRRVTXWTKGRNVILESKYGSPKIVNDGVLWAKEVDLKTLVKKFVA

SEQ ID NO: 64189 - DNA, 651 bp, Zea mays
  misc_feature: Ceres CLONE 1533257
  misc_feature: Encodes the peptide sequence at SEQ ID NO. 64190
ctccccgcggtggcggccgctctagaactagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcagccgccgtcgggggcgccatggtggtggggctcagcccgctcatcgaggccctgtggcgggacagctaagcgctcccgccgggggccggccacgcagcgctcatctgcgacgtgtccgccagactcacatggtaagacctctgcgtcaccgtggctctgggccccagcaagacgcaaacggtgctggactagctcacggggtacccggagcccgggtcgctgacggggcttatggggccatcggggtcggggaagtcacccggatcgaaaccctttgcgggcggctggccgcaaacctttcctttcggtaaacgggttctcaaagggcccaaaggccaattc

SEQ ID NO: 64190 - protein, 54 aa, Zea mays
  misc_feature: Ceres CLONE 1533257
MRRVGGDLQGDGTTPRSAAAGQAMMELQANGSAAVGGAMVVGLSPLIEALWRDS

SEQ ID NO: 64191 - DNA, 688 bp, Zea mays
  misc_feature: Ceres CLONE 1533258
  misc_feature: Encodes the peptide sequence at SEQ ID NO. 64192
  misc_feature (631)..(631): n is a, c, t, g, unknown, or other
caaaactggagctcaccgcgggtggcggccgctccagaccaagtggatcccccggggctgcaggaattcgtcccacccccagaaaaacgtcctgcaccagcacactgcacccggctacatggcggccgcctccaccctcgcgttcgggcacccaaaaaccctagccgccgccggcgccaagcccctgcccgccgccacctccacgtccgtctccttcccggccacccacccagcccgcgtgcctgctctcctcgcccgcgcccgggtctctgcgcccgccgggacgtcgcccccatggtctcccgcgcccgccggccgtcggcacccgccatgccgtcgctcgacttcgacaccctccgtcttcaacaaggagaaggtctccctcgccggccacgacgagtacatcgtgcgcggcgggaggaacctgttcccgctgctttcggaggcgttcaagggggtcaagcagatcggagtcattggatggggctcgcagggtcctgcccaagcccagaacctgagagattcactggctgatgccaagtcagatattgttgtgaagattggtctccggaaaggatccaaatcctttgaggaagcacgtgcccgctgattcaccgagagagcgaacccntgggcgatattttggaaaacgtctccggcagccgatcttgtgttgctgctgatatcc

SEQ ID NO: 64192 - protein, 163 aa, Zea mays
  misc_feature: Ceres CLONE 1533258
  misc_feature: SWISSPROT Homolog: EC 1.1.1.86 Ketol-acid reductoisomerase
MAAASTLAFGHPKTLAAAGAKPLPAATSTSVSFPATHPARVPALLARARVSAPAGTSPPWSPAPAGRRHPPCRRSTSTPSVFNKEKVSLAGHDEYIVRGGRNLFPLLSEAFKGVKQIGVIGWGSQGPAQAQNLRDSLADAKSDIVVKIGLRKGSKSFEEARAR

SEQ ID NO: 64193 - DNA, 715 bp, Zea mays
  misc_feature: Ceres CLONE 1533259
  misc_feature: Encodes the peptide sequence at SEQ ID NO. 64194
  misc_feature (614)..(614): n is a, c, t, g, unknown, or other
aaagctggagctcaccgcggtggcggccgctccagaaccagtggaacccccgggccgccaggaatcgtctcacccctagaaaaagcagcctcctccgtctgctcaagaagagggaggagcagaagaccgaactcctgccgtctccttcctcctccctctgcacccccacgagctccatggccgccacccgccatgattgggattaccaacctacgttgccgccacgacccgctctcctcccttccccgggctacgtcgtcggccgcccggtcctgtacgctgcttcctcctcgatgccgccgccattcttcttgctgctccccttcctcctccgtctctccgtgccgggcccgggtccgaccaacagcagcactgaagcgcatccctgccgccgacaccggcttcatgggtccagccaacaatgaggccacccacgctaaacgatcatcgtcggccgaccctcgccgcccgcctatcgtccccagctccaccgctggcaccggacacgccgccagtgcttccacagaagtgctgcccgccattatcggggttgcgcatctgctcgtgtcgctgggcattctgctcgccaggacaagtccctcagcaggcatccnccgcgcgtccatcaggttccccagtggcccttttccgcagttctgggtcctccccgggccccgaagccttcgaacatttcgggccctccccccccaaaagc

SEQ ID NO: 64194 - protein, 174 aa, Zea mays
  misc_feature: Ceres CLONE 1533259
  misc_feature (141)..(141): Xaa is any aa, unknown, or other
MIGITNLRCRHDPLSSLPRATSSAARSCTLLPPRCRRHSSCCSPSSSVSPCRARVRPTAALKRIPAADTGFMGPANNEATHAKRSSSADPRRPPIVPSSTAGTGHAASASTEVLPAIIGVAHLLVSLGILLARTSPSAGIXRASIRFPSGPFPQFWVLPGPRSLRTFRALPPQK

SEQ ID NO: 64195 - DNA, 683 bp, Zea mays
  misc_feature: Ceres CLONE 1533260
  misc_feature: Encodes the peptide sequence at SEQ ID NO. 64196
  misc_feature (227)..(227): n is a, c, t, g, unknown, or other
  misc_feature (228)..(228): n is a, c, t, g, unknown, or other
  misc_feature (233)..(233): n is a, c, t, g, unknown, or other
  misc_feature (245)..(245): n is a, c, t, g, unknown, or other
  misc_feature (376)..(376): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (533)..(533): n is a, c, t, g, unknown, or other
  misc_feature (559)..(559): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
ctccccgcggtggcggccgctctagaactagtggatcccccgggctgcaggaattcgtctcacccctagaaaaaacaccaccaccaccaccacagcacaggcccactgccaccgctaccgctaaccatggcctcctcagcgtccctgcagcggttcctcctgccctcctcgcacgcggcggcgacggcggcctcgccgtcctcccggctgcgccgcacagggcgcgnncccgncggcggggccgnttctccgtgccgccgccggcggcggcggggggagcaggtcccgacgggagcggctggagcccgagggtcgagggacgcgggcgggcggggtactggggtcccccaaggaaaaagtaacccggccggggggnctgaaacccccgccagggaagaaaagggggaaagcctttgggataaagggagcccccttgcgcccttgtttcatgggagggggggcgttccacggaaactggggccagggggtccccccttgggggggcaaaattgcggggggcnnnccgagcttgncccaagggagaaactccacgggccgncttaaaagtggggttggggcccttttccaccggccgaaaagccccagatagggggggggtttattaagaggnnnnncggcggaagaacgggcccccaaacggggtggttgaaaacccaaaannn

SEQ ID NO: 64196 - protein, 144 aa, Zea mays
  misc_feature: Ceres CLONE 1533260
  misc_feature (34)..(34): Xaa is any aa, unknown, or other
  misc_feature (36)..(36): Xaa is any aa, unknown, or other
  misc_feature (40)..(40): Xaa is any aa, unknown, or other
  misc_feature (84)..(84): Xaa is any aa, unknown, or other
  misc_feature (132)..(132): Xaa is any aa, unknown, or other
  misc_feature (133)..(133): Xaa is any aa, unknown, or other
  misc_feature (136)..(136): Xaa is any aa, unknown, or other
MASSASLQRFLLPSSHAAATAASPSSRLRRTGRXPXGGAXSPCRRRRRRGEQVPTGAAGARGSRDAGGRGTGVPQGKSNPAGGXETPAREEKGESLWDKGSPLAPLFHGRGGVPRKLGPGGPPLGGQNCGGXXELXPREKLHGP

SEQ ID NO: 64197 - DNA, 668 bp, Zea mays
  misc_feature: Ceres CLONE 1533261
  misc_feature: SWISSPROT Homolog: EC 3.2.1.23 Beta-galactosidase
tccccgcggtggcggccgctctagaatagtggatcccccgggctgcaggaattcgtctcacccctagaaaatcgatccgtatgtgtgcgtgcgtgtgtggcgttgctctttcttcttttgtgtagctgccctgccaccggccgacgtgtgcatgccatggtggcgggcagcgttttctaaggtcatatacagttgttgtgtttaagtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagataggggttgagtgtttgttccagtttggaacaagagtccactattaaagaacgtggactccaacgtcaaagggcgaaaaaccgtctatcagggcgatggcccactacgtgaa

SEQ ID NO: 64198 - DNA, 553 bp, Zea mays
  misc_feature: Ceres CLONE 1533263
ctgggctcaccgcggtggcggccgctctgaactagtggatcccccgggctgcggattcgtctccccctagaaaaaaccacttgctgcaagaggatacgattcagcttagctcagctccaccaccaccaagaacaagatctcgacgaagcagccagacgacaggcaggtagcaccggggtcaacgcggcagacaaacaggctctcccgctcggtcgctaggcggccttggatacccttggaagtttttgcccgggaaatggcaacaaacttccgtggtcccccccaggggaggacccggggaggcccaaaggggggtcctccctaaaaccctctggcggggaaaattgggggcacccccccgggggggggggcggggaaaaaaaaaaatttgtgtgttttttcccccaaaaaaggggggggggccaacccaaaaaaaccccggggggggggtttttcccccccccgggggggccccccccaaaaaaaattgtgggggcgggggaagaaaccccccccccccgctggtgttccccccccccaccccaacacaaaa

SEQ ID NO: 64199 - DNA, 612 bp, Zea mays
  misc_feature: Ceres CLONE 1533264
  misc_feature: Encodes the peptide sequence at SEQ ID NO. 64200
ctggagctccccgcggtggcggccgctctagaactagtggatcccccgggctgcaggaattcgtctcacccctagaaaaaaaccacttgctgcaaagaggaatacgattcagcttagctcagctccaccaccaccaagaacaagatctcgacgaagcagccagacgacaggcaggtagcaccggggtcaacgcggcagacaaacaggctctcccgctcgtcagctagcagccatgagtaccatgaagttttgccgtgaatgcaacaacatcctgtaccccaaggaggaccgggagcagaaggtgctcctctacgcctgccggaactgcgaccaccaggaggtcgcggacaacaactgcttgtaccggaacgtggtgcaccccaggcgccagggggaaagtttaaccctggtgcccccagacgggggctgggaacccagagtgggcccgaaccagagtcgggggcttgtccctctgggggcacggggaagggccgtttttttccaggccattttaaaaagggggacacaagggggttaaattggaagctggaaagggggggaaaacagaaatttctttcccccctttgggatttgggtaagaccgggtcgccc

SEQ ID NO: 64200 - protein, 101 aa, Zea mays
  misc_feature: Ceres CLONE 1533264
  misc_feature (4)..(60): Pfam Name: RNA_POL_M_15KD Pfam Description: RNA polymerases M/15 Kd subunit
  misc_feature: SWISSPROT Homolog: EC 2.7.7.6 DNA-directed RNA polymerase
MSTMKFCRECNNILYPKEDREQKVLLYACRNCDHQEVADNNCLYRNVVHPRRQGESLTLVPPDGGWEPRVGPNQSRGLVPLGARGRAVFFQAILKRGTQGG

SEQ ID NO: 64201 - DNA, 678 bp, Zea mays
  misc_feature: Ceres CLONE 1533276
  misc_feature: Encodes the peptide sequence at SEQ ID NO. 64202
tcccccgggctgcaggaattcgtctcacccctagaaaaaatctaaagaaccaagcccgagcagaagagtactttgccaagaaaaaagctggtgctggtgaatctgatagcggctctgcatagaatttctttgcgatgtactcttctcttgcttttagcatatgcttattactgagcaagacacaccggctcaactaaaaatgttcataacttcttcatccaaactctgacttcgatgatattagacatttcggaaattttatttaaagggctacgatagccactttaataattgattcagaaccgctcggcgtttttctccccccccccccaagggggggggggggggggagtaagggtgttggggttgttttccccccccccgggtaccccaatccgcccctatggcgagcgccgatttcccccccccctccttgcgccgtccgcttttaacaacgtgttgtgacgggggaaaaacaccgcggggttaccccaatttaaaacccctcgtggcagaacattcccccctttttccccctctgtggcttattttcccaaaaaggctctggcaccaatccctcctcttccacagatttggggcgaccctccctgcgcgaacgggaaaattgccagccgctttatttttttgctaagagcccccgttgacccggttccgcag

SEQ ID NO: 64202 - protein, 39 aa, Zea mays
  misc_feature: Ceres CLONE 1533276
PRAAGIRLTPRKNLKNQARAEEYFAKKKAGAGESDSGSA

SEQ ID NO: 64203 - DNA, 708 bp, Zea mays
  misc_feature: Ceres CLONE 1533277
  misc_feature: Encodes the peptide sequence at SEQ ID NO. 64204
  misc_feature (405)..(405): n is a, c, t, g, unknown, or other
caaagctggagctccccgcggtggcggccgctctagaactagtggatcccccgggctgcaggaattcgtctcacccctagaaaaaaccatttcaccaaattggcaagaaagccgctagcaatccacagttgcgatttgcgggaacaactactactatcaaaaactttcgacattcgattatgctggcgatggaaatggagctcctggtccgatttcaatgagagccataggcctccaaaaatagggttcaaaaagggccagagagcaaggagtcatcccatttttagccgttgccgtagctggtcgtcgtcgtcgtcgctgctcccaatctgcggccgtcggtgttgccttcgactttaatccacaagggcgagcagcaccgaccgagccgatccgctcctcttnctgggttctcttcataaatcagcagagcaggaaagatctgtgagcgttcttgcagccggcaggggtccaggattacgaaggaaaccaggaacgcagaaacttctaagagaggggaggaaagattgggtgtaaattggaaaaatttttacccgggttggttttggggtgggttattgcaaataaataggtgggaaaaaaccctggaaaaaaaagggaaaattttgggaaaacatgtttggatcccaaccaaggggagggcaaaagaattccccctcgggagaggagaattaaggaaaccccccc

SEQ ID NO: 64204 - protein, 38 aa, Zea mays
  misc_feature: Ceres CLONE 1533277
KAGAPRGGGRSRTSGSPGLQEFVSPLEKTISPNWQESR

SEQ ID NO: 64205 - DNA, 671 bp, Zea mays
  misc_feature: Ceres CLONE 1533278
  misc_feature: Encodes the peptide sequence at SEQ ID NO. 64206
  misc_feature (288)..(288): n is a, c, t, g, unknown, or other
  misc_feature (308)..(308): n is a, c, t, g, unknown, or other
  misc_feature (671)..(671): n is a, c, t, g, unknown, or other
agctccccgcggtggcggccgctctagaactagtggatcccccgggctgcaggaattcgtctcacccctagaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggaggntgagagccccgtccggcccngaccctgtcgcaccacgaggcgcccgtcacgagtcgggttgtttgggaatgcacccaaatccggcggtaaactccgtcccaggctaaaaaaaaaaaaaaaacgagacgctcgaggtacccaatccgccctatagtgagtcgtattacgcgccctccctgggccgtcgttttaccaacgtcgtgactggaaaaacccctgggtttacccaacttaatccgcctttgcaacacatcccccctttcccccagttgggcttaaataaccaaaaaaggcccccacccgattcgccctttccccaaaatttgccccaaccctgaaaggggcaaaaggaaaattgttaaaaccctttaaatttttttttn

SEQ ID NO: 64206 - protein, 39 aa, Zea mays
  misc_feature: Ceres CLONE 1533278
APRGGGRSRTSGSPGLQEFVSPLEKRPQVSRDYPLSLSI

SEQ ID NO: 64207 - DNA, 872 bp, Zea mays
  misc_feature: Ceres CLONE 1533280
  misc_feature (1)..(1): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (381)..(381): n is a, c, t, g, unknown, or other
ngggggggctgttttgcttttttcgcctctctcccaaaaaaaaaaaannnnnntttttgccgtccaaccatcttcattaacgctctgttctagtggatcccccgggctgcaggaagtcgtctcacccctagaaaaattttgtgtcaatgcttgttggttggaatgtaccatcttcgttctcgaatatttgtggtccgtttgttcaattttgtactacaccgcgacaaataaaaaatagcggaggcagtagaatataagtatttcctgagaactgaaatcaaaccccggcaggcactaccatgtcctcctgcatcacagttctgtcccttacattaatggctgtgtggtttttggaagtgttttacatgccttaaataaatnactgccccaatccaaccaaaacacacataaaacctaccgatgatggctcgcgtggtcacccaccgaccccccgggatggcggaggtgtgggcctatcgtgttgtgtttaatataggggtggtcgcccccccgggggggggttattaggtttgtgttaaaaattcctttggcctgtgtttcccctcacgctcaaacacaccgccattggccccctcaatcgccccccgaattgccgacgagactcgggtgtcactggcttgtgtggcagagcccccgtatgccacagtccctcaacttcctacgagcgtggtggtcggcgtattcctcgagaggttcctaatatgcgtaattttggtaccgcgcctcccacatttccacctctacacattctgtatttcataatatttcatgtaagaagtcccccgtctttactcccattggagaccctacaatatcccgtgaaccgtagagtaagtgccttcagctactcc

SEQ ID NO: 64208 - DNA, 675 bp, Zea mays
  misc_feature: Ceres CLONE 1533281
  misc_feature: Encodes the peptide sequence at SEQ ID NO. 64209
  misc_feature (480)..(480): n is a, c, t, g, unknown, or other
  misc_feature (482)..(482): n is a, c, t, g, unknown, or other
  misc_feature (483)..(483): n is a, c, t, g, unknown, or other
  misc_feature (501)..(501): n is a, c, t, g, unknown, or other
  misc_feature (502)..(502): n is a, c, t, g, unknown, or other
  misc_feature (519)..(519): n is a, c, t, g, unknown, or other
ggagctccccgcggtggcggccgctctagaactagtggatcccccgggctgcaggaattcgtctcacccctagaaaaactccccacatcgggaaccgccgccgacgccgcaggaggagacgcatcgaggttagcacgcgaagaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgcccttccgtaaggcattgtgtgggggttctagttgtattggaatccagcggtttccccctaagataaatcaaacttccttttggtaacccttttatgatggagctttatttcgctgatnannaaaaaaaaaaaagaaaannacccccaaaaaaaaaanaaccggggccctcgggggccccattttccccccagggggggggttttccgcccccccccggggcctctctttttaaacggcggggatgggaaaaccctgggttccccccaattaatccccttgggaaacatcccccttttccccaggggggataaa

SEQ ID NO: 64209 - protein, 57 aa, Zea mays
  misc_feature: Ceres CLONE 1533281
MTCVGTYISSDALVCLWRDVNLPWCHGPPSVERLACPSVRHCVGVLVVLESSGFPLR

SEQ ID NO: 64210 - DNA, 682 bp, Zea mays
  misc_feature: Ceres CLONE 1533282
  misc_feature (29)..(29): n is a, c, t, g, unknown, or other
  misc_feature (30)..(30): n is a, c, t, g, unknown, or other
  misc_feature (34)..(34): n is a, c, t, g, unknown, or other
  misc_feature (208)..(208): n is a, c, t, g, unknown, or other
agctcgcgtcgtctactatcgtgcaacannactngtggacccccgggctgcagatgtctctccccctagaaaaacttaaaaaaataggcgtctcagaatccgtgtacataataatctggcatgtcttgcatcaaaagaactcgttgcgtccactgtctgttgaactattgaagcgtactaaacatttaagcaactcgttgcgtccggngccggcgcccaaactcaacaagacggctaacaaaccgtcttccgcgaaaagaaaaaagcgagacgctcgaggtacccaatccgccctaaagtgagtcaaattacacccgctcactggccgtctttttccaacaccgtgactggaaaaacccctcgcgttacccaaattattccccttgaaaaaattccccttttccccccctggctaaatctccaaaaaggccccgccccgattccccttccaaaaattttgcccccccctgattgggaaaaggaaatttgaaaccctttaatattttggttaaatttccccgtttaattttttttttaaaaacaacccttttttttttacacaaataggccccaaaaccccgaaaaaaacccccttaataaacaaaaaaaatataaccccacaaaggggtttaaaaggttctttccccagtttggaaaaaaaaaaagccctcccttttaaaag

SEQ ID NO: 64211 - DNA, 668 bp, Zea mays
  misc_feature: Ceres CLONE 1533290
  misc_feature: Encodes the peptide sequence at SEQ ID NO. 64212
  misc_feature (668)..(668): n is a, c, t, g, unknown, or other
ggagctccccgcggtggcggccgctctagaactagtggatcccccgggctgcaggaattcgtctcacccctagaaaaagagatgacgatgacgacgatgaagaagcagcagcagctcctcctcctcctttctctcatgtttctcgttgctgtgacagcagccgctgttgctgccgatccacatccacagcagcaggtgcaggtgcagcagcagcagcaagcacagatgaggattaacagggccaccagatcccttcttcctcagccgccgccgaaactagactgcccgtccacctgctccgtgcgctgcggcaacaactggaagaaccagatgtgcaacaagatgtgcaacgtctgctgcaacaagtgcagctgcgtgccgccggggaccggccaggacacccgccacctctgcccctgctacgacaccatgctcaatccacacaccggcaagcttaagtgcccctaggccttcgccactcatgttatgtacaatgtactatcatcacttcaataaataaataaaaaaacttctggttctggatgcctgtttctacccaaaaaaaaaaaaaaaaacgagacgctcgaggtacccaattcgccctatagtgagtcgtattacgcgcgctcactggccgtcgttttacaacgtcgtgactgggaaaaccn

SEQ ID NO: 64212 - protein, 128 aa, Zea mays
  misc_feature: Ceres CLONE 1533290
  misc_feature (6)..(128): Pfam Name: GASA Pfam Description: Gibberellin regulated protein
MTMTTMKKQQQLLLLLSLMFLVAVTAAAVAADPHPQQQVQVQQQQQAQMRINRATRSLLPQPPPKLDCPSTCSVRCGNNWKNQMCNKMCNVCCNKCSCVPPGTGQDTRHLCPCYDTMLNPHTGKLKCP

SEQ ID NO: 64213 - DNA, 659 bp, Zea mays
  misc_feature: Ceres CLONE 1533292
  misc_feature: SWISSPROT Homolog: EC 3.2.1.23 Beta-galactosidase
  misc_feature (269)..(269): n is a, c, t, g, unknown, or other
  misc_feature (479)..(479): n is a, c, t, g, unknown, or other
  misc_feature (541)..(541): n is a, c, t, g, unknown, or other
acccgcggtggcggccgctctagaactagtggatcccccgggctgcaggaattcgtctcacccctagaaaaaccaattaagtgtacattttttttggtatcttctttcttcctcccttccttatatatagctgcaataccgtatacgttcatctctctctctctatctccttatatatagatgatgagaaccatgtggataccgtagtcgaaatctacaacagtttacttactcgatcgctttcaaaaaaaaaaaaaaaaacgagacgnctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccaacagttgcgcagcctgaatggcgaatggaaattngtagcgttatattttgtaaaatttcgcgtaattttttgtaaatcagctcattttttttaccnaatagccgaaatccgcaaaatcccttattatcaaaaaaataaaccgaatagggttggaatggttggtccctttgggaacaaaaaccccctttttaaagaacgggaaccccacccccaa

SEQ ID NO: 64214 - DNA, 666 bp, Zea mays
  misc_feature: Ceres CLONE 1533298
  misc_feature: SWISSPROT Homolog: EC 3.2.1.23 Beta-galactosidase
  misc_feature (656)..(656): n is a, c, t, g, unknown, or other
agctccccgcggtggcggccgctctagaactagtggatcccccgggctgcaggaattcgtctcacccctagaaaaaactttttgaggattgtcacttatgctagtatgtaatccaaacttacaaatattttataacatttcaaagtataatattttaatcacatttgtaatcactctgataatgtaaatttattgtaatttgaaagcttgtaataaaaattccgctgcaaaaactttggtcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcnaagggcgaaa

SEQ ID NO: 64215 - DNA, 668 bp, Zea mays
  misc_feature: Ceres CLONE 1533303
  misc_feature: Encodes the peptide sequence at SEQ ID NO. 64216
  misc_feature (1)..(1): n is a, c, t, g, unknown, or other
ncccgcggtggcggccgctctagaactagtggatcccccgggctgcaggaattcgtctcacccctagaaaaaaaccagctgtgcagggcatgaacgccaacatgtgagggagagttgccactgagtggagtcatggttgtcgccgctcgccaatcggagtgtgtgtcctcgtccgtgttgagaacgcggccggggaggctcggcctaccctcacggatgtgtccgtggcgtcgacgcgtcgtttggagggttgatcgatcagggggctggcaattgctcgccggtgaagaaacttcgtcgggggaccacaccgctctgcggatggtgattttcactgcgctatgcactggtcatgaacatgtaccactggatgaggcgcttgaaggatgttgtgatgggttcgtgagtgggttaggccgtcgtctcccaatcaactagggttgctggattgatgtcttcatatgatgtaattatttatttattttgtacagaactcgtattctatagtaaagatgtgacatttgtttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagc

SEQ ID NO: 64216 - protein, 101 aa, Zea mays
  misc_feature: Ceres CLONE 1533303
MVVAARQSECVSSSVLRTRPGRLGLPSRMCPWRRRVVWRVDRSGGWQLLAGEETSSGDHTALRMVIFTALCTGHEHVPLDEALEGCCDGFVSGLGRRLPIN

SEQ ID NO: 64217 - DNA, 678 bp, Zea mays
  misc_feature: Ceres CLONE 1533305
  misc_feature: SWISSPROT Homolog: EC 3.2.1.23 Beta-galactosidase
  misc_feature (617)..(617): n is a, c, t, g, unknown, or other
agctccccgcggtggcggccgctctagaactagtggatcccccgggctgcaggaattcgtctcacccctagaaaaagttgtggagatatcagctgtgtatagaactgggcgcaacaaactctgctgtaatgcccgtatatattccttttcggtatatcaagtctaaagctatagtgcataagtgctgtaatcggtgaactgagtgcatccagaatatcatgtcatggtaaacataattataattacatggttgtctttttagactgaacacagcatgtcttctgttccggctatactgaaactgaaagataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagtttgcgcagcctgaatggcgaatggaaattgtaagcgttaatattttgttaaaatttcgcgtaaaatttttgttaaatcaacctcattttttttaaccaaaangccaaaatcggccaaaacccctttataaatcaaaagaaaaaaacccaaaaaagggttgaaa

SEQ ID NO: 64218 - DNA, 675 bp, Zea mays
  misc_feature: Ceres CLONE 1533309
  misc_feature: Encodes the peptide sequence at SEQ ID NO. 64219
  misc_feature (453)..(453): n is a, c, t, g, unknown, or other
ctccccgcggtggcggccgctctagaactagtggatcccccgggctgcaggaattcgtctcacccctagaaaaatcagccgagtggttgtgccgtggaagctttcgtttaccgttcccatcccccgtcgtctctcctctccttcccactctcccacccgtcctccattgctcccttcctctctctcgcggagtcgctgcgatctaaccaccgagtacgagcgtcctactcgccgcggaccttgctcatggccgcggggtcgatccgggtcaccatggaggtgggcgccgacggcgtcgcgctcatcaccatcgccaacccgcccgtcaacgcgctccaccccatcatcatcgcggggctcaaggacaagtacgcggaggccttgcgccgtgacgacgttaaggcaatcgtgctcactggtgctgggagggcagtctgtggagggattgatatncacgttttcacaaaggttcatcagactggggatgtatcacttatgccggacgtatccgtcgagcttgtgtcaaacatgatggaagagggaaaaaaactttctgttgcagccattcagggtctgcattgggtgtggcctaaagatgactaggggttgcctgcccgaaatctcctccttgaactcacttgaattggcaaactacccttggaatcacccttgatt

SEQ ID NO: 64219 - protein, 118 aa, Zea mays
  misc_feature: Ceres CLONE 1533309
  misc_feature: SWISSPROT Homolog: EC 4.1.3.36 Naphthoate synthase
  misc_feature (69)..(69): Xaa is any aa, unknown, or other
MAAGSIRVTMEVGADGVALITIANPPVNALHPIIIAGLKDKYAEALRRDDVKAIVLTGAGRAVCGGIDXHVFTKVHQTGDVSLMPDVSVELVSNMMEEGKKLSVAAIQGLHWVWPKDD

SEQ ID NO: 64220 - DNA, 636 bp, Zea mays
  misc_feature: Ceres CLONE 1533310
  misc_feature: Encodes the peptide sequence at SEQ ID NO. 64221
  misc_feature (628)..(628): n is a, c, t, g, unknown, or other
tggagctccccgcggtggcggccgctctagaactagtggatcccccgggctgcaggaattcgtctcacccctagaaaaaaccgcatcgcctcgccgctgttccccgcaagctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcacagccggcttggtttcctcgaaggatcagcatctactcttgattgtggactttgtcgcatctgatatcaacttcataaatctctagtcaagatggcgctgcaaaacattggtgcttcacacaagtatgatgccttctacacgtacaagatgcccagagtgattaccgacatagaacgccgtggtaatggtatcaagacggatgttgtgcacatggttgacatagcagaagcactttgcaggccagcgncctacgca

SEQ ID NO: 64221 - protein, 55 aa, Zea mays
  misc_feature: Ceres CLONE 1533310
  misc_feature (53)..(53): Xaa is any aa, unknown, or other
MALQNIGASHKYDAFYTYKMPRVITDIERRGNGIKTDVVHMVDIAEALCRPAXYA

SEQ ID NO: 64222 - DNA, 574 bp, Zea mays
  misc_feature: Ceres CLONE 1533312
  misc_feature (430)..(430): n is a, c, t, g, unknown, or other
acccgcggtggcggccgctctagaactagtggatcccccgggctgcaggaattcgtctcacccctagaaaaatacaccaactgactgatcaactccagcccaggaaacatctctgcctgcccatgctgtccctcactcgatttgtatgtttgtatggcttaggtccttcgatcgtaccgtcgtgcgtggtaaccaccataaacatgcgatccattgagttgggttggcaaaaaaaaaaaaaaaacaaacccccggggtcccccattccccccttaggggagctaaataccccccccccctggcccccctttttttaaaaccggcgggggggggaaaaaccccgggggtccacccaaaaataacccccttgggaaaaaaccccccctttttcccgggggggggaaaaaaaaaaaaaaaacccccccccccnccccccccccccaaaaaattccccccccaagggggaggaaaaaaaaaaacaccccccctttttttttttttaaaaccccccccctttttttttttttataaacccctttttttttttataaaaaaaaaaaaaaaaaaaaaaaaa

SEQ ID NO: 64223 - DNA, 668 bp, Zea mays
  misc_feature: Ceres CLONE 1533314
  misc_feature: Encodes the peptide sequence at SEQ ID NO. 64224
  misc_feature (503)..(503): n is a, c, t, g, unknown, or other
ctacccgcggtggcggccgctctagaactagtggatcccccgggctgcaggaattcgtctcacccctagaaaaattcgccctgcctctagctgctgcttcttccagtatcggggatcggagcttgtgctgctactgctactataccagcgctagctagcagcagccgccggccggctcgcgcaagctaaggaagggtcgacatgacgatggggctccgcgtccgcgactcctccgcgctgctggctctggccgtcgcgctcgcctgctgctccgttgcagtggtggcctacgaccccctggacccgaacggcaacatcaccatcaagtgggacgtgatctcgtggacgcccgacgggtacgtggcgatggtgacgatgagcaactaccagatgtaccggcacatcatggcgcccgggtggacgttgggggtggtcgtgggccaagaaggaggtgatctggtccatcgtgggggcgcaggcccacgagcaaggggactgctccnagttcagggcggcatcccgcactgctgcaagcgcaccccggcggtgtggacctctttccggggggtgccctacaaccagaaaatgccaactgcttcaaggcccggcctggtgtcgctaacgggcaggacccggcggggtccctttccccgtttcagggttccctg

SEQ ID NO: 64224 - protein, 155 aa, Zea mays
  misc_feature: Ceres CLONE 1533314
  misc_feature (101)..(101): Xaa is any aa, unknown, or other
MTMGLRVRDSSALLALAVALACCSVAVVAYDPLDPNGNITIKWDVISWTPDGYVAMVTMSNYQMYRHIMAPGWTLGVVVGQEGGDLVHRGGAGPRARGLLXVQGGIPHCCKRTPAVWTSFRGVPYNQKMPTASRPGLVSLTGRTRRGPFPRFRVP

SEQ ID NO: 64225 - DNA, 623 bp, Zea mays
  misc_feature: Ceres CLONE 1533316
  misc_feature: Translation starting site: 271
  misc_feature: SWISSPROT Homolog: EC 2.7.9.1 Pyruvate, phosphate dikinase
gccgctctagaactagtggatcccccgggctgcaggaattcgtctcacccctagaaaaaacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgtttccacttcggcaaagggcaggagcgagggcaacaagaccatgaaggaactgctgggccggaaggggcccaaccttgggggaaaatggcaaacattggggttttcggtgccccccggggtt

SEQ ID NO: 64226 - DNA, 671 bp, Zea mays
  misc_feature: Ceres CLONE 1533317
  misc_feature: SWISSPROT Homolog: EC 3.2.1.23 Beta-galactosidase
  misc_feature (671)..(671): n is a, c, t, g, unknown, or other
ctccccgcggtggcggccgctctagaactagtggatcccccgggctgcaggaattcgtctcacccctagaaaaaagtgcatatttctaagagctcaaacacccaagtgcttaatagaatcactcggtgattagcgtaggtgctttgcaaagtgcttaggttagttagaccgctttagcgcttgctctaggtgaaccctatattgttgagtgagtttagattgaaagggaaataggctttaaaccttttcctaaatgattttggcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttgcaacaagagtccactattaaagaacgtggactn

SEQ ID NO: 64227 - DNA, 581 bp, Zea mays
  misc_feature: Ceres CLONE 1533324
  misc_feature: Encodes the peptide sequence at SEQ ID NO. 64228
acccgcggtggcggccgctctagaactagtggatcccccgggctgcaggaattcgtctcacccctagaaaaaggaggcatcgtgtggaccgcgccctgcacaccttgagcgtgggcctgcctcctccatctccctctgcggcgtataaagaagcgacccacggccaccgccacggcctcgccggaatatcatacgaaaaccctcgcggcggggagagcgctttccctcccacacactcgcgccgcagcatccgcagtccgcacctgcctgcctccacgacttgtcgtgctcgtgcgctactctcctcgagtggcggcgcgggagcacggggacatctaatggcggccgcggcggagatcggtggtttcacgggcggccgcgcttcagggccgcttgggccaccccaacccccgggggggggggggcccaggaggggggggggaaacaaaattctcttggggagaacaccccccccaaaaacgtttagagggggggattttttccccccaaaaagggggaaaaaaggggggggggggggtggtctccaaaaaatttatatagggggggggggtcttcttttt

SEQ ID NO: 64228 - protein, 81 aa, Zea mays
  misc_feature: Ceres CLONE 1533324
MAAAAEIGGFTGGRASGPLGPPQPPGGGGPRRGGGNKILLGRTPPPKTFRGGDFFPPKRGKKGGGGGGLQKIYIGGGGLLF

SEQ ID NO: 64229 - DNA, 692 bp, Zea mays
  misc_feature: Ceres CLONE 1533328
  misc_feature: Encodes the peptide sequence at SEQ ID NO. 64230
  misc_feature (373)..(373): n is a, c, t, g, unknown, or other
  misc_feature (420)..(420): n is a, c, t, g, unknown, or other
  misc_feature (428)..(428): n is a, c, t, g, unknown, or other
  misc_feature (429)..(429): n is a, c, t, g, unknown, or other
  misc_feature (461)..(461): n is a, c, t, g, unknown, or other
  misc_feature (559)..(559): n is a, c, t, g, unknown, or other
  misc_feature (574)..(574): n is a, c, t, g, unknown, or other
  misc_feature (575)..(575): n is a, c, t, g, unknown, or other
  misc_feature (578)..(578): n is a, c, t, g, unknown, or other
  misc_feature (579)..(579): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
ctggagctccccgcggtggcggccgctctagaatagtgggatccccgggctgcaggaattcgtctcacccctagaaaaacgttgcctcctccctgagacaatccccacgccaccgcgcaccggagacgaacctgaggagagaaaaatctgcgcccgtcagtgtgatcgcctacttctacgctccgctcgttcccccaaatagttcctcggcttcgctccctttcccctccctgctccggctccggttcgcacacagtaagaaaagatggcgctgccatccatgagtcttgcggcaaagggtgtgcttcccttctcagcacgtacctcgagtggtgtcacacaaagggccgggtgttcagtgaccgcttccttnggagcacaaaacccagcgattgccagaaggacacttcctaaaacttngcacttgnnggaaccttggagttgggactgccccaccttgnttggggcgctaagaaagcttcttcgctgatgaagcaaaggcgtcttcgtcctccgaggatgttcttatttccagggttcctcttgagtattctttggnacccagggtagtggnngannannngttgattttgttttgagaaatggaccaatttgttattggtggaggccattttctcccggagctttgggtaaccgccgtgcaaaagagttcggtgtggcaggcttccctg

SEQ ID NO: 64230 - protein, 74 aa, Zea mays
  misc_feature: Ceres CLONE 1533328
  misc_feature (36)..(36): Xaa is any aa, unknown, or other
  misc_feature (52)..(52): Xaa is any aa, unknown, or other
  misc_feature (55)..(55): Xaa is any aa, unknown, or other
  misc_feature (66)..(66): Xaa is any aa, unknown, or other
MALPSMSLAAKGVLPFSARTSSGVTQRAGCSVTASXGAQNPAIARRTLPKTXHLXEPWSWDCPTLXGALRKLLR

SEQ ID NO: 64231 - DNA, 698 bp, Zea mays
  misc_feature: Ceres CLONE 1533332
  misc_feature: Translation starting site: 292
  misc_feature: Pfam Name: Choline_kin_N Pfam Description: Choline kinase N terminus
tccccgcggtggcggccgctctagaactagtggatcccccgggctgcaggaattcgtctcacccctagaaaaaacaacactcgcctgccctgccctctcatctcgcttcgcttccattccatcgcgccagtcgccagactcaccagggagacagggagagtagggggaaatatcaattagaaacaacgaggaactagcaaagaaagaaggataactcccataagaaaaatcgccaaatacgccattcatcttctccgcccgggtttcagaacgtgcggcagtttagccaggatggtggcgatcgagaaccagaaccatagccaggccgcggtggcggtggcggctgaggcggagccagctcctgcgtcacggatccccaggtagcgcggcgcctgctgcacaatctggcggcggcctgggctgacgtgaacaactgctacgcgctagaagtcttgccgctcgaagggggcatgacaaaggaggtcgacccaggggtgctggtttaaaggaaggccctggcgggcaaaaaggaggaaccccaggccgaataagggaggggaagggaagggcctcggggcaatatttaggggtaacgggaataaaccctttttttttcaaccgggagggaacaaagggggccccccttcaaaagggggaggaaccaccacaggggcccgggggctcccccccccccaagg

SEQ ID NO: 64232 - DNA, 692 bp, Zea mays
  misc_feature: Ceres CLONE 1533333
  misc_feature: Encodes the peptide sequence at SEQ ID NO. 64233
  misc_feature (1)..(1): n is a, c, t, g, unknown, or other
  misc_feature (395)..(395): n is a, c, t, g, unknown, or other
naaagctggagctccccgcggtggcggccgctctagaactagtggatcccccgggctgcaggaattcgtctcacccctagaaaaaatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcaaatatggtgatacacttaaaaggttttatggntgtgccaatgggagtcattttgacatggatttatctgctctacgggcgaggattgatactgcccttaagtttggtcctgacgttgactttggtctgacttacaccgatgaggaaggggaaattgccatgccaaaagaggaggaagaatgcggggatgcgcttcccctccaagaattacccctctccgggttcctggttcactgaaaaaaaattccccccttgaaaaaaaagtattccggcccccgaaaaaccccgctccggaggaccctttccccgtttagggccccttttgagagg

SEQ ID NO: 64233 - protein, 106 aa, Zea mays
  misc_feature: Ceres CLONE 1533333
MSDWSSPAAPTFFPFGPQAEGWDVTFKVKYGDTLKRFYGCANGSHFDMDLSALRARIDTALKFGPDVDFGLTYTDEEGEIAMPKEEEECGDALPLQELPLSGFLVH

SEQ ID NO: 64234 - DNA, 663 bp, Zea mays
  misc_feature: Ceres CLONE 1533338
  misc_feature: Translation starting site: 225
  misc_feature (446)..(446): n is a, c, t, g, unknown, or other
  misc_feature (487)..(487): n is a, c, t, g, unknown, or other
ctccccgcggtggcggccgctctagaactagtggatcccccgggctgcaggaattcgtctcacccctagaaaaaaacctttccctctcctctctgtttcatctcgccagctttgcgggaaaagagacaccagggacaagccccgcctcctctcccgagtcctgacgtgccccttttgctccggccccacttcctcgcaaaaccctaacccctcgatctcccaagatggcgtcgcagccgccgccccctgccgcagccgcggcatctggagctccgccgccggcacaagtggtgggcaacgccttcgtgcatcagtactacaacatcttgcaccagtcgccggagctcgtctaccgcttctaccaggaggcagctgcctcgggcgccccgccggcaccggtgccgaacgcatggacacggtcaccaccatgaacgcgattaacgacnagatcgtgtccatgggtatcgaccgggcggagatcaaggcngtggacgcgcagaatccctctgtggcggggtcgcgtgctcgtcatgggtcatcttacggggaggaacagcgtcagccccaattttgggaagccttttttcttcggcccaaggaaaagggttcttttggccaacccatccggcctacttggggggggggaaggggcacaaaggggtt

SEQ ID NO: 64235 - DNA, 686 bp, Zea mays
  misc_feature: Ceres CLONE 1533342
  misc_feature (675)..(675): n is a, c, t, g, unknown, or other
  misc_feature (676)..(676): n is a, c, t, g, unknown, or other
  misc_feature (683)..(683): n is a, c, t, g, unknown, or other
tacccgcggtggcggccgctctagaactagtggatcccccgggctgcaggaattcgtctcacccctagaaaaaccccgccccaccaaacactcccgcagacccacccgtccccgtccgtccacagccagctccgcctcccatccagcgcccgtccacagccaccacagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgtttcttcttcggtttggttctagttctagcagtgtactactactagtcgttaggttggtagccaagagaggttctttttccacacctcccttgcgcaagtgagtcctgtcctgagcggatctacccaccactgccatctgttttttactgtggctgttgggttccgccagtttcttcgtttgttcttggtttgctagagagaggaaaaacaaaaaaacaaaaaaaacagtctagatggctgctgctatagatctgtcaggggaggagctgatgagagcactcgagccttttatccgggatgcctctgctcacggggatcagtcgctccnntcaccgnaca

SEQ ID NO: 64236 - DNA, 658 bp, Zea mays
  misc_feature: Ceres CLONE 1533343
  misc_feature: Encodes the peptide sequence at SEQ ID NO. 64237
ggtgcccgcggtggcggccgctctagactagtggatcccccgggctgcagggattcgtctcacccctagaaaaacctcctctgcatgtctcaacaacccgtctccaagaaaccaccttcccccctcgctccaatcccaatccttctccgcggaccaatagaacccaatccgatcactccccacgcagtttccccatatcaaaagatccgatcggagtccggcagctaattcaccaccggggaaagatgaaggtcgacagggagatggagattctgctgaacgagatccccctcctccaccacgtcggcctcctcggcggcagcgaggccggcgcggacgacgacgccgacctctccttcctcatccacgagctcgccgcgatgggcctcgtcgacggcgacgacgagctgccggcgccgggcgctgccaccggctacggcttccccacgaaaggcgagaaccttgtcgccatgcactcgttctccatggccagccactacgcgcacatgcgctctctgtttgttcccgtcaccttcgacgacgccgccgctgccgacggctgggacatccggtgctccccgccgccttatgtgcctctgcccttctccgcacgccgagggcccggtgcaagagcgtgaggaggaagaacggctcggtg

SEQ ID NO: 64237 - protein, 130 aa, Zea mays
  misc_feature: Ceres CLONE 1533343
MKVDREMEILLNEIPLLHHVGLLGGSEAGADDDADLSFLIHELAAMGLVDGDDELPAPGAATGYGFPTKGENLVAMHSFSMASHYAHMRSLFVPVTFDDAAAADGWDIRCSPPPYVPLPFSARRGPGARA

SEQ ID NO: 64238 - DNA, 651 bp, Zea mays
  misc_feature: Ceres CLONE 1533344
  misc_feature: SWISSPROT Homolog: EC 3.2.1.23 Beta-galactosidase
  misc_feature (333)..(333): n is a, c, t, g, unknown, or other
  misc_feature (335)..(335): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (405)..(405): n is a, c, t, g, unknown, or other
agctccccgcggtggcggccgctctagaactagtggatcccccgggctgcaggaattcgtctcacccctagaaaaagtctccctctccagatccagatcgcgtagaagcagacgtccctgcatggcggttttcaggttgcctttggtgcaatctatgctcaggtaaagaagaaggcgtcgaggcggatccccaggagtgccaggacttcggcgagttcgtggtttaggctagcgacctcccccagtcagctgcctgtggtgggtttgtttacgttggctacgtttctgttctgtgtactttgattatattatgtaaatgactctagtctttcntnttnnnnnnnnnnnnnnnnnnnnnnnnnnnnnnnnnnnnnnnnnnnnnnnnnnnnnnnnnnnnnnnntttnaaaaaaaaaaaaaaccgggccgctcgaggtacccatttccccctatagtgagtcgtattaccccccctccctggccgtctttttacaacgtcgtgactgggaaaaccctggcgttacccaacttaatccccttggagcaaatccccctttcgccagttgggtaaatagcgaaaaggcccccaccaatcgccctttcccaaaatttgcccaccctgaatggcaaatggaaattgtaagcctttaatt

SEQ ID NO: 64239 - DNA, 628 bp, Zea mays
  misc_feature: Ceres CLONE 1533346
  misc_feature: Encodes the peptide sequence at SEQ ID NO. 64240
  misc_feature (41)..(41): n is a, c, t, g, unknown, or other
  misc_feature (44)..(44): n is a, c, t, g, unknown, or other
  misc_feature (45)..(45): n is a, c, t, g, unknown, or other
  misc_feature (335)..(335): n is a, c, t, g, unknown, or other
ccccgcggtggcggccgctctagaaactagtggatcccccnggnngctgcaggaattcgtctcacccctagaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggaagagaaggccgcgcccgagttcgtcgaggccgcggcggagtccggcgaggccgcccacgcctgcngctgcggtagcagctgcaagtgcgaccccctgcactgctgatcacatcgatcgacgaccatggataatgatattatctatctagcttgtggtggtgggttgaaccataataagcgaggcccagctggctgccatacttagtatttgggtgggggtgtgaaaaaaaaaaaaaaaaacagaattcttccgttggccaatcctcccccccgccagtttggcggccagccttttttgggcccgggaaccgtgggcttccccagccaggtttgggttaaccccaataggccccccgcc

SEQ ID NO: 64240 - protein, 76 aa, Zea mays
  misc_feature: Ceres CLONE 1533346
  misc_feature (1)..(76): Pfam Name: Metallothio_2 Pfam Description: Metallothionein
  misc_feature (64)..(64): Xaa is any aa, unknown, or other
MSCNCGSSCGCGSSCKCGKKYPDLEETSTAAQATVVLGVAPEEKAAPEFVEAAAESGEAAHACXCGSSCKCDPLHC

SEQ ID NO: 64241 - DNA, 662 bp, Zea mays
  misc_feature: Ceres CLONE 1533348
  misc_feature: Encodes the peptide sequence at SEQ ID NO. 64242
ggagctccccgcggtggcggccgctctagaactagtggatcccccgggctgcaggaattcgtctcacccctagaaaaaaaaaaaaaaaaaaaaaaaagtgtctcgtcctcgcatcccgcgccacaccatcccaatcccctccctccccctcgcgtctccagtctccacacctttcacacgcgacgccggagagacagagcgcgcgcgcgcgcccgaaagatgtcgacgtgcgcagcggacctggcgccgctgctgggcccggcggcggcgaacgccacggactacctgtgcgggcagttcgcggacacggcctccgcggtggacgccacgtacctgctcttctcggcctacctcgtgttcgccatgcagctcggcttcgccatgctgtgcgccggctccgtccgcgccaagaacactatgaacatcatgctcaccaacgtgctcgacgccgccgcgggggcgctcttctactacctcttcggcttcgccttcgccttcggcacgccctccaacggcttcatcggcaagcagttcttcgggctcaagcacctgcccaggaccggcttcgactacgacttcttcctctaccagtgggccttcgccatcgccgccgcgggcatcacgtcgggctccatcgccgagcggacccagttcgtcgccta

SEQ ID NO: 64242 - protein, 147 aa, Zea mays
  misc_feature: Ceres CLONE 1533348
  misc_feature: Functional homolog of the protein sequence given in SEQ ID NO 96883
  misc_feature: Useful for making plants with modulated carbon-nitrogen partitioning
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDFFLYQWAFAIAAAGITSGSIAERTQFVA

SEQ ID NO: 64243 - DNA, 697 bp, Zea mays
  misc_feature: Ceres CLONE 1533352
  misc_feature: Encodes the peptide sequence at SEQ ID NO. 64244
  misc_feature (386)..(386): n is a, c, t, g, unknown, or other
agctcaccgcggtggcggccgctctagaactagtggatcccccgggctgcaggaattcgtctcacccctagaaaaagtcgcggagccgccgcaacccagcgtcccccgaagtctaaccctagatccggaccggccatggcgtcccgccgggtcgtctcctcgctcctccgctccgcgtcccgcctgcgggccgcctcgcccgctgctccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccnagtgtgccaggtgatcggcgccgtcgttgacgtgcgcttcgatgaggggcctccgcccatcctcacggggctcgaggtgctcgacaacaacatccgcctcgtgctcgaggtggcgcagcaccttggcaaggacatggtgcgcacatccctattgacggcacggaggggctcgtcgcgggcaggccggtcctaaacttggttccccctcaccgggctgtttggaggggtaccctggaccgcctaaaatgtttttgggaacccattgttggaaagggggaaataaaaacaacccctttcccccttttttgggg

SEQ ID NO: 64244 - protein, 147 aa, Zea mays
  misc_feature: Ceres CLONE 1533352
  misc_feature (85)..(145): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (84)..(84): Xaa is any aa, unknown, or other
MASRRVVSSLLRSASRLRAASPAAPRPRAPPHRPSPAGYLFNRAAAYASSAAAQAAPATPPPATGKTGGGKITDEFTGAGAIGXVCQVIGAVVDVRFDEGPPPILTGLEVLDNNIRLVLEVAQHLGKDMVRTSLLTARRGSSRAGRS

SEQ ID NO: 64245 - DNA, 649 bp, Zea mays
  misc_feature: Ceres CLONE 1533353
  misc_feature: SWISSPROT Homolog: EC 3.2.1.23 Beta-galactosidase
  misc_feature (461)..(461): n is a, c, t, g, unknown, or other
ctccccgcggtggcggccgctctagaactagtggatcccccgggctgcaggaattcgtctcacccctagaaaaacaaactgggaagacgcgacaccactaatgaaagaattggaatttaaaccttttgatgtttaaatccttgttctgggcatttgctacggtatcttctcgccagtgttcttaaggcggtaaggcgagcaagtaaacatgaccaccgccttaacgcctaggcgatgccttaaatacattgtttctcattacatattgcatgggatgaagctggttgcttatgccatgtgggtgatttgttcaattatgctgcttctgatgatgatactttattggaggacgaggatactgctgaacttacgaattaccagcacaagaatgaggtgatcaattcatctgagagattaacatatggtggacacaaagattgtaatgcatactgtttgtatgncacaaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatcccccttttcgccagctggcgtaatagcgaagaaggccgc

SEQ ID NO: 64246 - DNA, 677 bp, Zea mays
  misc_feature: Ceres CLONE 1533355
  misc_feature: Translation starting site: 223
ggagctcaccgcggtggcggccgctctagactagtggatcccccgggctgcaggaattcgtctcacccctagaaaaagcgctctttctctttcctcacgacgccgccgttgggagccctgcttcgggagagccccaacccttatcaaaccctaaatcaaaaactacccaaaaaaatccgcaaaatccagaaaaaaatcccaaaaatcaccacttgattggagatggcgacgcaagggcaagcggcggctggatccgcgtccgagtccggcggctctccggctgccttagctgcagcagccgcggcggcggccgcgttcccggcgacttcgctctacgtgggtgatctgcacgagagcgtgcaggacgcgcagctcttcgacgttttcagccaagtcggcggccccatctccgtgcgcgtctgcagggacatcacctcccgcaagtcgctcgggtacgccttacgtcaactacaacaaaccaggcgacgctgcacgagcacttggactgcttaacttcactcctatcaatggaaagcctatcaggatcatgtattctaacggggaccctagctcgcgcaaaaagcgggacaggaaatatatttttaagaaacttggataatcaatagacaacaaagcttttttgacaatttctgggcatttggaaaaaacttttctgg

SEQ ID NO: 64247 - DNA, 664 bp, Zea mays
  misc_feature: Ceres CLONE 1533359
  misc_feature: Encodes the peptide sequence at SEQ ID NO. 64248
acccgcggtggcggccgctctagaactagtggatcccccgggctgcaggaattcgtctcacccctagaaaaactccccttccccacctcttcccattgccaagcaagagagaaacgcacgcgagccgcgagcagaacagagcagcgcggcgccatcccgatctcgctatttcccttctcccccgatgcgatctcgccgaaccctaatccccacgcccgacgcccggccgtcgccggagccctagccccgaatgcggcggtgacgcgcggcgtgccaccaccaccacctcagcgcccgcgcccgcgcccgcgcccgccaccgaccgtcctgcccggccgacaccagctgccatgggcgccgccgacaagtggctgctcccgctcgtctccgtctccttcgtctcgctcctgctcttcctctccgcgctctcgggcttctccgcctcctccgcactcttcgcgcgcctcccgccaccctcctacgtgcgccgaggcgccgccgcaccgccctccttcgcctacctgctcgcgggcggccggggggacggcaggaagctcctgcggctgctcctcgccgtctaccaccccaggaaccgctacctgctccacctctccgccgacgcgccggcctccgagcgcgccgagctcgccgcggccgtcgcgcg

SEQ ID NO: 64248 - protein, 104 aa, Zea mays
  misc_feature: Ceres CLONE 1533359
MGAADKWLLPLVSVSFVSLLLFLSALSGFSASSALFARLPPPSYVRRGAAAPPSFAYLLAGGRGDGRKLLRLLLAVYHPRNRYLLHLSADAPASERAELAAAVA

SEQ ID NO: 64249 - DNA, 655 bp, Zea mays
  misc_feature: Ceres CLONE 1533362
  misc_feature: Encodes the peptide sequence at SEQ ID NO. 64250
ctccccgcggtggcggccgctctataactagtggatcccccgggctgcaggaattcgtctcacccctagaaaaaacattatataactatgatggttacaacaaagtggcgtacctggaagcagcagttttgaatggtcaaatttctgattttctggatgacaacactgagtgatctctctcactggcctgggggttgggatgtaaatcatgtcagttttcgtcaaaccacttactaatcgtttttaacaatgttttcaggtattgcctatcaggatcatctgattcgatgataagactatgggatctaggacaacagcgttgtgttcattcttatgctgtgcatactgattcagtttgggcgcttgcaaccactcattcgtttggtcatgtttacagtggtggaagggaccaatctgtatacctaacagacttatccacaagagagagtgttttactttgcacaaatgaatgccctattctacagttgtctctgcaagatgacacaatatgggtggcaacaactgattcttctgtatatggatggccagctgaagggctcacaccccaaaaggttttccaaaagggtggctcattcttagctgggaatttgtcattctcaagggcaagagcttctttagaaggatcagcacctgt

SEQ ID NO: 64250 - protein, 56 aa, Zea mays
  misc_feature: Ceres CLONE 1533362
PRGGGRSITSGSPGLQEFVSPLEKTLYNYDGYNKVAYLEAAVLNGQISDFLDDNTE

SEQ ID NO: 64251 - DNA, 682 bp, Zea mays
  misc_feature: Ceres CLONE 1533363
ctcaccgcggtggcggccgctctttactagtggatcccccgggctgcaggaattcgtctcacccctagaaaaatccacgtcggaagctagctagctactaccactcatgcccgcctcctacgctcctgctccctactcctcctctccctttcggctcccgatcccttcccgcgcgcgcacgtcgtccttcccgattcgctccgacgacgcaccgccgtgccgtcggctggatatagctgagctgcccgacccagcgcgccattaaaagacctctttcctcctcgatcgcggccgtgccaagcgcatagaccagcacgtaccacacgtttaggtgaacgaccgaccggcgcattccatcgtccatgggcaaccgcaagaagctggtccacttcctccacccccccgctgcggcggcggcggggctccgccctctcctcccctaggtccttctccgaccacgacgggtacagctcctccctctttcccatcatcctcgccggtcggcggttacaggcccggccccaaggccgccgggggggggcggcctccgggggggcctccggtgggtcctcaaggcccgtccggcggggaacagggccttctccgcgttcctttgtctagaggggggacgggcaagggttttatatcctttgggcggggggggcgggggaattttgtcttt

SEQ ID NO: 64252 - DNA, 817 bp, Zea mays
  misc_feature: Ceres CLONE 1533372-R
ggtcctcgagcgtctcgtttttttttttttttttgagtcaatcaaagatgtttgtatgtaacacttagggttggtccatacaattacagagaacaatatagccatataggagccacacaattaccatgacaaactgttttgaaggctcaaaaaggtggaaatcttgccaagtcttttcattggtcccttgtgtgtgtatcctcccagggaaagagaatggagtggcaaatgcagtgctagtatcactgacaccaggataaatagttcttaagctgtgaacatgatcaatcgattgctgatagctatctagccagctgtaatcatcgacctgtgggttctgcagtttttcaaccggaatagaatcatcttgacgctttggggttacatgattaaatcctggaggtggtccaacaggctttgatggacgactaacagggttcttcttcgaagcagttagtggtgcttctgtaagtttgattggcatgccacctgatggtgctattgaaggtacaactgaatcaagtgtagaggggacagtctctccagtaattttgacatgattatgcatcaggtttgcagtggtaccaccaggttgaataggtatctgagatgaataacccatagactgtaaaccactcaatccaggctgcaatctctgctctagatagccatttccagttatgttgacagtcttcagtccattcattaagaatatttcttgttctctgagaaatttcgaataatcggagctactaaaacattggaccattgatgcagatacacattggtcagagacaacatctggggaaagttaacc

SEQ ID NO: 64253 - DNA, 663 bp, Zea mays
  misc_feature: Ceres CLONE 1533372
  misc_feature: Encodes the peptide sequence at SEQ ID NO. 64254
ctccccgcggtggcggccgctctagaactagtggatcccccgggctgcaggaattcgtctcacccctagaaaaactctttccctcgctgtgcaatctcccccaaactcccctctcgaaccctcgctctcgtcgccagagcaagcaaagcgcagttgctgaaacccgtgcgctgttgatggatgatgaccgttcccatggatagtgctagcgcagccccgtcctctgcgcgggactttgctgagcgtctccttactaggaataatgaacttgaagatcagcttcgcaagtccgcacaatccaaagtcccatcagatcccagcatatggcttcagatgcgtgacaactttgagaagattattctcatagatcatgacctatctgaacagaaagaggtagagtatctcctatggaagttgcattacaaaagaattgaggacttcaggaggagcattagtgctgcaagctcagttgcatctcagagtgggaagagcaacgctaatccagatcgagtcaagagaattaaattaaccttcaaaagcttcctttcagaagcaactggcttctatcacgacttgatgttaaagatcaaatcaaatttgggccttccactcagttactttccagagggcatcgacaatgcaaacaactctgcgcgagataca

SEQ ID NO: 64254 - protein, 156 aa, Zea mays
  misc_feature: Ceres CLONE 1533372
MDSASAAPSSARDFAERLLTRNNELEDQLRKSAQSKVPSDPSIWLQMRDNFEKIILIDHDLSEQKEVEYLLWKLHYKRIEDFRRSISAASSVASQSGKSNANPDRVKRIKLTFKSFLSEATGFYHDLMLKIKSNLGLPLSYFPEGIDNANNSARDT

SEQ ID NO: 64255 - DNA, 815 bp, Zea mays
  misc_feature: Ceres CLONE 1533372-R2
cgtttgttgtacacttagggttggtccatacattacagagaacaatatagccatataggagccacacaattaccatgacaaactgttttgaaggctcaaaaaggtggaaatcttgccaagtcttttcattggtcccttgtgtgtgtatcctcccagggaaagagaatggagtggcaaatgcagtgctagtatcactgacaccaggataaatagttcttaagctgtgaacatgatcaatcgattgctgatagctatctagccagctgtaatcatcgacctgtgggttctgcagtttttcaaccggaatagaatcatcttgacgctttggggttacatgattaaatcctggaggtggtccaacaggctttgatggacgactaacagggttcttcttcgaagcagttagtggtgcttctgtaagtttgattggcatgccacctgatggtgctattgaaggtacaactgaatcaagtgtagaggggacagtctctccagtaattttgacatgattatgcatcaggtttgcagtggtaccaccaggttgaataggtatctgagatgaataacccatagactgtaaaccactcaatccaggctgcaatctctgctctagatagccattttcagttatgttgacagtcttcagtccattcattaagaatatttcttggtctctgagaaatttcgaataatcggagctactaaaacattgaaccctttgatgcagatacacatgggttcagaaaccacatcgggggaaagttaaacctgtggggcttgtgctgaaggaacaaaatgctgtggccccaatgcta

SEQ ID NO: 64256 - DNA, 689 bp, Zea mays
  misc_feature: Ceres CLONE 1533373
  misc_feature: Encodes the peptide sequence at SEQ ID NO. 64257
  misc_feature (259)..(259): n is a, c, t, g, unknown, or other
  misc_feature (260)..(260): n is a, c, t, g, unknown, or other
  misc_feature (262)..(262): n is a, c, t, g, unknown, or other
  misc_feature (265)..(265): n is a, c, t, g, unknown, or other
  misc_feature (268)..(268): n is a, c, t, g, unknown, or other
  misc_feature (350)..(350): n is a, c, t, g, unknown, or other
ggagctccccgcggtggcggccgctctagaactagtggatcccccgggctgcaggaattcgtctcacccctagaaaaagccgacgacgacggccgcgcgcgtttgttgtgtgtgtgtgtgtgtgtgtgtgtgtgtgtgtgtgtgtgttataagcgcgagggtttctggcgaggttgctaaagcgttagcgggggcgcccatggagcttgacgaggagacgttcttggacgagctcatgtcgctgcggcgggaggcggcnncngcngcntccgggcagtggcaagcagctgccgcctacacgggcggcggcggagacgaaggcatgatgatgggcgacctcctcttctacngcggggcgacggaagccgccgcgactgccaccagcggcggccgcatggaccagctctcgcccttccaccagcacgcgcccctgcaggtgcaggtgcaggggccccgcggggggccggaaccctaattctgaggaggaattcaacttccaatgcctccgccaaggtttgcaacccccaaaggggggcccggggtcccccataaaaaccgggggccaaaggccccccccgggcccggaaaaggccccctgccccctccccccaaaaccttgtggggaagaaaaaaaaaaaacggtccccctcccccaagggggaaaaaaaaagaagaccccgcgggtcccc

SEQ ID NO: 64257 - protein, 91 aa, Zea mays
  misc_feature: Ceres CLONE 1533373
  misc_feature (21)..(21): Xaa is any aa, unknown, or other
  misc_feature (51)..(51): Xaa is any aa, unknown, or other
MELDEETFLDELMSLRREAAXAASGQWQAAAAYTGGGGDEGMMMGDLLFYXGATEAAATATSGGRMDQLSPFHQHAPLQVQVQGPRGGPEP

SEQ ID NO: 64258 - DNA, 2827 bp, Zea mays
  misc_feature: Ceres CLONE 1533376
  misc_feature: Encodes the peptide sequence at SEQ ID NO. 64259
aaaacccgccagcatctccctccgagtccagggggcaggggcaccattaccgagtagtttaattagtgctagttgtattaccgttgttagtgacataattaccctcacgcgaagaacccctaccttggctagtcctcctacgtatacgtctcttctcttcgcttaatcttggtcggtgatttgattctgcacttcttgggcgcattgcagagggtgctcggtctgcagctatcttaggttaaccagtcgtgtgtggtctatcggtttcgatatagtactactgctctgttataatcagcggggaggaggaagatgacggtgacgccacggatcacggtgagcgacgggcggctgacggtgcgcggccgtacggtgctcaccggcgtgccggacaacgtgtcggcggcgcacgcggccggggcggggctcgtcgacggggccttcgtcggcgcccacgccggcgaggccaagagccaccacgtcttcactttcggcacgctccgggactgccggttcctgtgcctgttccggttcaagctgtggtggatgacgcagcggatgggcgtctccggccgcgacgtccctctggagacccagttcatgctcgtcgaggtccctgccagtgacggcgacggcgacgacgcccccgcgtacgtggtgatgcttccgctgctggaggggcagtttcgggcggcgctgcaggggaacgaccgcgacgagctgcagatctgcatcgagagcggggacaaggcggtgcagacggaccaggccgcgcacatggtgtacctccacgccggcgacaaccccttcgacaccgtcaccgccgccgtcaaggcggtggagaagcacctgcagacgttccaccaccgcgacaagaagaagctgccgtcgttcctcgactggttcggctggtgcacctgggacgccttctacaccgacgtcaccgccgacggcgtcaagaacggccttcagagcctgtccaagggcggcgcgccgccgcggttcctcatcatcgacgacggctggcagcagatcgcctccgagaacaagcccgaccccaacgtcgccgtccaggagggcgcgcaattcgccagccggctgaccgggatcaaggagaacaccaagttccagaccaagcccgacggagacggcgacggcgagcaggcggcgggcgggctgaagcgactggtggccgagaccaaggacgcgcacggcgtgaagcaggtgtacgtgtggcacgccatggccgggtactggagcggcgtgacgccgacggcggggacggcgatggagcgctacgagccggcgctggcgtaccccgtgcagtccccgggcgtgacgggcaaccagccggacatcgtcatggactcgctgtccgtcctggggctgggcctggtgcacccgcgccgggtgcgggacttctacggcgagctccacgcgtacctcgcctcctgcggcgtcgacggcgtcaaggtggacgtgcagaacatcatcgagacgctgggcgccggccacggcggccgcgtcgccatcacccgcgcctaccaccgcgcgctcgaggcctccgtggcgcgcagcttcccagacaacggctgcatctcctgcatgtgccacaactccgacatgctgtacagcgccaggcagaccgccgtcgtgcgcgcctccgacgacttctacccgcgcgacccggcatcgcacaccgtccacgtcgcctccgtcgcgtacaacaccgtcttcctcggcgagttcatgcagcccgattgggacatgttccatagcttgcatccggcggcggagtaccacggcgcggcgagggccatcggtggctgcccgatatacgtcagcgacaagccggggaaccacaacttcgagctgctcaggaagctcgtgctccccgacggctccgtgctacgcgcgcagcttcccggccggcccacacgcgactgcctcttctccgacccggcgcgcgacggcgcgagtttgctcaagatctggaacctgaacaagtgcggtggcgtggtgggtgtgttcaactgccagggagccgggtggtgccgcgtgaccaagcggacgcgcgtgcacgacgcgtcgccgggcacgctgaccggcaccgtgcgtgccgacgacgtcgacgccatagcgcgcgtcgctagtgacggcggcgggtgggacggcgagaccgtggtgtatgcgcaccgcacgcgggagctagtgcgacttccgcggggcgtcgcgctgcccgtgacgctaggcccgctccagtatgaggtgttccatgtgtgcccgctccgcgccgtcgtgccgggggtctcgttcgcgcccgtcgggctgctggacatgttcaacgccgggggcgccgttgaggagtgcgacgtgatcagcgatgctggcggcaaggccatggctctcagggttcgcgggtgcggtcggttcggcgcttactgctcgcgggagccggcgaggtgcctattggactcggcggaagtggagttcagctacgatatcgacactggcctcgtgtccgtcgacttgctggtgccggagcaggagctatacctttggacgctggagattatgatctaggtcgtgatgctgtgcgccgacgccaacgcttgccttcgcggctgagccattatgagtcggacgacattgtcatttgctatgtgcacgagagatagatgtattgtggtggtgttgtataattggcatggggagtgttttttttgttatgttcttatctgtatatcatacgtgctctgaatgttatataatacttgataataaaggatgggtgctcctttaatacgaataaaaaaaaaaaaaaaaa

SEQ ID NO: 64259 - protein, 756 aa, Zea mays
  misc_feature: Ceres CLONE 1533376
  misc_feature (7)..(740): Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
MTVTPRITVSDGRLTVRGRTVLTGVPDNVSAAHAAGAGLVDGAFVGAHAGEAKSHHVFTFGTLRDCRFLCLFRFKLWWMTQRMGVSGRDVPLETQFMLVEVPASDGDGDDAPAYVVMLPLLEGQFRAALQGNDRDELQICIESGDKAVQTDQAAHMVYLHAGDNPFDTVTAAVKAVEKHLQTFHHRDKKKLPSFLDWFGWCTWDAFYTDVTADGVKNGLQSLSKGGAPPRFLIIDDGWQQIASENKPDPNVAVQEGAQFASRLTGIKENTKFQTKPDGDGDGEQAAGGLKRLVAETKDAHGVKQVYVWHAMAGYWSGVTPTAGTAMERYEPALAYPVQSPGVTGNQPDIVMDSLSVLGLGLVHPRRVRDFYGELHAYLASCGVDGVKVDVQNIIETLGAGHGGRVAITRAYHRALEASVARSFPDNGCISCMCHNSDMLYSARQTAVVRASDDFYPRDPASHTVHVASVAYNTVFLGEFMQPDWDMFHSLHPAAEYHGAARAIGGCPIYVSDKPGNHNFELLRKLVLPDGSVLRAQLPGRPTRDCLFSDPARDGASLLKIWNLNKCGGVVGVFNCQGAGWCRVTKRTRVHDASPGTLTGTVRADDVDAIARVASDGGGWDGETVVYAHRTRELVRLPRGVALPVTLGPLQYEVFHVCPLRAVVPGVSFAPVGLLDMFNAGGAVEECDVISDAGGKAMALRVRGCGRFGAYCSREPARCLLDSAEVEFSYDIDTGLVSVDLLVPEQELYLWTLEIMI

SEQ ID NO: 64260 - DNA, 656 bp, Zea mays
  misc_feature: Ceres CLONE 1533377
  misc_feature: Encodes the peptide sequence at SEQ ID NO. 64261
  misc_feature (656)..(656): n is a, c, t, g, unknown, or other
cggcgtggcggccgctctagacttatgggatcccccgggttgcaggatttcttttcaccccttaaaaaaattcggccccacaatgtctttgacccaataaaaggtcaaaaaagggcgaatgcttcaggttttctctgctcggttaggttgctgtcgctcgttctgagtctaaggcctcaaccccctgctacctgaaagccaaaaaaaggaatcctcggccggcagcaggaaagaaaagccaccgtttgatcaccgaccgggcaaaagcaggccgcggccggccaccccgcccgtctctgtccaaccccgcaccagcgactcgccaagcgcaggcacaagaggggggctccatccatgaggcagccatgctggtgctcatcaacaggtatttcaggagcaggaacagcagcccggccggaggaggcggcaaaaagatggcgccggcggcggtctccagcgaccacctctgtttgccgggctgcgtgcccgtgcgcgccaagcgggcctcctcctccgccgccgccgcggccacggccaccacggcgcgggcgtcgcggcacaacttcgtcagggccgcggcgtcgggcctgctggcgggggcgcacttcaccaaccacgagtcgctgccgccgcttcccacgcgtacgccgagttcn

SEQ ID NO: 64261 - protein, 97 aa, Zea mays
  misc_feature: Ceres CLONE 1533377
MLVLINRYFRSRNSSPAGGGGKKMAPAAVSSDHLCLPGCVPVRAKRASSSAAAAATATTARASRHNFVRAAASGLLAGAHFTNHESLPPLPTRTPSS

SEQ ID NO: 64262 - DNA, 635 bp, Zea mays
  misc_feature: Ceres CLONE 1533393
  misc_feature: Encodes the peptide sequence at SEQ ID NO. 64263
tccccgcggtggcggccgctctagaactagtggatcccccgggctgcaggaattcgtctcacccctagaaaaaactactccgtctccaagtcgcgtcgtcgcactcgaatccatccatccatcgatcgccttcctctctttttatatcgcacccccccgcttccgctcgctcgatcgtcggagtaggcgggcggcatgctgcaggccagctcggagaggccggcgggcctgctgtgggtgcccgggacgagcccgtggccgacgatggacgcggggccgtcggcgagggcgcaggagatcgcgcggcggcgggaggagatgctggggatgctgcgcgacctcccggagtccgagtacgagctctcgctcaccgacctcgtcgagaaggccggggccgaagccgaagccgcgcccgcgaccgcccccaccaaggcagaggacgggaaggacccgggcgccgcgcggtcggcggcagctgcggggaggcacgagcggagggcgtcggcgcggcagcggggcagcggcgggagcagcttccgcagcagcagcgacggcgtcctgctcaacttctacatgccgcgctcgctcacccgcagcttcaccgcgccgcgacccgcccggacgccgtcgttcgc

SEQ ID NO: 64263 - protein, 146 aa, Zea mays
  misc_feature: Ceres CLONE 1533393
MLQASSERPAGLLWVPGTSPWPTMDAGPSARAQEIARRREEMLGMLRDLPESEYELSLTDLVEKAGAEAEAAPATAPTKAEDGKDPGAARSAAAAGRHERRASARQRGSGGSSFRSSSDGVLLNFYMPRSLTRSFTAPRPARTPSF

SEQ ID NO: 64264 - DNA, 625 bp, Zea mays
  misc_feature: Ceres CLONE 1533394
  misc_feature: Encodes the peptide sequence at SEQ ID NO. 64265
ctggagctccccgcggtggcggccgctctagaactagtggatcccccgggctgcaggaattcgtctcacccctagaaaaaactcctccacctctcccacccaacaacaaaacaagcctaatggcttcctctccatctcacgccactgcgttgcctacttgccctagaaccctcgccgccgcccctctttaggattcccatgtccctggtcgccccctgacacgcccgccccggatcctgcaccggaattccgcgtggaattccgggccgaaccgcctctctgcgtgcgcctccgaccaccaaactctctcacacgcgcgcgcgcgcacgtctgaggcggttggattctccggtgggggtcccttggtctcgatttgctgctgatgggggtgccgaagcagcgctggacgccggaggaagaggccgcgctcaaggccggcgtcgccaagcacgggcccggcaagtggcgcaccatcctccgggactcggacttcagcgcgctcctgcgcctccgctccaatgttgacctcaaggacaagtggcgcaacttgagcgtcaccgcaggaggttacgggtctagagagaaggcaaggatggcgttgaagaaggcaggcgcgtggtgccta

SEQ ID NO: 64265 - protein, 81 aa, Zea mays
  misc_feature: Ceres CLONE 1533394
  misc_feature (5)..(57): Pfam Name: Myb_DNA-binding Pfam Description: Myb-like DNA-binding domain
MGVPKQRWTPEEEAALKAGVAKHGPGKWRTILRDSDFSALLRLRSNVDLKDKWRNLSVTAGGYGSREKARMALKKAGAWCL

SEQ ID NO: 64266 - DNA, 668 bp, Zea mays
  misc_feature: Ceres CLONE 1533395
  misc_feature: Encodes the peptide sequence at SEQ ID NO. 64267
ccccgcggtggcggccgctctagaactagtggatcccccgggctgcaggaattcgtctcacccctagaaaaaagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgacccctagaccttcgccaagaaccgcgagctggaggtgatccactcccgctgggccatgctcggcgcgctcggctgcgtcttccccgagctgctctcccgcaacggcgtcaagtacggcgaagccgtctggttcaaggccggctcccatatcatcagcgagggcgggcttggactacctcggcaacccccatccttgatccacgcgccgaagcatccctcgccctccggggccctgccaaggtcgttcgctcattcgctcgcccgcactaagggctacccgaattttcacaggacgg

SEQ ID NO: 64267 - protein, 85 aa, Zea mays
  misc_feature: Ceres CLONE 1533395
MAASTMAISSTAMAGTPIKVGSFGEGRITMRKTVGKPKVAASGSPWYGPDRVKYLGPFSGEPPSYLTGEFPGDYGWDTAGLSADP

SEQ ID NO: 64268 - DNA, 689 bp, Zea mays
  misc_feature: Ceres CLONE 1533402
  misc_feature: Encodes the peptide sequence at SEQ ID NO. 64269
tggagctccccgcggtggcggccgctctagaactagtggatcccccgggctgcaggaattcgtctcacccctagaaaaaaaaaacgcttcgtccacagcccaactacccaagagcagagggcagaggatgcctcttgccgcaatggcgtcggcatcctcctcgccctgctcgcggcatcctctgatcttggtcgttctcttgtgcgccattgccgccatctctttctcttcctctgcagctgctggaaccgttggcagcggcacaggcggactgggccccatcagcaccaacgggaagaactacaccaaggtgtgcgaccccgcacggttcgtggcgctggggctcgacatgtcacgcttcaggtactgccacgcgtcgttgccgtacgccgaaccgggtgcgacgacctcgtgggcccgcctccgcgctggaagaacaaagggtgcccaaacctcgggggaaccagggtgttaagggggggcccccccccccctttgtggggtctttgacccccctttccgggtgattgtggggtgtctatgggttttttgatgcttcagtccttcagttccattacctacatctattgcctcgtacggggccgtttcccgttccttcactttggagtactgatgccgcgatcagcaccttggctctgctttgtttggatatattgctccgcgtatca

SEQ ID NO: 64269 - protein, 110 aa, Zea mays
  misc_feature: Ceres CLONE 1533402
MASASSSPCSRHPLILVVLLCAIAAISFSSSAAAGTVGSGTGGLGPISTNGKNYTKVCDPARFVALGLDMSRFRYCHASLPYAEPGATTSWARLRAGRTKGAQTSGEPGC

SEQ ID NO: 64270 - DNA, 668 bp, Zea mays
  misc_feature: Ceres CLONE 1533406
  misc_feature: Encodes the peptide sequence at SEQ ID NO. 64271
tgagctccccgcgggtggggccgctctagaactagtggatcccccgggctgcaggaattcgtctcacccctagaaaaaccacttgttctccctccctctctgcctgaccagctaggatcaccggaagcagcaatggtgatggcgtcatcaaacgggctgaggagctgcagcgccgtgggcgtgcccagcctgctggcgccgtcgtcccggtccggccgcctggcgcctttctgcgccaacatccaccacctctggccgcgtcaccatgtccacgaagtggatgcccggccagccacgccctgcccacctctacggctcctctcccggggacttcggcttctatacgctgagcctcacaaccgtgccagagaacttccagccgttcaagaagtcagaggtgtacgactgccgctgggccatgcttggcgtcccggggatctggatgccggaacctctgggcctgggcaactggctaaaggccccagaatgggccgccttcccccgttggcaaggccacgtacctggggggccccggttcccggggggcaaccctgcccaaacctcccggagaacaccaattctgtggcccattgccttttgcccgaaaaaaaagcgcacacctgggaaaaaaggccccccccaaaaaaaaaaaaatacccccccccgcg

SEQ ID NO: 64271 - protein, 134 aa, Zea mays
  misc_feature: Ceres CLONE 1533406
  misc_feature (10)..(100): Pfam Name: Chloroa_b-bind Pfam Description: Chlorophyll A-B binding protein
MSTKWMPGQPRPAHLYGSSPGDFGFYTLSLTTVPENFQPFKKSEVYDCRWAMLGVPGIWMPEPLGLGNWLKAPEWAAFPRWQGHVPGGPRFPGGNPAQTSRRTPILWPIAFCPKKKRTPGKKGPPQKKKNTPPR

SEQ ID NO: 64272 - DNA, 593 bp, Zea mays
  misc_feature: Ceres CLONE 1533408
  misc_feature: Encodes the peptide sequence at SEQ ID NO. 64273
  misc_feature (438)..(438): n is a, c, t, g, unknown, or other
tggagctccaccgcggtgggcggccgctctagaactagtggatcccccgggctgcaggaattcgtctcacccctagaaaaaaatttgcataagatcttcttcagtcttactcaaaaggtccaatagtgtatgtatattggcccttttgagacaactctcctcccccgctctcgacttcccatcccctgcggccccgccccccgactcttctcgtcgcggcgcgcccaatcggctcggtggcaggctagcgcaccggctcggctcgggtccggttctaccgccaacgcgggccgccgcgctcccggatctcggtctagtcagagagttagcagacaaagatggcgacttatgagcccaagaacattctcataactggtgctgctgggttcattgcatcgcatgtcgccaaccgtctggtcaggaactatccccaatacnagatttgtgcccttgacaagatggactactggctccaacctaaagaacctaaatctttcagggctttcaccaaaattaaaatttggccaagggggaaaattgcaaagggcggacccggggggaattacccttccggaacccccgggtcaatttgc

SEQ ID NO: 64273 - protein, 85 aa, Zea mays
  misc_feature: Ceres CLONE 1533408
  misc_feature: SWISSPROT Homolog: EC 4.2.1.46 dTDP-glucose 4,6-dehydratase
  misc_feature (34)..(34): Xaa is any aa, unknown, or other
MATYEPKNILITGAAGFIASHVANRLVRNYPQYXICALDKMDYWLQPKEPKSFRAFTKIKIWPRGKIAKGGPGGNYPSGTPGSIC

SEQ ID NO: 64274 - DNA, 675 bp, Zea mays
  misc_feature: Ceres CLONE 1533418
  misc_feature: Encodes the peptide sequence at SEQ ID NO. 64275
  misc_feature (409)..(409): n is a, c, t, g, unknown, or other
ggagctccccgcggtggcggccgctctagactagtggatcccccgggctgcaggaattcgtctcacccctagaaaaacaccagctgtccagctccacctcgtcgactcctccccgcacaagacaaaaaaaccctcgccttggagggtggaggcgcgtgagcccgacacccagagcgaaaaaagcaaggggtctgaccgccggcgatggcgtccatctccggagcggcggcggcgccatcttccgctgcgtgccggctgcggctgcgtaggcacatcctgctgcggccctcgcacctccgcctccgcgcgccccactccatcgccgacctctcccgctcctccagctcctctagttccgccccgacccgggcccagccgctgggctccaggccggagaacggcggcggcntccgcgcggtggagaaggacccgatcaagctgtgggagcgctacgtcgagtggctctaccagcacaaggagctcggcctcttcgtcgacgtcagccggatggggttcaccgaggacttcctgcgccagatggagccgccgatgcagcggggccttccccgccctggcgggagctccaagaagggcgccttcccccaccccggacgaggctcccatggggggcccactactgggttccgggacccgggcctcggggcccaattcctt

SEQ ID NO: 64275 - protein, 157 aa, Zea mays
  misc_feature: Ceres CLONE 1533418
  misc_feature: SWISSPROT Homolog: EC 5.3.1.9 Glucose-6-phosphate isomerase
  misc_feature (69)..(69): Xaa is any aa, unknown, or other
MASISGAAAAPSSAACRLRLRRHILLRPSHLRLRAPHSIADLSRSSSSSSSAPTRAQPLGSRPENGGGXRAVEKDPIKLWERYVEWLYQHKELGLFVDVSRMGFTEDFLRQMEPPMQRGLPRPGGSSKKGAFPHPGRGSHGGPTTGFRDPGLGAQFL

SEQ ID NO: 64276 - DNA, 591 bp, Zea mays
  misc_feature: Ceres CLONE 1533423
  misc_feature: Encodes the peptide sequence at SEQ ID NO. 64277
  misc_feature (245)..(245): n is a, c, t, g, unknown, or other
  misc_feature (256)..(256): n is a, c, t, g, unknown, or other
  misc_feature (387)..(387): n is a, c, t, g, unknown, or other
  misc_feature (434)..(434): n is a, c, t, g, unknown, or other
ctggagctccccgcggtggcggccgctctagaactagtggatcccccgggctgcaggaattcgtctcacccctagaaaaaatttcccatctctctctgcgccgtcccgtgctccctccgctagttctcccaattccttccccacctcctcggtcgtcgcctcccccagagagcaggagccgcctcgtccctgccggtcccgaccccgacccccatcccgtccgcgtccaacgccatgaatcccgnagtacgactancctcttcaagctgctcctcatcggggactccggtgttgggaagtcttgcctgctgctgaggtttgcggatgattcatatctggagagctatatcagtactattggagttgattttaaaatccgcaccgttngagcagatgggaaaagacataagctacagatttgggatactgctggncaagaacgctttaggaccatcacaagcagctactaccgtggagctcatgggcataattgttgtgtatgaatgtaactgacccaggaaagctttttacattggccaagccagtgcctgaatggaatttgatagggttggccccggggaaaatgtggaa

SEQ ID NO: 64277 - protein, 166 aa, Zea mays
  misc_feature: Ceres CLONE 1533423
  misc_feature (88)..(167): Pfam Name: Ras Pfam Description: Ras family
  misc_feature: SWISSPROT Homolog: EC 2.7.11.1 Non-specific serine/threonine protein kinase
  misc_feature (85)..(85): Xaa is any aa, unknown, or other
  misc_feature (129)..(129): Xaa is any aa, unknown, or other
GAPRGGGRSRTSGSPGLQEFVSPLEKISHLSLRRPVLPPLVLPIPSPPPRSSPPPESRSRLVPAGPDPDPHPVRVQRHESRSTTXLFKLLLIGDSGVGKSCLLLRFADDSYLESYISTIGVDFKIRTVXADGKRHKLQIWDTAGQERFRTITSSYYRGAHGHNCCV

SEQ ID NO: 64278 - DNA, 548 bp, Zea mays
  misc_feature: Ceres CLONE 1533424
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (229)..(229): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaaacggaactcacgtcggtggcggccgctctagaacagtggatcccccgggnctgcaggaattcgtctcacccctagaaaaaacacaccacaccacaccggccggctcaacgcgccgcaaacagagcacggggggctgagaccagagcagagcggagcgccaccagccaatcctttgcctgcccaagcagcagcagcagctggcccgatggctctgtctctctccgggtaactccgcccgcttcgccctcgggtcgctgggtccccggggcccagggccttaagccgggcgttccgggcggggggtcccgggggccccaataaaagggcccccccccggccgggaaaaaagggccccggggcccccgcggg

SEQ ID NO: 64279 - DNA, 652 bp, Zea mays
  misc_feature: Ceres CLONE 1533427
  misc_feature: Encodes the peptide sequence at SEQ ID NO. 64280
ggatcccccgggctgcaggaattcgtctcacccctagaaaaaaccgcgagtgacgcggcaacaaaaaaccatggcggatctgccgttctcgacgcggcggcccttatgcactccgtgcttcataatctgcttgctactcggattcgtcgccggcctcttccccttctggcactgccacctccacctctagctcgacctccgccacctcccgtctcgcggaccctcctcccgctgcacctacccagcgggccctaatccggccgccaccgacaacgaccataatctgtcgtgaccccgacccgcgcgcgcccactgcaagcatactaactgcatcgtctcgcgcaaaccctccgcctcgtcccgcagccgctgctctggctcgtcgtcgaccgatgcgccaccaagtacgagaacgccgcgctgctgcgcggctgcgacctcatgtacccccacctgcccatccgagtgccagcgcgacgcgcactgtgctcaattgaccaaagagctagcgcccggaaggagctctggccgtgttccatatgtaacaaagacgctccgaaccacatgcttagaaagaaacagcaaatccacggaccctggatactaaaattcatccacaacaagaaaacaacggggttaccctcgcccttgg

SEQ ID NO: 64280 - protein, 70 aa, Zea mays
  misc_feature: Ceres CLONE 1533427
MYPHLPIRVPARRALCSIDQRASARKELWPCSICNKDAPNHMLRKKQQIHGPWILKFIHNKKTTGLPSPL

SEQ ID NO: 64281 - DNA, 730 bp, Zea mays
  misc_feature: Ceres CLONE 1533429
  misc_feature: Encodes the peptide sequence at SEQ ID NO. 64282
ggagctccccgcggtggcggccgctctagaactagtggatcccccgggctgcaggaattcgtctcacccctagaaaaagatatggaaccctagtacaggggaatgccttcggaccattgactctggatatgggttgtcaagtgctttcgttggaaatcggtatgctcttgttggtacaaaaagtggtacgttggagattatggatattgctagtgggagcttaactgaggccatagaagctcatgctggctccatacggtcaattgtacctattccagattattatggaactgttggggcaccaggcttttttattggaattgcttattatgattgtcaggttgtgggaaatacatttttggtgcccaaatacgggggggggggggggggcaactttacttgtatctaattgcccaccccccttgaaaaatggaaggcaaaaggtccctcgactgtcttcgttccgggccccctagagaaaaaccacattggcctggtggaactgcctgggaattgccgagggtcaaaagcgtccttcccgaatggcaaaacccttggaaaccgctccttcaaaaccctctttatgggccccccaacgttccccagctccccttatccttgctctcatccgcccctatagtcacctctatccacgtataccgcgcacacaacccgcgtctcacccttgacaacgcccggcggccaaggcagttttatgccccctccccca

SEQ ID NO: 64282 - protein, 69 aa, Zea mays
  misc_feature: Ceres CLONE 1533429
MDIASGSLTEAIEAHAGSIRSIVPIPDYYGTVGAPGFFIGIAYYDCQVVGNTFLVPKYGGGGGGNFTCI

SEQ ID NO: 64283 - DNA, 719 bp, Zea mays
  misc_feature: Ceres CLONE 1533446
  misc_feature (451)..(451): n is a, c, t, g, unknown, or other
  misc_feature (489)..(489): n is a, c, t, g, unknown, or other
  misc_feature (490)..(490): n is a, c, t, g, unknown, or other
  misc_feature (579)..(579): n is a, c, t, g, unknown, or other
  misc_feature (590)..(590): n is a, c, t, g, unknown, or other
  misc_feature (604)..(604): n is a, c, t, g, unknown, or other
  misc_feature (628)..(628): n is a, c, t, g, unknown, or other
  misc_feature (663)..(663): n is a, c, t, g, unknown, or other
  misc_feature (665)..(665): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (706)..(706): n is a, c, t, g, unknown, or other
ctcaccgcggtggcggccgctctagactagtggatcccccgggctgcaggattcgtctcacccctagaaaaacaaagcagagagctgcaactcgtagaaaaacaacaaaaaacaagctcctactgcgagcatggattcgcttgtgaagcgcagcactggctatgggggcttactgcagcagcaagccccagatgagctaccaccgccagagcacctagtctgtgaccaccgtcgtcacggatattaaccgcatgaccatcaacgacgagccctactactgcagctgctgcggcttgcagaaacaggcctgcaagggtggaggcgttccatgagcaccacaaagcgtacaaaggcacccctggccgtgaagaaggcacgacgagtacgaggaggaccaaggaggagtaccggccaagtagtcctaccccggaagtaccgtgcccccttacgncgaacacccgctgtgacaaagcagcctacagctaccanncaggatgcgtacgtggagactcgaagctgcccgcggtacagtggcgcggtcatggataagcacaggctacatctacacctaagacacgntgcggagaagncgacgccgcctacngcgtcgcaccacgtttgacgcccngtgccgcccatgcagacgtaacgctacacccgcangnccgctgtactgtgggctaccatnnngtgtcgaccctgcaanccagcggctctac

SEQ ID NO: 64284 - DNA, 739 bp, Zea mays
  misc_feature: Ceres CLONE 1533450
  misc_feature: Encodes the peptide sequence at SEQ ID NO. 64285
  misc_feature (369)..(369): n is a, c, t, g, unknown, or other
  misc_feature (433)..(433): n is a, c, t, g, unknown, or other
  misc_feature (476)..(476): n is a, c, t, g, unknown, or other
  misc_feature (639)..(639): n is a, c, t, g, unknown, or other
  misc_feature (663)..(663): n is a, c, t, g, unknown, or other
  misc_feature (667)..(667): n is a, c, t, g, unknown, or other
  misc_feature (702)..(702): n is a, c, t, g, unknown, or other
  misc_feature (703)..(703): n is a, c, t, g, unknown, or other
  misc_feature (706)..(706): n is a, c, t, g, unknown, or other
  misc_feature (738)..(738): n is a, c, t, g, unknown, or other
ctggagctcaccgcggtggcggccgctctagaactagtggatcccccgggctgcaggaattcgtctcacccctagaaaaaattttgtaccaccaagaggatgtgtgaccaacttgcaaggacactcaccaggcagtttggagcttcggccattcatggtgacaagtcccaaagtgaaagggagaaggttctgaatcagtttcgatctgggcggtctcccattttagtggcaactgatgttgctgcgcgaggtttggacatcaaagatatcagggtagtgatcaactatgacttccccactggtgttgaagactacgttcacaggattggcaggacaggaagggctggtgccactggtgttgcatatacntttttttgtgatcgggattctaaatatgctggtgaccccccccaaattctggaaagggggcaanccaacaagtgcccccgtgatttaaaggatatggcttctcctgncggtggaccaggtaggaagagaaacctttgggattccccccctgacggggggggttcacctttctgaactgggatttcagggtcaaccccccaaatggaccaaacaactttgggggaaaccaaaagaggtcccggcagccctgtgaagggatgaataaggganacccttggcagtgaaacaccctgngtgnaaacctgatgcgcgactccccaaaaggactcccannagntgccccttttaagaccaaatacttcaatatgnc

SEQ ID NO: 64285 - protein, 147 aa, Zea mays
  misc_feature: Ceres CLONE 1533450
  misc_feature (7)..(83): Pfam Name: Helicase_C Pfam Description: Helicase conserved C-terminal domain
  misc_feature (112)..(112): Xaa is any aa, unknown, or other
  misc_feature (126)..(126): Xaa is any aa, unknown, or other
MCDQLARTLTRQFGASAIHGDKSQSEREKVLNQFRSGRSPILVATDVAARGLDIKDIRVVINYDFPTGVEDYVHRIGRTGRAGATGVAYTFFCDRDSKYAGDPPQILERGQXNKCPRDLKDMASPXGGPGRKRNLWDSPPDGGGSPF

SEQ ID NO: 64286 - DNA, 712 bp, Zea mays
  misc_feature: Ceres CLONE 1533456
  misc_feature: Encodes the peptide sequence at SEQ ID NO. 64287
  misc_feature (484)..(484): n is a, c, t, g, unknown, or other
  misc_feature (495)..(495): n is a, c, t, g, unknown, or other
ctggagctccccgcggtggcggccgctctagaactagtggatcccccgggctgcaggaattcgtctcacccctagaaaaagtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcacgccacggtggctgtaccacgtcggccagaaccttatattggattcagacattttcctccctcacgttgaggagcgtnaatttgctgcngcagggctgggatactggcagagagctttgtacgtgccgacgtcgtcggacgccatggtggtcgccttcaggaactggttcagaaaattctgcaggacccagtcggctgggcaaccctaaaaagtcgacaagttgccaccaaaccggtacccaggacagctcctggaaagtactggtcccccgtgtgcattgcaagaattaaaccgggccttaaggc

SEQ ID NO: 64287 - protein, 148 aa, Zea mays
  misc_feature: Ceres CLONE 1533456
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (106)..(106): Xaa is any aa, unknown, or other
MAAADVEYRCFVGGLAWATSNESLENAFASYGEILDSKVITDRETGRSRGFGFVTFSSENSMLDAIENMNGKELDGRNITPRWLYHVGQNLILDSDIFLPHVEERXFAAAGLGYWQRALYVPTSSDAMVVAFRNWFRKFCRTQSAGQP

SEQ ID NO: 64288 - DNA, 717 bp, Zea mays
  misc_feature: Ceres CLONE 1533459
  misc_feature: Encodes the peptide sequence at SEQ ID NO. 64289
  misc_feature (717)..(717): n is a, c, t, g, unknown, or other
ctggagctccccgcggtggcggccgctctagaactagtggatcccccgggctgcaggaattcgtctcacccctagaaaaaacacacacagagagagagagagagcgagcgagcgagagacagcgctgagctgagctgagctgatcatcttttcggcggcacatggcggttcttgacgcggcggtgacgccgtcgccgagcggcagggcggacgcggcggcggcggaccaggtcgccacgacgagcggctgcggcggccgcgcggcagaggaggcggaggcggtgctgctgcagcaggagcatgacggccaagggcgcgcgaagcgaaagcgctcgaggcgccgccgcgaccgcgacggccagcagcccaaggagccgaccacccaggaggagtacctggcgctgtgcctcgtcatgctggcgaccggccgccgcgacgccgacgccgacgccgcggctccgccgcaggaccacgcgtgctccgtctgcggcaaggcgttcccgtcgtaccaggcgctgggcggccacaaggccagccaccgcgccaagccctcgccctcgccttctccggcggcggcgctggcgccggagccgggcgcatgagacggggaccgccacgacgagaagaagccggcgcagccgtcctcgtcgtcggctgctccagacccggcggcgcggcgcacgagtgcaacgtgtgccggaaggcgttcccgacggn

SEQ ID NO: 64289 - protein, 146 aa, Zea mays
  misc_feature: Ceres CLONE 1533459
MAVLDAAVTPSPSGRADAAAADQVATTSGCGGRAAEEAEAVLLQQEHDGQGRAKRKRSRRRRDRDGQQPKEPTTQEEYLALCLVMLATGRRDADADAAAPPQDHACSVCGKAFPSYQALGGHKASHRAKPSPSPSPAAALAPEPGA

SEQ ID NO: 64290 - DNA, 646 bp, Zea mays
  misc_feature: Ceres CLONE 1533463
  misc_feature (510)..(510): n is a, c, t, g, unknown, or other
  misc_feature (511)..(511): n is a, c, t, g, unknown, or other
  misc_feature (521)..(521): n is a, c, t, g, unknown, or other
  misc_feature (535)..(535): n is a, c, t, g, unknown, or other
tggcggccgctctagaactagtggatcccccgggctgcaggaattcgtctcacccctagaaaaactccccgccccaccaaacactcccgcagacccacccgtccccgtccgtccacagccagctccgcctcccatccagcgcccgtccacagccaccacagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgtttcttcttcggtttggttctagttctagcagtgtactactactagtcgttaggttggtagccaagagaggttctttttccacacctcccttgcgcaagtgagtcctgtcctgagcggatctacccaccactgccatctgttttttactgtggctgttgggttccgccagnnttctcgtttngtctgggtttgctngagagaggaaaacaaaaaacaaaaaaacagtctagatggctgctgctatagatctgtcagggggagagctgatgagagcactccgagctttttatcgggatgcctctgctc

SEQ ID NO: 64291 - DNA, 672 bp, Zea mays
  misc_feature: Ceres CLONE 1533466
  misc_feature: Encodes the peptide sequence at SEQ ID NO. 64292
  misc_feature (469)..(469): n is a, c, t, g, unknown, or other
  misc_feature (472)..(472): n is a, c, t, g, unknown, or other
ctggagctccccgcggtggcggccgctctagaactagtggatcccccgggctgcaggaattcgtctcacccctagaaaaaacccgcttcactccccattcattctccgatccccttcccagcgggcagcggccgcaccacgcctgttcgcctctcgcgggacccagccccagcgggacccacgcggccacgccccacgccttcattcctccctttctcggcctcaaccgcttcctttttccccttgtaccatttgtccattttcgtgtcccaccagtcgcggtcgggcgattccgtctctggcatagcaagcaggcgcgtccgggccgtcgaggtcgagctgtggatccacgcggagatgcaagcgccacgtggcgatggcttcctcgggaagcggaaggagcgcgactattgcccgcatccctcagtgtcgccgacggagcaggcagccccgctccagcggcaaccgnccngcgtcgctaggcccgacccgcgtggcgtcaagctggatcgcccgggccgtgaaggtttgccgccaagccgccgcttcctcaacaggggggccaaggtcggggggcaacgggaacaaacttgctggcaggtatatttgggccacaaattccttgggggggggggaaccttctcccggggaagagggagggtcccgagcccc

SEQ ID NO: 64292 - protein, 105 aa, Zea mays
  misc_feature: Ceres CLONE 1533466
  misc_feature (38)..(38): Xaa is any aa, unknown, or other
  misc_feature (39)..(39): Xaa is any aa, unknown, or other
MQAPRGDGFLGKRKERDYCPHPSVSPTEQAAPLQRQPXXVARPDPRGVKLDRPGREGLPPSRRFLNRGAKVGGQREQTCWQVYLGHKFLGGGGTFSRGRGRVPSP

SEQ ID NO: 64293 - DNA, 679 bp, Zea mays
  misc_feature: Ceres CLONE 1533471
  misc_feature: Encodes the peptide sequence at SEQ ID NO. 64294
  misc_feature (73)..(73): n is a, c, t, g, unknown, or other
tccccgcggtggcggccgctctagaactagtggatcccccgggctgcaggaattcgtctcacccctagaaaangcgtccccgggactagttcagtcgcttcactgtggcggtggcctggccctgcgtgccgcgtgcgcgctgcagcagtgcggtagcgggcagatggccgactccacggccatgaccgtcgacttcctccgtgcgcggctgctctcccagcggtccgtctcccgcgccgccaaggagcgtgcggacgagctcgccaagagggtcgcgcagctggaggagcaggtcccggcggtgacggctcagaggccgcaggccgaatgaggccacccccaggtgctcccacccctcgagcccggggggggggggcgaccatctctcggaatggggccaaccccccccgccccctcttaaatccaggaccggcgaggaagaggacggcaagactccccgccaccccgaccggtgccccccgttaaggatgggcaaaagggacccccccgcctcccaaggggggaggccggaagaccccccttgctccgggaaccccgaggccaaccccggctgggctttccctggaaaaaggccccctccttttatgcgcgtctgcataagcccctctaacttccatgccgcctgccccacaggcggaactttcctgctccccttgta

SEQ ID NO: 64294 - protein, 55 aa, Zea mays
  misc_feature: Ceres CLONE 1533471
MADSTAMTVDFLRARLLSQRSVSRAAKERADELAKRVAQLEEQVPAVTAQRPQAE

SEQ ID NO: 64295 - DNA, 661 bp, Zea mays
  misc_feature: Ceres CLONE 1533473
  misc_feature: Encodes the peptide sequence at SEQ ID NO. 64296
tccccgcggtggcggccgctctagaactagtggatcccccgggctgcaggaattcgtctcacccctagaaaaatcttggacagcacagcgcagcgcaagctcgatcaccacaccaaccagactcagaacatccagaactcagagcttctacttctagaacagaagaacatcgagatcagtcctcccctgcatcctccaccggcctcacctagatgagcacctcgtacaccgaggcgcagttcggctccttgttagacctgcccgccggagacgacctcacgtcctggttcacacacctgtgcggcgaggagcaggcggcggccctgccggcgttccaggcgccggtggcgatggccgaccccaggaggaggagcggcgagtaccatctcctggagggggaggcgtccggggtcaagaggcaccgctccccgaccagcagctcccgggaaaccacgcccgcagcaatgacggcgactacgagccaccgtccgcagccgcagccccagccccagccggcggcggtggcggaagcaggggccggcgcccccccccctcggggtcaggagccgccccccccaggggggggaacgggttaacagccccgggggcccccagcaaaaaatttcgccccggccttccccgtgggcccggggggcccttg

SEQ ID NO: 64296 - protein, 127 aa, Zea mays
  misc_feature: Ceres CLONE 1533473
MSTSYTEAQFGSLLDLPAGDDLTSWFTHLCGEEQAAALPAFQAPVAMADPRRRSGEYHLLEGEASGVKRHRSPTSSSRETTPAAMTATTSHRPQPQPQPQPAAVAEAGAGAPPPRGQEPPPPGGGTG

SEQ ID NO: 64297 - DNA, 688 bp, Zea mays
  misc_feature: Ceres CLONE 1533474
  misc_feature: Translation starting site: 241
  misc_feature (467)..(467): n is a, c, t, g, unknown, or other
  misc_feature (472)..(472): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (635)..(635): n is a, c, t, g, unknown, or other
  misc_feature (636)..(636): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (663)..(663): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (676)..(676): n is a, c, t, g, unknown, or other
  misc_feature (679)..(679): n is a, c, t, g, unknown, or other
aaactggagctccccgcggtggcggccgccctagaaatagtggaacccccggggccggaggaatttcgtctcaccccttagaaaaacccggcggtcgccaccacaccagcaggaaggcagagcgcgcgggcgggctgggaaaagtacaccgttgatggcatctaccgccatcccgtccccgccgcctccggcagtgccggaacggaagagtgcccgctggtgccgcggctggcggaacgaatggcggcggggacggaaggggtgaacgcgcgagggagtagcgcgggaggtggcgggagcgggagcggcagcgtggcgggcatctcgccgagcatcctcgtcatcgcagtcatcgtggtggtgatgctgctcgcgtcgctgtgcatccactactttatccgccactctgccgcacgtggcccagcggggtccctctcctcctcctcctcttgtcccggaggctcgcnccccntttcccccnnnctttttttgtggggccgcgccccccccccnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnngnnngnnnnnngnnggnnngggggggggggggggggggggncgnnnnnnnnntnttntggtttctc

SEQ ID NO: 64298 - DNA, 664 bp, Zea mays
  misc_feature: Ceres CLONE 1533475
  misc_feature: Encodes the peptide sequence at SEQ ID NO. 64299
tccccgcggtggcggccgctctagaactagtggatcccccgggctgcaggaattcgtctcacccctagaaaaatcagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgctttctgataatcgaccagttcccccgtcttgctccctggactcttccctcctcatctcaagattgtgttctgaatcacctgctccgattgctggtgttc

SEQ ID NO: 64299 - protein, 50 aa, Zea mays
  misc_feature: Ceres CLONE 1533475
  misc_feature (1)..(50): Pfam Name: AdoMetDC_leader Pfam Description: S-adenosyl-l-methionine decarboxylase leader peptide
MESKGGKKSSSSRSMMYEAPLGYSIEDVRPAGGVKKFQSAAYSNCAKKPS

SEQ ID NO: 64300 - DNA, 724 bp, Zea mays
  misc_feature: Ceres CLONE 1533477
aagctggagctccccgcggtggcggccgctctagaactagtggatcccccgggctgcaggaattcgtctcacccctagaaaattttgtatcgctcttatgaaattttatacattactgcatttctcctgtgtttttgaggtacccttgtgtgtaatctgtcactcccatttgcagcatgtgtgtctcgtcttcataaatcactattctgcatgtatgtatgctacggatgctggtcactcgtgtctacattccaagaacattggctaaacctatatactgatgaaataataagaggatcattaggaataaaaatgaaacaaaaggctcttcaggaatgtgatttctattgttcaaaatatgctgagtgtgcacgaggaatatcattttctgtggaatggcaaccccgcaaacaagcaaaagagttgaatgagtgccttcatcaatatgttttaaacggcttgcctgctgctgtggtgagagctgtttcacagattcactagatcacgggttctaagcagcctctcctcattttgtaacatgatcgttgccacaatttatcaattatcccttccccagatcctacttatgtgggagtactctggcctgaacctccgccctcttgaatgtgccctctttgttttctcagtctgagacatatcactgaagcgttgcaagatgttcagctcttactctcgtttcaagcaagatgcacattgcatttgt

SEQ ID NO: 64301 - DNA, 715 bp, Zea mays
  misc_feature: Ceres CLONE 1533480
  misc_feature (352)..(352): n is a, c, t, g, unknown, or other
  misc_feature (426)..(426): n is a, c, t, g, unknown, or other
  misc_feature (446)..(446): n is a, c, t, g, unknown, or other
  misc_feature (467)..(467): n is a, c, t, g, unknown, or other
  misc_feature (503)..(503): n is a, c, t, g, unknown, or other
  misc_feature (511)..(511): n is a, c, t, g, unknown, or other
  misc_feature (535)..(535): n is a, c, t, g, unknown, or other
ctggagctcaccgcggtggcggccgctctagaactagtggatcccccgggctgcaggaattcgtctcacccctagaaaatagaaaaaacactatctattgccagttatgaggcctgttctttcatgggatgtaccagctccatcctggggacattgacttctttcattgacctctccccttacagaccttgtgggacttatcatttcttgacaagcagtgagcaattgattgttctcgcaaattcagatgctgtactgcagttgttattctactgccttcagttggatccccagcaacaactgcttgatgctgctgctagaagcttaagtgctcactggcagtacgaaccanttaaatactgcatacaggatatagtttgtgtggattacctgggaaacatctcatcagctgttccctgtaggcangcaggcagagtggcccttgnaagcatttgactgagcagggnagctatactgcaccttttctgcagctgctccatggnaagaaccnaagacggaaaacccaaccaaaatngttgaaaagtgccaaaagattccgggaaacttctcagggcccctaaaccaatcaaaaaaattcggggaaacccctgggcggtgggcttatcaaattccttaagggccccaagggggggggggtgtctttcttgacaccgtaaaaagggttaaacctccttgcgcccctgggaaaaaaaaa

SEQ ID NO: 64302 - DNA, 646 bp, Zea mays
  misc_feature: Ceres CLONE 1533483
  misc_feature (1)..(1): n is a, c, t, g, unknown, or other
ncccgcggtggcggccgctctagaactagtggatcccccgggctgcaggaattcgtctcacccctagaaaaacactcgttctatctccttctccactgggccaactccgctctactccccaatcccaggcgaatccctcgtcttcttcgaccgcgtgtcggagcttcgtcttctctggcccccctgccctgatttgccgctccgctctccccccttccgccggaaaggggggaaattgatggcgaggctagtggctctggcatcggcggtggcggttctggtactcggcctcgcctgtgcagaggcggagccacagtgcacgcggcgccgcccgcccgcgcccgcgcggccgcacagcgtgacgatcaccgagttcggggccgtggtgacggcgtcacccctcacaccgtgtccttcagaacgccgtcttctacctgcgctccttcgccgacaggggggcgcgcagctgtactttcccaggggcccttggctccacgggcagtttcaatctcacccggcccccttaccctcttcctggaaatgggccctgtcatccttgggcccccaggacgttcccaagtgggcctgttgttaaacccttgccctcctttgggccaagagaatggacctttcccaggtccgaggg

SEQ ID NO: 64303 - DNA, 584 bp, Zea mays
  misc_feature: Ceres CLONE 1533484
  misc_feature: Encodes the peptide sequence at SEQ ID NO. 64304
  misc_feature (356)..(356): n is a, c, t, g, unknown, or other
aagctggagctccccgcggtggcggccgctctagaactagtggatcccccgggctgcaggaattcgtctcacccctagaaaaaaccgatcggatcggcaaaatcccccaccagatcccggcgcccccaccacacagcgctcgcgcctccctgcttcccaattcccgtctgcccggccgcggagcggagctgctcctgccccccgtcgccacgccacgatggcggagtgccgcagcctcatcgagttcctccgcgcgttcgagcaccaccgcagggcggccgacagctccgcctccgcgtgctcccgatccaggcgggcgtccgccgccggtggctccttctgcgacacaccccgantgccgtgatcgacgcggtcatgctcctcggcgtcgtcatcgcgatcgggcttcctcctggatcccctaacttaagggtggcccccccctccaaaatggggggccaaaattcccccccccccccccgggtgttttttgttcttccggggggcgggccttttttttttttggggggggggcgggggtccccccttttcccccccccccgggggggggttcttcccgcggg

SEQ ID NO: 64304 - protein, 48 aa, Zea mays
  misc_feature: Ceres CLONE 1533484
  misc_feature (47)..(47): Xaa is any aa, unknown, or other
MAECRSLIEFLRAFEHHRRAADSSASACSRSRRASAAGGSFCDTPRXP

SEQ ID NO: 64305 - DNA, 724 bp, Zea mays
  misc_feature: Ceres CLONE 1533485
  misc_feature: Encodes the peptide sequence at SEQ ID NO. 64306
  misc_feature (444)..(444): n is a, c, t, g, unknown, or other
  misc_feature (445)..(445): n is a, c, t, g, unknown, or other
  misc_feature (462)..(462): n is a, c, t, g, unknown, or other
  misc_feature (469)..(469): n is a, c, t, g, unknown, or other
aaagctggagctccccgcggtggcggccgctctagaactagtggatcccccgggctgcaggaattcgtctcacccctagaaaaaaccgtccacctcagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtgnngtgaggctggtgctgantatgtcntggagtcccaccgtgttctcactgacagggacaggctgctgcacatctgaaggggtgtgcccaagaagttgttatcccctgcccaagcaaagatgccccatggttggttgttggggcaatgaggaacaagtaccctcccaaggtaacattgttttccaatggtagctggcccaaaaatggcttggtccccttgttaaagggattcaggaaaccttgtggtttatttgagggcttgaaaaaaaggtgtctgccccc

SEQ ID NO: 64306 - protein, 113 aa, Zea mays
  misc_feature: Ceres CLONE 1533485
  misc_feature (4)..(108): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (89)..(89): Xaa is any aa, unknown, or other
  misc_feature (90)..(90): Xaa is any aa, unknown, or other
  misc_feature (95)..(95): Xaa is any aa, unknown, or other
  misc_feature (98)..(98): Xaa is any aa, unknown, or other
MGKIKIGINGFGRIGRLVARVALQSEDVELVAVNDPFITTDYMTYMFKYDTVHGQWKHSDITLKDSKTLLFGEKPVTVFGIRNPEEIPXXEAGAXYVXESHRVLTDRDRLLHI

SEQ ID NO: 64307 - DNA, 721 bp, Zea mays
  misc_feature: Ceres CLONE 1533488
  misc_feature: Pfam Name: Oxidored_q4 Pfam Description: NADH-ubiquinone/plastoquinone oxidoreductase, chain 3
  misc_feature: SWISSPROT Homolog: EC 1.6.99.5 NADH dehydrogenase (quinone)
  misc_feature (483)..(483): n is a, c, t, g, unknown, or other
  misc_feature (491)..(491): n is a, c, t, g, unknown, or other
  misc_feature (502)..(502): n is a, c, t, g, unknown, or other
ctggagctccccgcggtggcggccgctctagaactagtggatcccccgggctgcaggaattcgtctcacccctagaaaaatatctaaatagaagggaaatcaaaaagaagggaagtggggattacattggatgaatccttaaggaagacatatcacaaaagaaataaaggctaaagtaagcgctccttgcctttggtttgagcaaaacagattcttgtttcaccgaggaaaagagagaagttctggataaattgacaatgtcaacttgaattgactaattcagttccgcctattccacattaatgggagtacatttatgtttctgctttacgaatatgatattttttggacatttctaataatagcaagccttattcctattttggtattttggatttcaggacttttagccccggttagtgaaggaccagagaagctttctagttatgaatcgggtatagaacccatgggggggggcttggntacaattncgaatacgctnatacatgtttgcgctagttttttgtgtttttgatgtggaaacagtctttccctaccctggggcaatgagtttcgacgtattgggggggattcgtttttatcgaagctttcatttttgggctttacctagtgtggtgggttaagttaagccggccgaaaaggaacctggaaaggcccttaccggaattttccaaaaaaaaaaaaaagaagggaaagttcc

SEQ ID NO: 64308 - DNA, 744 bp, Zea mays
  misc_feature: Ceres CLONE 1533489
  misc_feature (608)..(608): n is a, c, t, g, unknown, or other
aaagctggagctccccgcggtggcggccgctcttgaactagtggatcccccgggctgcaggaattcgtctcacccctagaaaaactcatcccctcagtcctcagtccctcacacactcactctacactgctctgctgacagcaagaaagaagaagctagcgcctccctagctctcgttgtcagcaatggccaccaccgccgcgtccagcctcctcaagtcctccttcgcgggctcccggctcccttcggccacgcgcaccaccaccccgtcgtccgtggacgtggccaccccgcgcgccggtggcagccccatccgcgcgtggatatcctcctctcacactctgcctacgacctgacgtccttccggtcagccccatcagagagtccatcgtgttccgtgagatgacccgaggttaatgatggacatgaacaccccccccaaacccaactgggaaacgtggcccccggccacgaggactttctcccgcgttaaattttccccggcccccccccttagggggcattggggaaacccttttttccccttgggggggaacattttttggggggagacactttttatcccctgggggggccccaaaacccgnaaccctttttttttgagaaaaatggggggggtggtaccaagagaggaccaaacaatatttggggggaaaccaacccgaggtgtttttttacaccccccctataaataaacccgtcccggtgggcgcaccaaaaaaa

SEQ ID NO: 64309 - DNA, 729 bp, Zea mays
  misc_feature: Ceres CLONE 1533511
  misc_feature: Translation starting site: 251
ctcaccgcggtggcggccgctctagactagtggatccccggggctgagggattccgtctcacccttagaaaaagctggcttctcctttctctcacggggaccacggggcgaaccaaccaaccgtccgctgcgctaccccgggggccaaggccttcttcgggtccttccccggcgaccagcagcaccaggcaattagacttgtgtaagaaaatgggatgctactgcccggttaattgcgacacagatttatatggacatagatattggggccatgtgtaagggcggaagctgttcctaccgcgtcaataaggggagtcctgctggttctaccaggaagatccgttcctcagccgctcaaggtcggatggcatctgacacagcgagggtaacgaaaacagaggcatcaaagctgaagaacctgatctcggcatcattcaaacccttgtctctgaccattcccatcggcgacggattccacgaatcgctccctttcagccattgtcatttatagtagagaaaggcctacaagaacgtcgaggtgctttctgcaggatctcatagtacttgcacgagctaggatgcagctcaagcctcctgcaagacccaagctctattcagggctcatgccccaagaagatttggatccgtaccgtgatctaataccaggcttgcctgaagacttggcgaagatatgtcttgcccttgtccctcgtgctcattttcctgccc

SEQ ID NO: 64310 - DNA, 673 bp, Zea mays
  misc_feature: Ceres CLONE 1533516
  misc_feature: Translation starting site: 146
  misc_feature: SWISSPROT Homolog: EC 1.13.11.12 Lipoxygenase
tccccgcggtggcggccgctctagaactagtggatcccccgggctgcaggaattcgtctcacccctagaaaaaatccctcactcactcactcactcactcacacagcaaatacccacagtccacactccacagcaagaaccgaagatgttcggaaacatcggaaagatcccgatcattggcgacctgacgggcagcaacaagaatgcgcacctcaagggcaacctggtgctcatgcgcaagaccgtgctcggcttcgacgtcaccagcatcgccggctccctcatggacggcctcggcgagttcctcggccgcggcgtcacctgccaactcgtcagctccaccgtcgtcgaccccaacaacgggaaccgcgggaaggtgggtcatgaggcgagcctggagcagtggctgctgcacctgcggccgctctagccggcgaggacagttccgcgtcacttcgactgggaggtggagagcacggcgtcccgggcgctatcatcgtgaggaacaacacgcctcccgagttcttctcaagaccatcaccatcgacgaggtccccggccaaggcccccttcggcttcgtaacaaactcatgggtggacccgcagtacaggtaccggtaaaaacggcgttttttttcccaaagaaacgtaacctccccaaacaaagcccggg

SEQ ID NO: 64311 - DNA, 656 bp, Zea mays
  misc_feature: Ceres CLONE 1533517
  misc_feature: Encodes the peptide sequence at SEQ ID NO. 64312
  misc_feature (528)..(528): n is a, c, t, g, unknown, or other
  misc_feature (579)..(579): n is a, c, t, g, unknown, or other
  misc_feature (602)..(602): n is a, c, t, g, unknown, or other
ctccccgcggtggcggccgctctagaactagtggatcccccgggctgcaggaattcgtctcacccctagaaaaagctctctctcagtctctctctccgtgagggaggaagttgggcttcgttctcgagtactcttcgttctcaggcggcccccggctgcttctgctggtcgccgcccagctccagttattagagaaataagggccagcctggttgcccgaggctgacccagcacctgcgatggaggagaaggctgtcacaaatggagcggcagctgctgatgttgctgctcctgataataaggataacaccaaggaagaggttagcaagagcaaggagccagtagcgaataaggatgctgaagagcagaacaaaggctcggaaaatggtgctgagggccattcaggtggagatgtcaatatggcagaggctgagatcactgaggaaggtggtggtggtgatgctggtgcggcaaagcaggtggattctggagatgtcaaaacggatgccgatacaaaggaagatgccnatgcgagaacagaagaaagtgaagatgccaagatgactgaggctgacgtangaagtacagagggtcaagataangaagagaagggagatgaagttgagaatacaaatgagcaggatgaatcgaaggag

SEQ ID NO: 64312 - protein, 139 aa, Zea mays
  misc_feature: Ceres CLONE 1533517
  misc_feature (97)..(97): Xaa is any aa, unknown, or other
  misc_feature (114)..(114): Xaa is any aa, unknown, or other
  misc_feature (121)..(121): Xaa is any aa, unknown, or other
MEEKAVTNGAAAADVAAPDNKDNTKEEVSKSKEPVANKDAEEQNKGSENGAEGHSGGDVNMAEAEITEEGGGGDAGAAKQVDSGDVKTDADTKEDAXARTEESEDAKMTEADVXSTEGQDXEEKGDEVENTNEQDESKE

SEQ ID NO: 64313 - DNA, 608 bp, Zea mays
  misc_feature: Ceres CLONE 1533525
  misc_feature: Encodes the peptide sequence at SEQ ID NO. 64314
tccccgcggtggcggccgctctagaactagtggatcccccgggctgcaggaattcgtctcacccctagaaaaaactggtcctcctctccactctctcttctccctcaataattctctccacccctgcttgctgcagcttcaagcactaccgaatcacggcgagtgggagcagaggagggaatcccatgtctccgcccctcgctggagcagatcattgtcagacccgacgtggagctgctgcgatacaaagctagcggagcctgctagctagcctgatccgtccgcagtccgatcgggatcgatgggtggggaggcgcctgagccgcggctgctgacccgggcgctgagcatccgcggcggtgaccgccgctgggttcccaaggagatgctgcaactcgtgatggggttcgtcgaggacccgcgcgacctggaggccgcgtctctggtgtgtcacgcgtgggaccacgtcgactcgctctctgggaagcacgtgagtgtgcctttctgctacgccgtttctacggcacgcctgctcgcgcggttcctgcggctagagtctctcgcagtgaacgggaagccccgcgcggtcatgtacggactcatacccg

SEQ ID NO: 64314 - protein, 102 aa, Zea mays
  misc_feature: Ceres CLONE 1533525
MGGEAPEPRLLTRALSIRGGDRRWVPKEMLQLVMGFVEDPRDLEAASLVCHAWDHVDSLSGKHVSVPFCYAVSTARLLARFLRLESLAVNGKPRAVMYGLIP

SEQ ID NO: 64315 - DNA, 691 bp, Zea mays
  misc_feature: Ceres CLONE 1533526
  misc_feature: Encodes the peptide sequence at SEQ ID NO. 64316
tccccgcggtggcggccgctctagaactagtggatcccccgggctgcaggaattcgtctcacccctagaaaaacttttttttctctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaggggtggtcagaaaaagagctaaaagcaatgcagtacttggagagaagagagtgtgagtacgacagaaaatatccatggtttctacagggaagaaatccctgaaacagctgtgacgggcgcctaatggtcgttccactccgatcaatgggaacagtactatctggcctgccccctgaggattg

SEQ ID NO: 64316 - protein, 76 aa, Zea mays
  misc_feature: Ceres CLONE 1533526
  misc_feature (3)..(76): Pfam Name: ChaC Pfam Description: ChaC-like protein
MVLWVFGYGSLIWNPGFDFDDKILGFIKGYKRTFNLACIDHRGTPEHPARTCTLETDDEAICWGIAYCVRGGQKKS

SEQ ID NO: 64317 - DNA, 748 bp, Zea mays
  misc_feature: Ceres CLONE 1533528
  misc_feature: Encodes the peptide sequence at SEQ ID NO. 64318
  misc_feature (1)..(1): n is a, c, t, g, unknown, or other
naaagctggagctcaccgcggtggcggccgctctagaactagtggatcccccgggctgcaggaattcgtctcacccctagaaaaaaacacacgacacaacaagtacccaaccactccttgattcccctttcggcctttcctccctctcgcattcatctccaccagcaggtcggacttcttgcgctccaagaactcggcgaggatggaaatgttttttggcagctttctcagtgaatcagtatcaccgcagaacctttttggacacccagatgtcgagagatgcccattcctgaggaatatcaatggagctacaaccttttccctcgcttctgctttgccagtagctactcaaggaggcaagggtccaatttttgaggaagggtcaggctttgagtcagcattcaagcttttccatggccgagatggaaatagtccccttttcagaagatcatatgtatctgatgaaaacccacatgagagcattgatgtcaggactgaccctgctctgccgtttaatccattggctgctagagcagcccacataagtctatcagcattttggacaattggttttgggcttcttccaccgccaagggcaaaagggaaaacaggaaccccaccaattttaattcgtcccccccgaagccccaaaaccccaattcagccttccttggaacaaaaggggtccaccccccctcccctggggcgttccccccataagggtgttggaaaaaggcccgggcccctt

SEQ ID NO: 64318 - protein, 182 aa, Zea mays
  misc_feature: Ceres CLONE 1533528
MEMFFGSFLSESVSPQNLFGHPDVERCPFLRNINGATTFSLASALPVATQGGKGPIFEEGSGFESAFKLFHGRDGNSPLFRRSYVSDENPHESIDVRTDPALPFNPLAARAAHISLSAFWTIGFGLLPPPRAKGKTGTPPILIRPPRSPKTPIQPSLEQKGSTPPPLGRSPHKGVGKRPGPL

SEQ ID NO: 64319 - DNA, 720 bp, Zea mays
  misc_feature: Ceres CLONE 1533530
  misc_feature: Encodes the peptide sequence at SEQ ID NO. 64320
  misc_feature (544)..(544): n is a, c, t, g, unknown, or other
  misc_feature (607)..(607): n is a, c, t, g, unknown, or other
  misc_feature (608)..(608): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (615)..(615): n is a, c, t, g, unknown, or other
  misc_feature (616)..(616): n is a, c, t, g, unknown, or other
  misc_feature (643)..(643): n is a, c, t, g, unknown, or other
ggagctcaccgcggtggcggccgctctagaactagtggatcccccgggctgcaggaattcgtctcacccctagaaaaagcagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaaaggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcagggagaagaaccctaagaaacagtctgtcgctgcggtggggaaagctgctggcgacaggtggaatccctgagcgagtcggacaagctccctatgtagcccaggctaacagctcaagctcgangtacacaagccatcgctgcctacaacaagggcaagagccctgcagctaagaagctccctgccnngnnngannaggggaaaattaaaagggtcctgcccngtccaaggccgaggtcatgcccaggttaattaaaagggttgggggggggtaaaattttttccccggttgggggcctc

SEQ ID NO: 64320 - protein, 82 aa, Zea mays
  misc_feature: Ceres CLONE 1533530
  misc_feature (41)..(81): Pfam Name: HMG_box Pfam Description: HMG (high mobility group) box
MKGAKSKGAAKADAKLAVKSKGAEKPAKGRKGKAGKDPNKPKRAPSAFFVFMEEFRKEFREKNPKKQSVAAVGKAAGDRWNP

SEQ ID NO: 64321 - DNA, 716 bp, Zea mays
  misc_feature: Ceres CLONE 1533535
  misc_feature: Encodes the peptide sequence at SEQ ID NO. 64322
  misc_feature (473)..(473): n is a, c, t, g, unknown, or other
ctggagctcaccgcggtggcggccgctctagaactagtggatcccccgggctgcaggaattcgtctcacccctagaaaaaacctctccctctccgtcgcgacacaggccacggcgggcggcggcggaggcttccgtgcggctcttggcggattgaacgcccactcgaagctgcgccggcggctgtttcagccgtccttagatagaccctgctttcctcccgggcgaatcaaagttgcacatgccgacaccagtgaagtcggtgctccccgtggtgctcctcggctgcggcggcgtcggccgctacctcctccgccacatcgtctcctgtcgtcccctccacgccaaccagggcgtggccatccgggtggtgggcgtcgccgatagctcctccctgctcgtcgccgaagatgtccactccaccggcctcgatgacgcgctcctcacccagctctgcgcccgcaagtccgcaggntctcccctctcctccttgctcggccgaaggcactgtcagctgttcaggaaccctgaagctaggggcaaatcatagacgccgctacccacttggaaataacaactgcctggtgcaaattgactgttccgcaactttgaacctgttaacctggctaaaaaaacctggggaacagggaagcctgtgccaattggaaaaacaaaaaccctcttcccggggtttaaaaaaattttcaaaagtgggccc

SEQ ID NO: 64322 - protein, 102 aa, Zea mays
  misc_feature: Ceres CLONE 1533535
MPTPVKSVLPVVLLGCGGVGRYLLRHIVSCRPLHANQGVAIRVVGVADSSSLLVAEDVHSTGLDDALLTQLCARKSAGSPLSSLLGRRHCQLFRNPEARGKS

SEQ ID NO: 64323 - DNA, 634 bp, Zea mays
  misc_feature: Ceres CLONE 1533549
  misc_feature: Encodes the peptide sequence at SEQ ID NO. 64324
  misc_feature (634)..(634): n is a, c, t, g, unknown, or other
aagctggagctccccgcggtggcggccgctctagaactagtggatcccccgggctgcaggaattcgtctcacccctggaaaaaaccaccattcgactccacagctggaggatgaagctcagaagtcacagcattcaaatcaatctctctctttctctctctctctcacaggaggtaagccatggcagacttgcctttggcagaagggctgatggaccttcgcaactgcttgctctctccgaagccagcgccacccttgccactccccgcgctccgccgcatgcacacaagcgccacggctacgacggccccgtccccgcgccatgcggtccccgaactccactccactaccgagctggcggacgggagcatcgtcttccgtttcggccatcctaagtccaaggcgctggagccggagccggcgagcgtaaagaccagcccttactccagagttgcccctgcctcgggcgctgtgcccggcagccagatggagccggagattgactctgaacatggattagacggcgtgcgaataggcaccacggctggggttgagaagccgagcccgaatgccgcagccgaggcctggccgacacctccacctcctgacgccggcgcggtaacaggtgccactn

SEQ ID NO: 64324 - protein, 151 aa, Zea mays
  misc_feature: Ceres CLONE 1533549
MADLPLAEGLMDLRNCLLSPKPAPPLPLPALRRMHTSATATTAPSPRHAVPELHSTTELADGSIVFRFGHPKSKALEPEPASVKTSPYSRVAPASGAVPGSQMEPEIDSEHGLDGVRIGTTAGVEKPSPNAAAEAWPTPPPPDAGAVTGAT

SEQ ID NO: 64325 - DNA, 656 bp, Zea mays
  misc_feature: Ceres CLONE 1533550
  misc_feature: Encodes the peptide sequence at SEQ ID NO. 64326
ctggagctccccgcggtggcggccgctctagaactagtggatcccccgggctgcaggaattcgtctcacccctagaaaaaagcccgaaacgcgagcgcaatcaacacccaccattacccaccgcagcaggcagcagcggcgttcgcaatggcggctcgtcttgcctgagcagagcttcaaggagcgcgcgcattggcgccgcccgcggcgtggcccatcgccgccgatcgccggcgcccccgtcaccgcgttgtgttggcggaacagcttaagccagcttgctgcgccgtcaagaagccgaaacgcggcgtccccgcggatggcggcccgccgtctggcgacgacgctgacgctgctggcggccgcgttcctggccgccgccggcgcagcagcaggcagcaagccctcggcgaagttcgagctcatccaccgggagcaggcgccctgtgacgaggtggcgcgcatggaccaggagcgcacggcgttcatctcctcgcacgctcgtcgccgccgcgccacggaggcggccgccggtgccaagcccaaggcgagggctagggcgaaggccacgccgccggcggacgaggccttcgcgatgccgctctcgtcgggcgcatacaccggcacccggccagtacttcgtgccctttccgcgg

SEQ ID NO: 64326 - protein, 112 aa, Zea mays
  misc_feature: Ceres CLONE 1533550
MAARRLATTLTLLAAAFLAAAGAAAGSKPSAKFELIHREQAPCDEVARMDQERTAFISSHARRRRATEAAAGAKPKARARAKATPPADEAFAMPLSSGAYTGTRPVLRALSA

SEQ ID NO: 64327 - DNA, 892 bp, Zea mays
  misc_feature: Ceres CLONE 1533552-R
  misc_feature (382)..(382): n is a, c, t, g, unknown, or other
gaattgggtacctcgagcgtctcgtttttttttttttttttgtgagcaaaacaaaactcattgcattatctggtaagtgaaacaacaatacaaccatcgctgttcaagagtttcaatgaaaatgccaccacttggcatatcagttttaagcagtagaatagcaataacctaaggatggtacatcaggcatagcagttgcaacagatacaaggcaaccaagaaaggcatctcaaacttccccagcatctgaaaggcatctgcatctcaaacttcccagcatctctaaacaagggtagctagccaacataaactacacctattgtgcctcctctgtatctcggctcttcttcttcttctcttttttcttctcactcttctcggnacctgtgccatctccaatctgagcactctctggttctgcagcatcacttgcttccttgctcttctttttcttctttttcttctcactccccttctcgtcacccgtagcaacctcctccttgccctcaacgacctcagctggctctgactcgcccttgtctttctttttcttcttcttcttctcaatcttctcccctttcactgcttcagtggcttcctcaaactttgatcttcttcggcaggaaacagaaagcatcagttaccctccagcattcctccctttctggcctctttattttttcattctcccttgaacctcttcaagttaaaagactgcgttcccgggctcccaccttttaaccttcttctgggttccaggaaaccgggctggccaaaggctttggaaaattgtaaaaaaattcccccaccccgggggggggaaataacaccccccaatttctcccaaaaacaccaccccccaagtttggggggggtctccttccccacccta

SEQ ID NO: 64328 - DNA, 644 bp, Zea mays
  misc_feature: Ceres CLONE 1533552
  misc_feature: Translation starting site: 132
  misc_feature (266)..(266): n is a, c, t, g, unknown, or other
  misc_feature (268)..(268): n is a, c, t, g, unknown, or other
  misc_feature (405)..(405): n is a, c, t, g, unknown, or other
ggagctccccgcggtggcggccgctctagaactagtggatcccccgggctgcaggaattcgtctcacccctagaaaaatttcccttcgccgcgaaaaccctagaaactacccaccccgactgcccgccgccatgtcatccacaacgccggccatcgcgtcccccgcctctgagcaagccaaatcgaagaaaaagaagcacagatcgaaggacgacccctccgctgctgccgccgacccaccgtcgctcgctgaggccgaggagaananggaactgatggctacctcatcaagccgcagtcccttgttccgtccctcgacacctccacctggccgctcctcctcaaaactacgaccgccttaacgtccgcacccggcactacaccccgctaccctccggccactcnacgctcaagcgccccctcgccgagcatctccgttacggcatcatcaaactcgacaagccgtcgaacccgtcctcccacgaagtggtcgcctggatcaagcgcatcctccgcgtcgagaagaacggtcacagcggcacgctcgaccccaaggtgaccgggaacctcatcgtctgcatcgaccgcgcaacgcgccttgtcaggtcgcaccagggcgctggcaagaatacgtctgcgttccc

SEQ ID NO: 64329 - DNA, 632 bp, Zea mays
  misc_feature: Ceres CLONE 1533553
  misc_feature: Encodes the peptide sequence at SEQ ID NO. 64330
  misc_feature (83)..(83): n is a, c, t, g, unknown, or other
  misc_feature (87)..(87): n is a, c, t, g, unknown, or other
tcaccgcggtggcggccgctctagaactagtggatcccccgggctgcaggaattcgtctcacccctagaaaaagttggaattnaagnttcctcggaagaacaacagcaagcctccatggttggatgaaggaagggtattatgaattcttttcgcccgactctactacgacctacgctccgtacattcctctcgtctgacgtctccgcgactacgtatctgtgcctcacatcgccttttctcctccctggaccaagtctccgcacatgcttccgcctccgcggccctggccgatgttgtacgcgtgccggacgctgaggagtcgctagaggaggaatctgcgcccgaggcggaggctgaggcgcccacttcgttcgagctcccacggctgccgcggccgaagctgaccgtgaaggagcggaaggagctggcctctgacgctcacggcactcggcaaagagctcagatcgcaacaggtcggtaagagcggcgtcacaccgaaccttgtcaccgccttcagtgacaagctcgagtccaacgagcctcctaaagctaaaaattcaagggaactgcactggggagctacctgatgtgatactgcaccttgaggaggtcacaggatccatcgctcgtg

SEQ ID NO: 64330 - protein, 41 aa, Zea mays
  misc_feature: Ceres CLONE 1533553
  misc_feature (28)..(28): Xaa is any aa, unknown, or other
  misc_feature (29)..(29): Xaa is any aa, unknown, or other
HRGGGRSRTSGSPGLQEFVSPLEKVGIXXSSEEQQQASMVG

SEQ ID NO: 64331 - DNA, 656 bp, Zea mays
  misc_feature: Ceres CLONE 1533557
  misc_feature: Encodes the peptide sequence at SEQ ID NO. 64332
  misc_feature (512)..(512): n is a, c, t, g, unknown, or other
ctggagctccccgcggtggcggccgctctagaactagtggatcccccgggctgcaggaattcgtctcacccctagaaaaaccgacggatttggcagctgggaaatgggatctcaccagatcccataagcgcgcgccacctaacgcagacactgcatcctctacaaatgaaacccctgagacagtcagacgtcccgtgctcgtcatcaccacccacatctcagttcaccccggcgtcgtcctcttcccccggcgctactctcccgctccacgttccaaaggaaagatggcgtcccatattgttggataccctcgcatgggccccaagagagagctcaagtttgccttggagtctttctgggatgggaagagcagcgccgatgatttagagaaagttgcctctgacctcaggtctagcatctggaagcaaatgtcagaagctgggatcaagtacattcccagcaacaccttctcgtactatgaccaggtccttgataccacgtgccatgctggntgctgtcccagagcgctactcttggactggaggcgagattggcttgagcacctatctctcaatggccagaggaaatgccactgtccctgctatggagatgaaccaagtggtttgatacaaactaccactttattggtccctgac

SEQ ID NO: 64332 - protein, 124 aa, Zea mays
  misc_feature: Ceres CLONE 1533557
  misc_feature (2)..(123): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSSADDLEKVASDLRSSIWKQMSEAGIKYIPSNTFSYYDQVLDTTCHAGCCPRALLLDWRRDWLEHLSLNGQRKCHCPCYGDEPSGLIQTTTLLVPD

SEQ ID NO: 64333 - DNA, 625 bp, Zea mays
  misc_feature: Ceres CLONE 1533559
  misc_feature: Encodes the peptide sequence at SEQ ID NO. 64334
tggagctccccgcggtggcggccgctctagaactagtggatcccccgggctgcaggaattcgtctcacccctagaaaaaatattccttcgtgccgtcacttgctggcctaaaccctgccaccacttgagtctccgcgttctccgcgtctcactttcttctccgttctccgttccgctcccctcttcataacgaagccctagtgtctcgcggacatggcgtctggtctagaggagaaactcgcagggctctcaacgggcggcgacgggcgaaaccctccgccggcgagtgacggcggagaggagccgcagctctcgaagaatgcgaagaccagagaggacaagaggtaaaagctggaagaggagcggaggctctcggaggaacagaagaagaacaaggttgcggctgccaacggaagacctcggaaggcatctgctgctgacgatgatgacatggatcccactcaatgctatgagaataggctcaaggctcttgattaactgaaggccacacgtgtaaacccctatccccataagttcacgagtggggttgtctggacccgaatacattttagaactacatgaccctggagcgagggggaagaaccttactgatgtggcgagaggg

SEQ ID NO: 64334 - protein, 44 aa, Zea mays
  misc_feature: Ceres CLONE 1533559
  misc_feature: SWISSPROT Homolog: EC 6.1.1.6 Lysine--tRNA ligase
MASGLEEKLAGLSTGGDGRNPPPASDGGEEPQLSKNAKTREDKR

SEQ ID NO: 64335 - DNA, 695 bp, Zea mays
  misc_feature: Ceres CLONE 1533576
ctggagctccccgcggtggcggccgctctagaactagtggatcccccgggctgcaggaattcgtctcacccctagaaaaaacagcaaccgccgtcgccctcccccgccaaaatcgcaacaagaatgtccacaagccacagccttgtcttgtcttctgtatctacatcctctcgcaattccccatcgtcttctacccttctgtcctccgatccccaccctccggttaactcctcaccaagaaaaaggaaccggccgtcctcattcctgtcggcgctgttctttcctcgccattaccggcgtataaaaacagccctcggcctgatcacacagcatccggccaagcgggactagtccctgtcgtctgtccaccaccctctgcaagtacgtctcctcctcccgtctgtctctctctgtgtgtcggtctgccgttcccgccgccgccgccgcagatgggcctgttcagctcgccggccaatgtgtacaaaccggtccgcccacgtggacctcggccccggcagcgacgagctctacatcagccccaatgtcaaagctccccgggtcaccaggctccatggtgatgatcgtcgctgtggatgcatgcagatgcccatcgtcggggcagatcgtggctctacatccatgaagtagtgactacctcatccaaaaagtcaggtagcccaacgcccatcatcgcg

SEQ ID NO: 64336 - DNA, 622 bp, Zea mays
  misc_feature: Ceres CLONE 1533577
  misc_feature: Encodes the peptide sequence at SEQ ID NO. 64337
ggagctccccgcggtggcggccgctctagaactagtggatcccccgggctgcaggaattcgtctcacccctagaaaaaacgctcgccttattcataaccacaccggctaagcgccactgcacacgtcactcgctgtccgttctagcataccgcaccacacttcggcgccggtccgcgagcagatcaacagatggccacggcgacctacctctcctcctcctccttctcctcgccgccgccgcccccgtcatcacgcgcccgcctgcggcggcagacgaccagggcgggcgcgtcggcggcgacggaccgcccgcgcgaggtgctgtccccgaagcgccggctcccgctgcgggaggtgccgggtgactacggcccgccggtgctgggcgcggtccgcgaccggttcgagtacttctacgggccgggcggccgcgacggcttcttcgcctcccgcgtgcgcgcgcacggctccaccgtggtgcggctcaacatgccgccgggccccttcgtggcgcgcgacccgcgcgtggtggcgctcctggacgccgcctccttcccggtcctcttcgacacctcgctcgtcgacaagacggacctgttcacgggcaccttcatgccgtcc

SEQ ID NO: 64337 - protein, 144 aa, Zea mays
  misc_feature: Ceres CLONE 1533577
  misc_feature: SWISSPROT Homolog: EC 4.2.1.92 Hydroperoxide dehydratase
MATATYLSSSSFSSPPPPPSSRARLRRQTTRAGASAATDRPREVLSPKRRLPLREVPGDYGPPVLGAVRDRFEYFYGPGGRDGFFASRVRAHGSTVVRLNMPPGPFVARDPRVVALLDAASFPVLFDTSLVDKTDLFTGTFMPS

SEQ ID NO: 64338 - DNA, 668 bp, Zea mays
  misc_feature: Ceres CLONE 1533578
  misc_feature: Encodes the peptide sequence at SEQ ID NO. 64339
agctccccgcggtggcggccgctctagaactagtggatcccccgggctgcaggaattcgtctcacccctagaaaaaccctagaaaaaaacgataacggtcctaaggtagcgaaattccttgtcgggtaagttccgacccgcacgaaaggcgtaacgatctgggcactgtctcggagagaggctcggtgaaatagacatgtctgtgaagatgcggactacctgcacctggacagaaagaccctatgaagctttactgttccctgggattggctttgggcttttcctgcgcagcttaggtggaaggcgaagaaggcccccttccgggggggcccgagccatcagtgagataccactctggaagagctcggattctaaccttgtgtcagacccgcgggccaagggacagtctcaggtagacagtttctatggggcgtaggcctcccaaaaggtaacggaggcgtgcaaaggtttcctcgggccagacgggacattggtcctcgagtgcaaaggcagaagggagcttgactgcaagactcacccgtcgagcagagacgaaagtcggccttagtgatccgaccgtgccgagtggaagggccgtcgctcaacggataaaagttactctagggataacaggctgatctttccccagagtccacatcgacgggagg

SEQ ID NO: 64339 - protein, 79 aa, Zea mays
  misc_feature: Ceres CLONE 1533578
MSVKMRTTCTWTERPYEALLFPGIGFGLFLRSLGGRRRRPPSGGARAISEIPLWKSSDSNLVSDPRAKGQSQVDSFYGA

SEQ ID NO: 64340 - DNA, 635 bp, Zea mays
  misc_feature: Ceres CLONE 1533580
  misc_feature: Translation starting site: 134
  misc_feature: Pfam Name: FtsH_ext Pfam Description: FtsH Extracellular
cgcggtggcggccgctctagaactagtggatcccccgggctgcaggaattcgtctcacccctagaaaaaagttcctcggcttcgctcccttcccctccctgctccggctccggttcgcacacagtaagaaaagatggcgctgccatccatgagtcttgcggcaaagggtgtgcttcccttctcagcacgtacctcgagtggtgtcacacaaaggccggtgtcagtgaccgcttccttggagcacaaaaccagcgatgccagaaggaagttcctaaaacttgcgcttgggaaccttggagttggactgcccaccttgttgggcgctaagaaagctctcgctgatgagcaaggcgtctcgtcgtcgagatgtcttattcgaggttccttgagtatcttgacaaggatagagtgaagaaggttgatttgtttgagaatgggacaattgctattggggaggccattttctctgaccttggtacccgcatggcaagagtccctgtgcagcttcctgggccaaaccagaagcttcttccaaaagttgaagggaaaaaaacatcgatttttgcgggctcaaagaaaccaagaaaaaacccgggttcccttttgtttaaaccttattgggaaaatttggcttt

SEQ ID NO: 64341 - DNA, 679 bp, Zea mays
  misc_feature: Ceres CLONE 1533581
  misc_feature (153)..(153): n is a, c, t, g, unknown, or other
  misc_feature (159)..(159): n is a, c, t, g, unknown, or other
  misc_feature (209)..(209): n is a, c, t, g, unknown, or other
  misc_feature (226)..(226): n is a, c, t, g, unknown, or other
  misc_feature (240)..(240): n is a, c, t, g, unknown, or other
ggagctccccgcggtggcggccgctctagaactagtggatcccccgggctgcaggaattcgtctcacccctagaaaaactcgccgggccgatccgggcggaagacattgtcaggtggggagtttggctgggagcgcacatctgttaaaagatnacgcangtgtccctagatgagctccacgagaacacgaatctcgtgtagaacaaaangggtaaaagctcgtttngatcctaattccangtaccaataccgacccctgaaagcgtgggccattcgattccttaaaccttccaaatttgagccccgaagggtccaaaaaatttccccacggggtaacttgcgttttggcgcccacacgttttttagggccttggcccttttatccctccaaggatgggccctccctttctttttgaagaccaattccccaaaaggttgggatggtgtccccccccaattttggaaactcgcccgcggtgtttacccccccgtggagacaggcgggttttttcccccccccgagtacccccccccccccttctttattttatccccccttcaaaaagaaaacaccttggttttcccccccctgtggcccccccgccctttgttggaaaaaaacaaaggtggggggaaaactaatccttacccccccccctccccaaaaaaattccccctc

SEQ ID NO: 64342 - DNA, 713 bp, Zea mays
  misc_feature: Ceres CLONE 1533585
  misc_feature: Encodes the peptide sequence at SEQ ID NO. 64343
  misc_feature (450)..(450): n is a, c, t, g, unknown, or other
  misc_feature (452)..(452): n is a, c, t, g, unknown, or other
  misc_feature (475)..(475): n is a, c, t, g, unknown, or other
aagctggagctccccgcggtggcggccgctctagaactagtggatcccccgggctgcaggaattcgtctcacccctagaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcacccgacacgagcggggctcatcggcggacgctgcccaagaaaccagggtcgccaattggaaccccaacccaacacccgtccttcgatgccaaggcggttgatcgggaggnangttctcttgacccgtcaggtgcnagatgacctgaagctttgggccgttccaagtcattcccaggggcctggtgaccaacccctggattggaggccacctccagggggaaagaaaaaacctttttcctccttgaggaaaacctccccccagggggcccccccagaaaggagaggaaattggtgaagacccctcctttggtttcccccactaaaaaaaacccggtgggggaaaggggcccccgccttatttttaaaaccaccc

SEQ ID NO: 64343 - protein, 79 aa, Zea mays
  misc_feature: Ceres CLONE 1533585
MAKSEGPAIGIDLGTTYSCVGVWQHDRVEIIANDQGNRTTPSYVGFTRHERGSSADAAQETRVANWNPNPTPVLRCQGG

SEQ ID NO: 64344 - DNA, 635 bp, Zea mays
  misc_feature: Ceres CLONE 1533590
  misc_feature: Encodes the peptide sequence at SEQ ID NO. 64345
tggagctccccgcggtggcggccgctctagaactagtggatcccccgggctgcaggaattcgtctcacccctagaaaaaacgagttcgccgtggcgcgccacccgccaccagtcagtcccgccgcgccgataaaccctccctccccgaatcggagaaaccgcatctctgagattcccctccgacacccgccgtccgcgctgggtgggatctcccatccggacccgtcttccgactcattgtccctagaatttctcctccacacagagtccaccggcttccggagcccgactcgtttcgtcatccgcgcctggtctcgtcagttccggcgcgcctagcagattcgtggcccttcctcgtacacaattcgggggctgggtgggtagggccccttttccgcctagcgggttgcgtgcggccggcggtgttgcttggaaggcaaatcgagtgtttagggggccgcgcgcgtgcgggggcggtgggaaataaagctactagggttggtggggtcattagcggagctgtgtgaggcgacgatggggctgggggctgcggtggcgctggcgctgggcgacccgccggcggactacgcctccatcgcggcggtggggctgttcgtggcgctcatgtgcgtctg

SEQ ID NO: 64345 - protein, 33 aa, Zea mays
  misc_feature: Ceres CLONE 1533590
MGLGAAVALALGDPPADYASIAAVGLFVALMCV

SEQ ID NO: 64346 - DNA, 644 bp, Zea mays
  misc_feature: Ceres CLONE 1533592
  misc_feature: Encodes the peptide sequence at SEQ ID NO. 64347
acccgcggtggcggccgctctagaactagtggatcccccgggctgcaggaattcgtctcacccctagaaaaaaaggaagaagggcctcctgtctcacttccctcagtcctcgtccgtctctgctctccctcctctctctctctctacctagctagctagctagccttcctgtagcgcggcagatatggctgcctccaccacggcggcggcggcgctgctgctgctcctcctgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgccgccgacgcgggcgtccactccttccgcctcggcctcaaccgcttcgccgacctcacaaacgacgagtaccgcgccagctacctcggcgccaggacaggccgcagagggagaggaagctcgcgccaggtaccacgccgccgacacgaggaactgcccgaatccgtcaactggaggccaagggcccttcccgaggccaagaccagggaacttgcggaactgtggggtt

SEQ ID NO: 64347 - protein, 153 aa, Zea mays
  misc_feature: Ceres CLONE 1533592
  misc_feature (41)..(101): Pfam Name: Inhibitor_I29 Pfam Description: Cathepsin propeptide inhibitor domain (I29)
  misc_feature: SWISSPROT Homolog: EC 3.4.22.14 Actinidain
MAASTTAAAALLLLLLSLAAAADMSIVSYGERSDEEARRMYAEWMAAHGRTYNAVGEEERRYQVFRDNLRYIDAHNAAADAGVHSFRLGLNRFADLTNDEYRASYLGARTGRRGRGSSRQVPRRRHEELPESVNWRPRALPEAKTRELAELWG

SEQ ID NO: 64348 - DNA, 688 bp, Zea mays
  misc_feature: Ceres CLONE 1533593
  misc_feature: Encodes the peptide sequence at SEQ ID NO. 64349
  misc_feature (231)..(231): n is a, c, t, g, unknown, or other
  misc_feature (598)..(598): n is a, c, t, g, unknown, or other
agctccccgcggtggcggccgctctagaactagtggatcccccgggctgcaggaattcgtctcacccctagaaaaagtctgctcaagacgagggaggagcagagaccgaactctgccgtctcttcctcctccctctgcacccccacgagctccatggccgccaccgccatgattgggattaccaacctacgttgccgccacgacccgctctcctcccttccccgggctacngtcgtcggccgcccggtcctgtacactgcttcctcctcgatgccgccgccattcttattgctgctccccttcctcctccgtctctcagtgccgggaccgggtccgaccaacagctagcactgaagcgcatccctgccgccaacacgtgcttcatggcgtcagacgactatgaggccaccacgcttgaacgatcatcgtagggcgacccttcggcgcctccatatcgtccccagactccaccgctggcatcaggacactccgaccgtgctcccaagggagtgctgcccgaccttatcggggtggcgcccctgctcgttgaccctgggcatcctgccggccagggacagtccttcaaggaaggattccncccccccgaccctaaatttcccaaagccccttttccgcttggtctgggtttttcaaggggcaatattttctcaacactttggggcgcccc

SEQ ID NO: 64349 - protein, 96 aa, Zea mays
  misc_feature: Ceres CLONE 1533593
  misc_feature (67)..(67): Xaa is any aa, unknown, or other
MRPPRLNDHRRATLRRLHIVPRLHRWHQDTPTVLPRECCPTLSGWRPCSLTLGILPARDSPSRKDSXPPTLNFPKPLFRLVWVFQGAIFSQHFGAP

SEQ ID NO: 64350 - DNA, 652 bp, Zea mays
  misc_feature: Ceres CLONE 1533596
  misc_feature: Encodes the peptide sequence at SEQ ID NO. 64351
  misc_feature (37)..(37): n is a, c, t, g, unknown, or other
  misc_feature (44)..(44): n is a, c, t, g, unknown, or other
  misc_feature (52)..(52): n is a, c, t, g, unknown, or other
  misc_feature (66)..(66): n is a, c, t, g, unknown, or other
ctccccgcggtggcggccgctctagaactagtggatnccccggnctgcaagnattcgtctcacctntagaaaaattccctctcttcctcccgaaatttcccacctcagactccgagagaagcaaacacaagaagaagaagaaaaaaaaccgtccgcacaaaaaagaaaacggcagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggccctgctcgcggtcgccgccctcacgtgctgcgccgtcgcggagccgccgccgagcgagcggggggctctgctggcgttcctcaccgcgaccccgcacgagcgccgcctcgggtggaacgcctccaccccggcgttcggctgggttggggtcacgtgcgacaacgccaactccaccgtcgtccaggtgcgcctcccgggcggtgggcctcgtcgggcgccttcccgccgggcacgctcgggcgggttaccaaccctccgcgtggtctggctcccgctccaccggcgtcctcgggaccgtcccccgaaacgtggttcgggtttgcaggcccaaggggggtgtg

SEQ ID NO: 64351 - protein, 126 aa, Zea mays
  misc_feature: Ceres CLONE 1533596
  misc_feature (29)..(66): Pfam Name: LRRNT_2 Pfam Description: Leucine rich repeat N-terminal domain
MAGPSVPAAALAALLAVAALTCCAVAEPPPSERGALLAFLTATPHERRLGWNASTPAFGWVGVTCDNANSTVVQVRLPGGGPRRAPSRRARSGGLPTLRVVWLPLHRRPRDRPPKRGSGLQAQGGC

SEQ ID NO: 64352 - DNA, 667 bp, Zea mays
  misc_feature: Ceres CLONE 1533597
  misc_feature: Encodes the peptide sequence at SEQ ID NO. 64353
  misc_feature (659)..(659): n is a, c, t, g, unknown, or other
actggagctccccgcggtggcggccgctctagaactagtggatcccccgggctgcaggaattcgtctcacccctagaaaaaaccaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcgagtacgatgcgctgctcgtcgaccgcttcctcaacatcctccaggacctccacgggcccagccttcgcgaatttgtccaggagtgctacgaggtgtcggccgactatgagggcaaaggagacacgacgaagctgggcgagctcggcgccaagctcacggggctggcccccgccgacgccatcctcgtggcgagctccatcctgcacatgctcaacctcgccaacctggccgaggaagtgcagatcgcgcaccgccgccgcaacagcaagctcaagaaaggtgggtcggccgacgagggctccgccaccaccgagtccgacatcgaggagacgctcaagcgcctcgttgtccgaggtcggcaagtccccccaaggaggtgttcgaggcgctcaangaaccaga

SEQ ID NO: 64353 - protein, 168 aa, Zea mays
  misc_feature: Ceres CLONE 1533597
  misc_feature: SWISSPROT Homolog: EC 4.1.1.31 Phosphoenolpyruvate carboxylase
  misc_feature (166)..(166): Xaa is any aa, unknown, or other
MASTKAPGPGEKHHSIDAQLRQLVPGKVSEDDKLEYDALLVDRFLNILQDLHGPSLREFVQECYEVSADYEGKGDTTKLGELGAKLTGLAPADAILVASSILHMLNLANLAEEVQIAHRRRNSKLKKGGSADEGSATTESDIEETLKRLVVRGRQVPPRRCSRRSXNQ

SEQ ID NO: 64354 - DNA, 692 bp, Zea mays
  misc_feature: Ceres CLONE 1533599
  misc_feature: Encodes the peptide sequence at SEQ ID NO. 64355
  misc_feature (410)..(410): n is a, c, t, g, unknown, or other
  misc_feature (439)..(439): n is a, c, t, g, unknown, or other
ggagctccccgcggtggcggccgctctagaactagtggatcccccgggctgcaggaattcgtctcacccctagaaaaagttcacaacctcctccacgaccgaacgagcagagcagacccttccccctcaccagctccgggttccagcggcggcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaagttgctcaactacaacacactggagaagactgagacaagttaagtgagcaagcatatcatgctctgaaagcacntactgttcgcagtatcatatatattgtanggcggtattgttgttccctctctatcaggaaaagattgtttgtgaagggaaacttgcttttgcccccgagccttcaaagactgaaaagggcatggttgcacctttgtttccaaggtgggaaaatttaatcgatttaccggcctacctataaaaaaaaaaaaaaaaaccccccccccccttgggggggggccttaaaaaaaaaaaaggggtggcccccggtttcccccaaaaattggagggggggggggttttc

SEQ ID NO: 64355 - protein, 71 aa, Zea mays
  misc_feature: Ceres CLONE 1533599
  misc_feature (1)..(60): Pfam Name: RNA_pol_N Pfam Description: RNA polymerases N / 8 kDa subunit
  misc_feature: SWISSPROT Homolog: EC 2.7.7.6 DNA-directed RNA polymerase
MIIPVRCFTCGKVIGNKWDLYLDLLQADYSEGDALDALELFRYCCRRMLMTHVDLIEKLLNYNTLEKTETS

SEQ ID NO: 64356 - DNA, 669 bp, Zea mays
  misc_feature: Ceres CLONE 1533601
  misc_feature (540)..(540): n is a, c, t, g, unknown, or other
ctggagctccccgcggtggcggccgctctagaactagtggatcccccgggctgcaggaattcgtctcacccctagaaaaagccgagctcagtagcgagagcttgtaacctgagcgggggcattaaggtggtgcggatgctttgcgatggctttctgtgcctgggctcgctttgtgcctttggccggcctgcccgtcccaagtttggtggtggctggcggacgctttagcagaagctttggtctctgcagacctgaagtggcaggaatggcgtgagctggcttcacagagcagcgatcactgcccgcttccaacggtgggaggataacaggccgctgcacttcgaaccaggctagctcccccactcaaaagccccacctcctccccgtgtcaaaacctccaagtccatcgcccaggtggccggcgaggcggctaccgccgccgtagagacgatggacgacgcgttgggctccgcagtgggtcccacgtcagcgagcctcgtctagactcgcgccgcctctccctctctcattcctcctccnactgccgctccgccaagggcaacggtacgctcgtcgctgcgccgggtctcgggttccccaggctgaggacgggaccaggaagcccttcctcatatgcttgtgtggaggcaccacctcgggcaagacacg

SEQ ID NO: 64357 - DNA, 746 bp, Zea mays
  misc_feature: Ceres CLONE 1533979
  misc_feature: Encodes the peptide sequence at SEQ ID NO. 64358
acccgcggtggcggccgctctagaactagtggatcccccgggctgcaggaattcgtctcacccctagaaaaaacccgcggcatctataacaaccggtccagcactttcaagctcagctccagcaatggctgcctccaccatggggatctcctccacggggatggccggcacccccatcaaggtgggctccttcggagaaggccgcatcaccatgtgcaagaccgtggggaagcccaaggcggcggcggccggtagcccctgcaacggccccgaccgcgtcgagtacctcggacccttctccggcgagcccccgagctacgtgaccggcgagttccccggcgactacagctgggagcccggcgggatgtcccccgaccacgagaccttcacaaataatcgcgacccccatgtgatatgagtccgctgggccatgctcggcgcgctcggctgcgacatcccccaactgctccaccagcaagggggcaagttcggaaaggccaaactggctcactgacgcgcccccaaagcgcaccccgagggcggggtggggaacctcgagaagacccctccctgatccactagcagagcattcccgacaacctaatcccgcccggacccctctgcagagaggcctgtctagaccaaacctcaaatgccgacaagaacagctaaatcacggccagcaaaccgactgtactcagggaatgaacacgtctattccttaagcggatgatacaaaaacccct

SEQ ID NO: 64358 - protein, 97 aa, Zea mays
  misc_feature: Ceres CLONE 1533979
MAASTMGISSTGMAGTPIKVGSFGEGRITMCKTVGKPKAAAAGSPCNGPDRVEYLGPFSGEPPSYVTGEFPGDYSWEPGGMSPDHETFTNNRDPHVI

SEQ ID NO: 64359 - DNA, 652 bp, Zea mays
  misc_feature: Ceres CLONE 1533980
  misc_feature: Encodes the peptide sequence at SEQ ID NO. 64360
  misc_feature (508)..(508): n is a, c, t, g, unknown, or other
  misc_feature (558)..(558): n is a, c, t, g, unknown, or other
gctctagaactagtggatcccccgggctgcaggaattcgtctcacccctagaaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggacccctccgtgagcgtcngcatcgtggagcagtccgtgtcccccgggcgcgggccgtggctgggcggncacctgttctccgccatggtggtgcgcagggcggcgcacttgttcctggaccaactgggctggggctacaaccaggccaagaaatacctgtggg

SEQ ID NO: 64360 - protein, 162 aa, Zea mays
  misc_feature: Ceres CLONE 1533980
  misc_feature (62)..(161): Pfam Name: Thi4 Pfam Description: Thi4 family
  misc_feature (115)..(115): Xaa is any aa, unknown, or other
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGLSCAYELSKDPSVSVXIVEQSVSPGRGPWLGGHLFSAMVVRRAAHLFLDQLGWGYNQAKKYLW

SEQ ID NO: 64361 - DNA, 943 bp, Zea mays
  misc_feature: Ceres CLONE 1533983-R
  misc_feature: Translation starting site: 256
  misc_feature: SWISSPROT Homolog: EC 1.11.1.15 Peroxiredoxin
ttgggacctccagcgcctcgtttttttttttttttttgaccacatgaatatgctggtcgatcaaacgagccacaatcttgtgatagatacactcactgaaagatggaactaaacatcgggtcctcatctcttggttacatacactacactactacataatccggtacttttactgagaccaatgcatatcatggcccacaacagtgaggaggttgatcggatcatagggtctgctggatcttgagcgtctcacaaatgtacttctcgcgccggaactggttgttgtacacgtacttcacgacgccctgcttgtccagtacgtacctctggcgccccggccgcgtcccgaacaggtccgacgggacgccccactccttgcgcactcggttcccctcatcacacaacagcttgaacggcagcctgtacttctgcccgaactacttgtgcgatgccgcgtcatcaccccttatgccgattacctccgccccggccttcttgaacttcccgtacgagtccctgaacgcgcacgcctgctttgtgcatccggtcgtctcgccccccgtgtatgaagtaaaccccgacgggcttgccccttgaacttgttccgcgacacgggcctttcccgttctggtcctcgaaaggtgaaagttccgccggccaccttgcccctgggtaaaccttgcccccacaatattgcccgtgcgacatccgccctagctgggcccctgtttttgttctcggttccgttaaaatgctgtcctcccgcctttccccctgtaaaccggtagtgcaagtgctttccaaaggaatttccccctggccgccatgcgctccggttcatagtgggcaacaccctagctgccattccccagtgcaatccttgcactattgccgtatcctggcgtgaaatgctttgtttgttgtatcttctcggtcaaatctt

SEQ ID NO: 64362 - DNA, 726 bp, Zea mays
  misc_feature: Ceres CLONE 1533987
  misc_feature: Encodes the peptide sequence at SEQ ID NO. 64363
ctccccgcggtggcggccgctctagaactagtggatcccccgggctgcaggaattcgtctcacccctagaaaaaaacccaaagaacagagagaaattactgaagcatgagcgcggagctgaagagggactacgagatcggcgaggagatcgggcgcggccgcttcggggtggtccaccgctgcacgtcccgcgccaccggggaggccttggccgtcaagtccgtggaccggtcgcggctgggcgacgacctggaccgcgagctcgcgcagctggagccgaagctggcgcagctcgccggcgcgggcaacccgggcgtggtgcaggtgcacgcggcgtacgaggacgaggcgtggacgcacgtggtcatggacctgtgcccgggcccggacctggggaaaatggggtggggccgccgccgcggcgcgcccgtgccggagcccgtggccgccgccatcgtcgcgcaggtcgcgcaggcgctcgcgctctgccaccgccgcggcgtcgcccaccgcgacgtgaagcccgagaacatcctcatcgacgccgacgacgacgccgggagcgacgaggaggaccaggccgaggcggcgccgcgcgcgcgcctggcggactttcggtcggcggcgtgggtgggcgccggtgggctcgggcgcgccgagggcttgtggggacgccccactacgtggcgcccgaggtggtggccggcgcaagtacggcgcccagcg

SEQ ID NO: 64363 - protein, 207 aa, Zea mays
  misc_feature: Ceres CLONE 1533987
  misc_feature (9)..(199): Pfam Name: Pkinase Pfam Description: Protein kinase domain
  misc_feature: SWISSPROT Homolog: EC 2.7.11.1 Non-specific serine/threonine protein kinase
MSAELKRDYEIGEEIGRGRFGVVHRCTSRATGEALAVKSVDRSRLGDDLDRELAQLEPKLAQLAGAGNPGVVQVHAAYEDEAWTHVVMDLCPGPDLGKMGWGRRRGAPVPEPVAAAIVAQVAQALALCHRRGVAHRDVKPENILIDADDDAGSDEEDQAEAAPRARLADFRSAAWVGAGGLGRAEGLWGRPTTWRPRWWPAQVRRPA

SEQ ID NO: 64364 - DNA, 772 bp, Zea mays
  misc_feature: Ceres CLONE 1533988
  misc_feature (772)..(772): n is a, c, t, g, unknown, or other
acccgcggtgggcggccggctctattaactagtggatcccccgggctgcaggaattcgtctcacccctagaaaaaacttaggccgtcacaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctccctgggcgagccagttgatgaaaagaacctccctcttggcctcgaaggccgagggggcctggtcgggcgcttgttggcctcccgaaggcggcccgggccggtttccccttaaagcgcccccccaccccggagggggggggcgtccccaggggggtggcaaccccatccaccccccaaaccccctttatttgggaagccttggaaaaaacccgggtccccctccacgaccccccgttttggggtgggggggaaaccttctcccaacacttttcgggggctttaagggagacctctccctgggaagccccccctgttggtttgggggggctcaagaggttcggcctccccctctcccggtttcacatccttcccggggggcgcctttgtcgcggccttcaggggcccccctctctcctctcatccgcccttgttctgagatagatgcgcggcgcttcttctgcccccctcgggcttctgtggctctcctttacatggggtccgccacctaggtgtcggtgcctccccn

SEQ ID NO: 64365 - DNA, 790 bp, Zea mays
  misc_feature: Ceres CLONE 1533991
  misc_feature: Encodes the peptide sequence at SEQ ID NO. 64366
aagtagtggagctccccgcggtggcggccgctctagactagtggatcccccgggctgcaggaattcgtctcacccctagaaaaaatcccttggttgccgcagcctccaaagccactcccaaacccccgcttccagaaccttctcgaagctccccgccgcctcctccactcgcagcgatggcgaaggaaccaatgcgcgtgctcgtcactggcgccgcaggacaaattggatatgccctggttcccatgattgctaggggtgttatgcttggtgcagaccagcctgtttttctgcacatgcttgacattccgccagcagctgaagcccttaatggtgttaagatggagttggttgatgctgtttttcccccccccggaggggggggggggggccactgatgttgtgaaattcttccccccccccacatgggggccgccatggatgggtagaattccccggggagggatgggaatgggaaaagaaaacatgttatggcccaaaaaagggttcaatccaacaaatcccccagcgattcgcccctttgaatcccccctggcagcttcccaattgccagggacccgggaggactgcccaccccccgtgaaacccccagtggcccccttccgcgtggaagacagttccgcccccactaagcccctgaagagcagcctctgcttttgcgtgatctcctgtctggtccttgcgaacgggggctccctctgacccgcgttctcaaggcaacctttgtggcccatagtatccgtggatggcgtcgtaacgtgtctgctgc

SEQ ID NO: 64366 - protein, 73 aa, Zea mays
  misc_feature: Ceres CLONE 1533991
  misc_feature: SWISSPROT Homolog: EC 1.1.1.37 Malate dehydrogenase
MAKEPMRVLVTGAAGQIGYALVPMIARGVMLGADQPVFLHMLDIPPAAEALNGVKMELVDAVFPPPGGGGGGH

SEQ ID NO: 64367 - DNA, 721 bp, Zea mays
  misc_feature: Ceres CLONE 1533998
  misc_feature: Translation starting site: 174
tcaccgcggtggcggccgctctagaactagtggatcccccgggctgcaggaattcgtctcacccctagaaaaagcgccgccacttccctcccgacccactatcccaaaaccgtagcgccctcgcctgctcgccgccgccgtcgttgcgagctccccatcttcctccgtcaaccatggcgacccagatcagcaagaagaagaagttcgtcagcgacggcgtgttctacgccgagctcaatgagatgctgacgcgggagctcgcggaggactgctactccggcgtggaggtgcgcgtcacaccgatgcgcacggagatcatcatccgcgccacgcgcacgcataacgtgctcccccagaagggcggggggggggggggatctcacttctgtcctccaccaaaggttcaacttccccgagaacggcgtcgagctctacgccgagaaggtcgtccaaccgcgggctctgcgcccttcgcgcaaggtgaatccctcccgcacacagcccctcgaaggccttggcgccccgaagggccggctatggggttcttgcccttggtaagggaaaagcggcgcccaaggtttgtcaacgccattgggagggaaaaccccagggctcaacaaacccaagtcccttgaatttcacgggggggtctcgtgacgcctgccgggccccccggtcaacgagacccccccccccctgtgtgagacacgcccccctcaag

SEQ ID NO: 64368 - DNA, 725 bp, Zea mays
  misc_feature: Ceres CLONE 1534000
  misc_feature: Encodes the peptide sequence at SEQ ID NO. 64369
  misc_feature (323)..(323): n is a, c, t, g, unknown, or other
  misc_feature (397)..(397): n is a, c, t, g, unknown, or other
  misc_feature (404)..(404): n is a, c, t, g, unknown, or other
  misc_feature (420)..(420): n is a, c, t, g, unknown, or other
aacttctggagctccccgcggtggcggccgctctagaactagtggatcccccgggctgcaggaattcgtctcacccctagaaaaaagcacatgtgcatctcagcagcactagcagtgacaaactcgaagcttgccttcttgtttacaccctaaaactaaaactagagtcgtcggcggcaacaagcggtacgtacgtagaggatgaagagcaggagcagcactctgttggtgatcctagttctccaggcccttctgctctctgcggctgtggccaaaggacctgcagggccgaagaagcagtgctggtgcggcaagtgcaccanctggtcgggcgtgtggacctgcgacgacctcctcaccaagtgcgccgccacctgcaaggagggcggccccgtgnccacggncaaggccccccccaantacaggtgccgcgacttcctccccgaaaactgcgggggcaagatccactaaactcatccaattccaccatggccccagcacccgatggatccttccttcctatgcatgttcctcccccgcccgtccccccagctttgcaacaagcaggcgctaaaaagcaggctgcttgttggttgttttgcatgcttgaataagggaccctttccacctcaaaagagaaaaaaaaaccctcggccccctttctgtgcggttattacaaatttcccccccaaaaaaagggctctggtaattcgtttcgtgaaaag

SEQ ID NO: 64369 - protein, 89 aa, Zea mays
  misc_feature: Ceres CLONE 1534000
  misc_feature (41)..(41): Xaa is any aa, unknown, or other
  misc_feature (66)..(66): Xaa is any aa, unknown, or other
  misc_feature (68)..(68): Xaa is any aa, unknown, or other
  misc_feature (73)..(73): Xaa is any aa, unknown, or other
MKSRSSTLLVILVLQALLLSAAVAKGPAGPKKQCWCGKCTXWSGVWTCDDLLTKCAATCKEGGPVXTXKAPPXYRCRDFLPENCGGKIH

SEQ ID NO: 64370 - DNA, 716 bp, Zea mays
  misc_feature: Ceres CLONE 1534006
  misc_feature: Encodes the peptide sequence at SEQ ID NO. 64371
tccccgcggtggcggccgctctagaactagtggatcccccgggctgcaggaattcgtctcacccctagaaaaacatcctcacatcgtccacagaatttcacgcatcgcacggggaacagaacaccgatcgatcgatccctcgagaagcagagacaagtagcccgcccgtccgcccgcacacatagagacagagagaatcaagccgccgccgaccagtgacatggcgccctgggccattgccatccacggcggcgcgggcgtggacccgaacctcccggagcaccggcaggaggaggcgaagcgcgtgctggcgcggtgcctgcaggtgggcgtggacctgctgcgcgcgggcgcgcaggcgctggacgtcgtggaggccgtggtgcccaagctgaacacggaccccttcttcaactcggggcgggggtcggcgctcacccggggcgggaccgtggagatggaggccagcatcatggacgggcggcggccgccgctgcggggccgtggtccggcgtctccaccgtcagaaacccggtgtccctggggcggccgggccttggaaaaatcccccccattcgaacttcggccttcgagggggcccaaggagttcccccggggccggggcctgggaaaccgtgggaaaaaatttacttctttccggagggacaaggtgcggatgggtgaaacctccccaaggggggcgggaagattctggt

SEQ ID NO: 64371 - protein, 165 aa, Zea mays
  misc_feature: Ceres CLONE 1534006
  misc_feature: SWISSPROT Homolog: EC 3.5.1.1 Asparaginase
MAPWAIAIHGGAGVDPNLPEHRQEEAKRVLARCLQVGVDLLRAGAQALDVVEAVVPKLNTDPFFNSGRGSALTRGGTVEMEASIMDGRRPPLRGRGPASPPSETRCPWGGRALEKSPPFELRPSRGPKEFPRGRGLGNRGKKFTSFRRDKVRMGETSPRGAGRFW

SEQ ID NO: 64372 - DNA, 738 bp, Zea mays
  misc_feature: Ceres CLONE 1534007
  misc_feature: Encodes the peptide sequence at SEQ ID NO. 64373
  misc_feature (738)..(738): n is a, c, t, g, unknown, or other
tggagctccccgcggtggcggccgctctagaactagtggatcccccgggctgcaggaattcgtctcacccctagaaaaactactcgtctccacggaatcgatcgatcggtgctttgatctctgagcctgagcaagcggtcgagctcaccaaccgccacgctcaagacaggtcgagtagctagctagctgccggagtggaaaaggaggcggtgcagtggcatggggaggccgccgtgctgcgacaagatgggggtgaagaaaggcccgtggacccccgaggaggacctcatgctcgtctcctatgtccaggagcacggccccgggaactggcgcgccgtgccgaccaacaccggtgtgtgatgaatcatctggtgatgcagggcttgatgacgcgcgcggcggatggaattgcctttcaagatccaagctccgagcttacttgatttttttgtttgtttgttggtttggtcggcacgtgtgcgcgtgtgtgcagggctgatgcggtgcagcaagagctgccgattgcggtggacaaactacctccggccgggaatcaagcgcggcaactttaccgagcaggaggagaagctcatcgtccacctcccagctctccttgggcacaggtgatggtcactcgcctgtcgtcgtcttaaagcttttgttcccgttttgtttttccggctgtaacaaatggatcggacaaaccaaatcatccacggacgaagtgatcgtgtgctn

SEQ ID NO: 64373 - protein, 46 aa, Zea mays; identical to SEQ ID NO: 63423
  misc_feature: Ceres CLONE 1534007

SEQ ID NO: 64374 - DNA, 713 bp, Zea mays
  misc_feature: Ceres CLONE 1534009
  misc_feature: Encodes the peptide sequence at SEQ ID NO. 64375
ggagctccccgcggtggcggccgctctagaactagtggatcccccgggctgcaggaattcgtctcacccctagaaaaaagggtttcattccccctctccctctcggccagcaccacctcacatcaccgtgatcctatgacagccatggcggccgaagcaccaccgtcggcttcaacgtcctcctcctcgacctcgcggctacctctgcctccagcggtggggtggtcagatccgcatagttgtacatcgggagctgcattagcttgactttgaagagcgagatcgggtatgagggcgtcctttacaccatcaacaccgaggagtccagcatcgggctttgcaataatcttggaaatgaacactgaggattaagctgaggaggatggtgctaacattgatttaaactcacaaggaaaggaaaatgtgttgttctaaaaacctccacaagacaactatcagctaggaacttgtgagatgatattattgataaggattacaacacacatggatatgtgaacttaaggtgcgaaggttgacttggaagaaattgtggcagcaccagttcaggatggacaacaaccaaaatctcctacaaaagttgtttctaatgtgctatcgagctccagtgtgttcctatgcaatctgggcttcataccgcctcccaagaaaagctcgcaatgacaggttctgcaaaggttcaacaccttaggatc

SEQ ID NO: 64375 - protein, 46 aa, Zea mays
  misc_feature: Ceres CLONE 1534009
MDNNQNLLQKLFLMCYRAPVCSYAIWASYRLPRKARNDRFCKGSTP

SEQ ID NO: 64376 - DNA, 694 bp, Zea mays
  misc_feature: Ceres CLONE 1534011
  misc_feature: Encodes the peptide sequence at SEQ ID NO. 64377
  misc_feature (382)..(382): n is a, c, t, g, unknown, or other
  misc_feature (398)..(398): n is a, c, t, g, unknown, or other
  misc_feature (425)..(425): n is a, c, t, g, unknown, or other
gcggtggcggccgctctagaactagtggatcccccgggctgcaggaattcgtctcacccctagaaaaaagtggcggcggcgggcgggctgcccccggcgttcccggagctggcggcgtactacgaccggccgtcggactcgatgccgcggctgcacgcggactactccagctgctcggagcaggtgctgtccccggagcagctggcgtgcgaccgggaggtgcagagccagcccaagatcagcgagtgggagcggaccttcgcctccgaccccgtgaaccccgcgggctccatgctcgaccccgtcgtcggccacgccggcggcgacccgctgctgcaggacatcctcatgcactggggcgaggcggggcgggacgacgccncccatcatgtcctgangggcgaggggaggtgggggtggccaancatgcatgcaaacacccctcctcggctgcggttgggtgggtgattgatctgccttgggcaccccaatgccatgccaccgcccggtgggggctttgacccagggaaaccgccctttgttgacttggcaggaggataaaattttggaactttcccttggtatacctgggaaaggccgcgcataggagaccgctctggccccctcccggaaagggaacatggaaaaccggaaaccggaaaccggtagggcccccaacgcatcccgggcgggg

SEQ ID NO: 64377 - protein, 108 aa, Zea mays
  misc_feature: Ceres CLONE 1534011
  misc_feature (81)..(81): Xaa is any aa, unknown, or other
  misc_feature (86)..(86): Xaa is any aa, unknown, or other
  misc_feature (95)..(95): Xaa is any aa, unknown, or other
MPRLHADYSSCSEQVLSPEQLACDREVQSQPKISEWERTFASDPVNPAGSMLDPVVGHAGGDPLLQDILMHWGEAGRDDAXHHVLXGEGRWGWPXMHANTPPRLRLGG

SEQ ID NO: 64378 - DNA, 867 bp, Zea mays
  misc_feature: Ceres CLONE 1534019
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (51)..(51): n is a, c, t, g, unknown, or other
  misc_feature (52)..(52): n is a, c, t, g, unknown, or other
tgttgcctccccgccccgggttggcacagaaaaanannnnnaaaannaaannaaacactggggctccccgcggtggcggccgctcttcactagtggatcccccgggctgcaggatttcctctcacccctagaaaaagagacttcccttcgtctgcttcccagagacccagccatggcgatctcccagatctcacgcatattcctggccatccttctcctggcccgcgccttcgcccgccgccccagctgcgcttgcggacggggacgacgtggtggcccttaccgaattccccgttctaaaaggaggtccgaaaggaccccggcgcccctcattcaattcctcccacccccgggagggggtctgtggcaaaaaagttgggttcccggggattttgaaagggttttgtgttttagaagttttttaataaaaaattaaagccccctcccctctcgctgcgcggcttataggggtttttaatttaagaaatagaaaaaaaaaaaaacaccccccccccccctctcgtgtggggggagatgttccctcgggttactcccccaccccgcccctcccaagagggggatatctgaaataggcgtgcctccttggaggatatccctcttatgtatatgtgtgatgagaagagtataagtatattccatccatctcatatgtcttgttggtgccacaagtttgttcacccaacctaacttgtgtggacgggggataccacgggcagtaatgtcgtgctcgcgccaccaaccttagtctcatatattcgtggctctcgtgcttattcttctcccttccagtcagaatctgttttttctcgtattagccgcagttcgttcatcctagaacaaagaggt

SEQ ID NO: 64379 - DNA, 720 bp, Zea mays
  misc_feature: Ceres CLONE 1534020
  misc_feature: Encodes the peptide sequence at SEQ ID NO. 64380
  misc_feature (1)..(1): n is a, c, t, g, unknown, or other
  misc_feature (405)..(405): n is a, c, t, g, unknown, or other
nagtagtggagctcaccgcggtggcggccgctctagaactagtggatcccccgggctgcaggaattcgtctcacccctagaaaaaaaaccagcacccgccgcccacaggaacatcgccgcccagatcggctgcatacctgttcttcttctgggcgccggagttcgcatcgtcggctcgtcgttcggtaacttgggggagcaatgggaggagggaaagacaagcatgacgagagcgacaaggggctcttctcaaacttgatgcacggcgttgccggtggccatgggtaccccccgcagggataccctccgcagggctacccaccgcaaccaggagcatacccacctcccccaggggcgtatcctcctccacccggcgcgggggcggcacaatatgggtaccctcanccgggtggctacccacctcaaggtggatatcctcctgcaggctaccccggctcatctcaccagggttatgggagcagccactccgggggccacatggggacgggggcaatgctagctggaggtgcccccgccgccgctgctgctttcggagcacacaacctttctcatggccatagcggacccggtggacatgggcccttttgaaggccatgggcgtggtcgtgggggtaatggccggggtcatggcccaccccacaagttcaagcagggcagcatggaccccgcatggttcgcgggaaattcaaaaattggaat

SEQ ID NO: 64380 - protein, 135 aa, Zea mays
  misc_feature: Ceres CLONE 1534020
  misc_feature (68)..(68): Xaa is any aa, unknown, or other
MGGGKDKHDESDKGLFSNLMHGVAGGHGYPPQGYPPQGYPPQPGAYPPPPGAYPPPPGAGAAQYGYPXPGGYPPQGGYPPAGYPGSSHQGYGSSHSGGHMGTGAMLAGGAPAAAAAFGAHNLSHGHSGPGGHGPF

SEQ ID NO: 64381 - DNA, 782 bp, Zea mays
  misc_feature: Ceres CLONE 1534024
  misc_feature: Encodes the peptide sequence at SEQ ID NO. 64382
  misc_feature (343)..(343): n is a, c, t, g, unknown, or other
  misc_feature (383)..(383): n is a, c, t, g, unknown, or other
  misc_feature (391)..(391): n is a, c, t, g, unknown, or other
  misc_feature (447)..(447): n is a, c, t, g, unknown, or other
  misc_feature (448)..(448): n is a, c, t, g, unknown, or other
  misc_feature (450)..(450): n is a, c, t, g, unknown, or other
  misc_feature (456)..(456): n is a, c, t, g, unknown, or other
  misc_feature (508)..(508): n is a, c, t, g, unknown, or other
  misc_feature (509)..(509): n is a, c, t, g, unknown, or other
  misc_feature (511)..(511): n is a, c, t, g, unknown, or other
  misc_feature (513)..(513): n is a, c, t, g, unknown, or other
  misc_feature (515)..(515): n is a, c, t, g, unknown, or other
  misc_feature (516)..(516): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (522)..(522): n is a, c, t, g, unknown, or other
  misc_feature (524)..(524): n is a, c, t, g, unknown, or other
  misc_feature (530)..(530): n is a, c, t, g, unknown, or other
  misc_feature (542)..(542): n is a, c, t, g, unknown, or other
  misc_feature (584)..(584): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (726)..(726): n is a, c, t, g, unknown, or other
gggtttgggggggggggagtagtattaaactctcgctggtgtgggagtggtggtccccagaacttgtgctcaccacgatggcggccgctctagactagtggatcccccgggctgcaggaattcgtctcacccctagaaaaaacatttcgaagcccaccgaattccctgcgattcctctaccctcggctcctcgtctccccctaggggatcgtccggaaaggaatcgcaaagaggggcgtcgcatcctagttaatgaagccaagggagcacaaggaggcttggatgctatgggcccaggaggggaaacccttcctccagaacccgataaactgagagaaggggngggtttgtaggggtgggggacattgaagatgggggttttnttttgttnctgggagatgatgaaggaagggtggttgaggttaatttgtggtgttgttttaattnnanaaattntttaatggttggttggttttttgtgggttgttaggaacccccctctgggtgnnancncnnannnanantgtgtnctttgtctggancgcttagtttttgtgtatagtgaaaagaagtggtcttgtttntccccctccctagagacnnnnaaatggttcgtaggtggcgtacttgccaccacacaccgcgactaattctttcgggtgccgcaaccatagatcaaccgccgctcgcctgcaaccagaaacacactcaatgttcgcacgattntaggttgtataaatggttctgcactcgcggactatgcgctcgcaggacttctcgta

SEQ ID NO: 64382 - protein, 31 aa, Zea mays
  misc_feature: Ceres CLONE 1534024
VWGGGSSIKLSLVWEWWSPELVLTTMAAALD

SEQ ID NO: 64383 - DNA, 576 bp, Zea mays
  misc_feature: Ceres CLONE 1534027
  misc_feature: SWISSPROT Homolog: EC 5.2.1.8 Peptidylprolyl isomerase
  misc_feature (102)..(102): n is a, c, t, g, unknown, or other
  misc_feature (114)..(114): n is a, c, t, g, unknown, or other
  misc_feature (228)..(228): n is a, c, t, g, unknown, or other
ccgcggtggcggccgctctagaactagtggatcccccgggctgcaggaattcgtctcacccctagaaaaagaaagcaaaaaccaaccaaacaagctagctangagctagccaangccgcggcgtgcctccgctccggccggcccgcccctgtcagagcccccaccgccgctgccacctccgccagccgtcaccccaggcgttggatcggggccctcctcgatccgcgncccggcgaaatccagaacgggacccgcattggggttggggccccttcgatcgggcgcttggtgggggtttggctgggagctcaggctgagggacggggcggggggacctgatccttcattccgtcggattcgcttttccccgtggggctcgactgcctgaggggaggaggactggattggccgtcgtcaccaggaactggccaaatccagggcaaatcggcaaatcctccccgaatggaaaaagggtttccaaaactggaaaaatcaagatgccaccccccccaaaggggctttgaaaactttcccaaaaaatgggaaccgggaaaaaactctttaaaaactttgggg

SEQ ID NO: 64384 - DNA, 731 bp, Zea mays
  misc_feature: Ceres CLONE 1534028
  misc_feature: Encodes the peptide sequence at SEQ ID NO. 64385
  misc_feature (623)..(623): n is a, c, t, g, unknown, or other
ctggagctccccgcggtggcggccgctctagaactagtggatcccccgggctgcaggaattcgtctcacccctagaaaaaaagcagagtctgcccctccccgcgccgttctttttggttctccactccccagtcgccggcgccgccgaaacccgaatatggaggtcgtcttcgccgcaaagcagaaggcgaagaaacacatacgcctcttctactgctcagaatgcgaggagctcgccctcaagatcgccgccagctccgacgccatctagctccgatccatcagctggcggagcttcgacgactggttcccgaacctgttcatcaacaaggcgcacgacatccgtgggcagcacgtggcgttcctggcctccttcagctcgccgtcggacatattcgagcagatctccgtcatcttcgcgctgcccaagctattcattgcctcattcactctcgtgctgcctttcttccacacgggctcattcaagcgcgttgaggaggagggcgatgtctgcaccgcgttcaccctcgcgagcattctctcgatgatcctcaagtcgcgcggcgggcctagcagcatcgtcatctacaacatccacgcgctctaggacaggttctacttcngggacgacgtcctgccatgcttcgagataggcatcccgctcctgctgcagcgcctccgacagctctcggatgcagaaaatatcaccattgcctttccagatgaacgag

SEQ ID NO: 64385 - protein, 37 aa, Zea mays
  misc_feature: Ceres CLONE 1534028
  misc_feature: SWISSPROT Homolog: EC 2.7.6.1 Ribose-phosphate diphosphokinase
MEVVFAAKQKAKKHIRLFYCSECEELALKIAASSDAI

SEQ ID NO: 64386 - DNA, 734 bp, Zea mays
  misc_feature: Ceres CLONE 1534029
  misc_feature: Encodes the peptide sequence at SEQ ID NO. 64387
ggagctccccgcggtggcggccgctctagaactagtggatcccccgggctgcaggaattcgtctcacccctagaaaaaagtctgtctcccaccccataccaggtcctccctaagtcccaaaggccgccgccgcccggcagcccaccatggccgcgcaatcattcctcctcgccgccactgccgccgccaggtcccccgcgggcttcggcgctccctattcctccgcacgccctttacactaggaccacttcgtcgccggcccctggggcgcccccgcctcctgtgcgctcgtcgtcgcggaccccactaagaagactcaacccctcttcaaagctccgtctgaggtctagagcccgcccccccacgcgcaggaccacaatcgacctacaactgtgactgtacgaatcactggacttacacctgcacttcctggttcccctctccatcagctcgctgatacgactcatgctcgcatgtcaacaggaccactttttaatccaaacaatctgaagcccggtgcaccgtaaaacaagatcagtagtagccctgacctacaaaaccttcttgccaatgctgagggcatacccgaagcaacacttgctgacacacagattccttagactgacccacattcagatgatgagagagcttcagggcttcatcaccgtgtataagatttcgctaaaagagccatcgagctcggagacactactggatatgctggtgcattactg

SEQ ID NO: 64387 - protein, 31 aa, Zea mays
  misc_feature: Ceres CLONE 1534029
MAAQSFLLAATAAARSPAGFGAPYSSARPLH

SEQ ID NO: 64388 - DNA, 911 bp, Zea mays
  misc_feature: Ceres CLONE 1534031
  misc_feature (1)..(1): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (104)..(104): n is a, c, t, g, unknown, or other
ntaaccccccccncccnnnnnttatttnnnnnnttgggggtnnncccccccggccctccccgcggtggcggccgctctagaatagtggatcccccgggctgcangaattcctctcacccctagaaaaattcctcgcctcgcctttttagagagagagaaacccggctgcgcacagcgagttagagagagagagagagaccaaggccaaggaggaccgctccccgtacgtccccagcaggagagggagagagactgataaggctgcgccaagggaacaatacgccgctggagagaacggccacatggatagggccggcccgtgaggcacccccagggggggactgccgacctgctggttctgtgccggaaggggaaccgcaaggagatgccccctagttttttttcccccccccccaggggggaaagaagggggacacctttcaacttttctcaatacccccccgcggcttgagacgtctaacacacctggaggctcggtgggcgggagggggcctgtcccatccaactatctccctctctccctggtccagcctgtcttctggcgtagccccccgctcgagttcgcgccgctccctccgagcggctgtgacggccacgcctcacgccacactaccgatacttccgcgcgcacaccgccgcacgccacaccagttcccttgccgccgagacattaccacgggaacccttctccacacgcgccgctcgcctttcagtaataaaagatcgacactaccgtgcccgcgacgcccaacaccgagtggtcgtgtccttcggtagcgtgtatagaacaactcaccctacatcatagagctgcggtgactcggatgccgccgtcgtgcggggccccacggtcctggggagccctacgctcctccgcccacattacaagt

SEQ ID NO: 64389 - DNA, 721 bp, Zea mays
  misc_feature: Ceres CLONE 1534039
  misc_feature: Encodes the peptide sequence at SEQ ID NO. 64390
tggagctccccgcggtggcggccgctctagaactagtggatcccccgggctgcaggaattcgtctacacccctagaaaaatattttttttttcaatcgatataacgctcagtcggtcgctgactcgtgcgacttcactattctctcaaacttaccctcttagctctatgctctaggtaagcgcgtgcttccttagtgtagccatcagggttttcttcgcgctcgatgggcactgctgaggtccacatctcgaacgacctgacggacgaggacactcgagtggaggagactatcatgccggccgacgtgcatgaggaggctgacctcgccgaggacaatgctgaagttcatgctgaggctgctgatcgtgatgatcccgatgagctttccgcgggttattcacacccagccgtttgagcccgaggctgctgctcctgctgatgtcgaggagcccgcagctgccgacgcgatcgctcgaggagatgctgttgctcctgctggctccgaggagactccagctatcgaacaggacgcaacagcctagcaggagggtgctgctgctcctcctgttggtatccaagaagtcgccccgatcggatacggtcgccaaggttgaagcttgcttacccccatcaagctagccgtgggacgaaaggcgaacgtcttcaacttcatggattcggtctgaattcccatggaagggggtcccgctctaggcggga

SEQ ID NO: 64390 - protein, 68 aa, Zea mays
  misc_feature: Ceres CLONE 1534039
MLKFMLRLLIVMIPMSFPRVIHTQPFEPEAAAPADVEEPAAADAIARGDAVAPAGSEETPAIEQDATA

SEQ ID NO: 64391 - DNA, 922 bp, Zea mays
  misc_feature: Ceres CLONE 1534039-R
  misc_feature: SWISSPROT Homolog: EC 5.3.1.1 Triose-phosphate isomerase
  misc_feature (694)..(694): n is a, c, t, g, unknown, or other
tgggacctcgagcgtctcgtttttttttttttttttccagtaagatgtagcttctctgttaaaaaaaaaacgcttacatttctccttgactgtcaacatttttttttctttagaaaaggaccacataacaatattcccaacgtacatcgctcacgacaactgaactctcctcgtcacgtgcagatccacgagagcaaaacattattttctgtccccgtgctgcaaatcagcaaaaacaggaggtgacgcctcctacaggctttaaggcgtggcagatgaggcgacacggtgatggcctcttatttcttcacagggtggtccatcaggctgcaactttcttggcggtcactgagttgataatggtggcgaagtccggggccttcaaggaggcaccaccaacaagaaaaccatcgatatcctctttctttgctagctctgcacagttggctgcattcacagaacctccatagattattcgggtgctagaggcaacatcaggtgatatgttggtcgtcaaccaatcgcgtacagcagcatgaacttcctgggcttgctcaggagtagcaacttttccggttccaatagcccaaacaggctcatatgcaatcacaacatcggcccagtttgaaatactatctgcaaaagccttcatctgctcaaaacatacttcaaaagttttccctgcttccctctnctccagaagctctcctatgcaggcaataacctaacattttggctcatgcatatgcagccttcttcccataaactcgtcatttcaccaatatatgtctacgctctgagtgtccagaatacccattgacaacgatgtccaccagtggttctgcctgatctctccggtgtagccctccctttcaatcccaatcctgagcgaacctcatgcgaccgttaggaattctgaccg

SEQ ID NO: 64392 - DNA, 744 bp, Zea mays
  misc_feature: Ceres CLONE 1534040
  misc_feature: Encodes the peptide sequence at SEQ ID NO. 64393
  misc_feature (744)..(744): n is a, c, t, g, unknown, or other
ggatcccccgggctgcaggaattcgtctcacccctagaaaaaatactccgttccttggtcttcagccctcacactctttctgcccgaaatcaagaccggatagccgtcccccagcgccagacctgccgcctagcgggcgcccatactgccgccgatgctgcctactcaactgctaccccatgcttgccgggggcccttgcccccggatggaggagcgcgacacctaagtccgcgcatttccttccacctagccgcctcgagatcaggcatcccaggtggccgatttcgttgcggttcccctgaacttaaatggatggcatttttacccacacccacggtgaaggggggggccaaccactaacatgtaccccccccccccccctatctttaccgcctaattcttgcccccccttttgatgttgcgatgtgtttcaattgaagtcttccttacccaaccagttctgaaaactataggcactcttaatacgtacggtccgtctaaaaccaacaagcctctccgttaaaaccacccggctctatgcgatatccaaagccactgatgcttgctctcgtcaaaacacacgcgctagacacaaactactctttcgctcgatgcgcatcccactagcgtgcaccgactgccatcctacatatccccaacattctttttctctattttcgttaatcgctgtccatactcttcccactccatcctgctccttacgtccctgtcacaatcaggcn

SEQ ID NO: 64393 - protein, 68 aa, Zea mays
  misc_feature: Ceres CLONE 1534040
MLPTQLLPHACRGPLPPDGGARHLSPRISFHLAASRSGIPGGRFRCGSPELKWMAFLPTPTVKGGANH

SEQ ID NO: 64394 - DNA, 732 bp, Zea mays
  misc_feature: Ceres CLONE 1534044
  misc_feature: Encodes the peptide sequence at SEQ ID NO. 64395
aaagctggagctcaccgcggtggcggccgctctagaactagtggatcccccgggctgcaggaattcgtctcacccctagaaaaaacgctccggcagcgaagctcccccctccctgcctccttccccggcgccctgctcttcctccttccgctccggcgatgggcactggccgcggctgcggcgggggcgtgctccaccgcctcctcggcctctcgtcgctgctgctcctcacttccggtgaggtcgtcttctaagagcgcttccaagatggttgggagactccgtgggtacaatcttactggaaaaggagtgaacggaaagcaagaaggttcaagcacaccgcgggaagatactctgcacaccctgatgacgaaggaatttcaacgacgatatatgccagacatccccccctctgggccaacgtcccggaattcacgaacacgaaccggacgcttgtggtccagtcctccattagctttgaaccggatattccatgtggcggagggtatattagacttatgttcggttctgctatccacaaaaacttattggggaccctccataccgcttgctgtttcgacccgaaatatgtgggtactcaacaaaaaaagctccacttgaaacttccctaaccggggagagaactatccccttccgagaaaatccaagaagtgtggcttccgaccagtttaacgccccgggggaaacttttcctttcgtaaaggttggaag

SEQ ID NO: 64395 - protein, 31 aa, Zea mays
  misc_feature: Ceres CLONE 1534044
MGTGRGCGGGVLHRLLGLSSLLLLTSGEVVF

SEQ ID NO: 64396 - DNA, 627 bp, Zea mays
  misc_feature: Ceres CLONE 1534049
  misc_feature (261)..(261): n is a, c, t, g, unknown, or other
  misc_feature (322)..(322): n is a, c, t, g, unknown, or other
ccccgcggtggcggccgctctataactagtggatcccccgggctgcaggaattcgtctcacccctagaaaaacccctcccccaatcccagcctgacacccggtccacggcagaatcccattccgattcctccctccccgtcccgtctcccctctcgccctaggggccggggggctagggttcgcttcaccgccggcctccccctccgacgcggcaccggcccccgcgcaccgggcctggatgctatgctgctgagctgcangaccctctccacctgggtgcgccgcctcgtcgcttgcatgggagagaagttgctttggatngtgtgctagcccacctccataatagcagtagacgagcctcccagcggttgaagatccagggcgaacagtaaggaagcttagctttccgaagactttttgaaccccaatgccccttaaatggaaaaaaaccgggatccatccccaaagaaaatttccttttaataaaccttttggtctcttcccacaataaaaaaggcccaaggaaaatttcgcccccccccccaaaggtttttaaaaaaaaagggttttttgtttttgaaacaaaaaaaaaaaaaacagggggtttgggaaaaaaaaaccccccc

SEQ ID NO: 64397 - DNA, 718 bp, Zea mays
  misc_feature: Ceres CLONE 1534050
  misc_feature: Encodes the peptide sequence at SEQ ID NO. 64398
  misc_feature (468)..(468): n is a, c, t, g, unknown, or other
  misc_feature (718)..(718): n is a, c, t, g, unknown, or other
ggagctccccgcggtggcggccgctctagaactagtggatcccccgggctgcaggaattcgtctcacccctagaaaaaatcttggtatacacgtaatatatacacacacacacgatgggcagcgccggcggcggcggcgagagcaagctggagagcccgctgctgggcgcgtcgtcgacgggccacggcgaggcggtggtgagcgggcagctggagagcatcctgggcgacgcgtccgtgccgtgggggacgcggatggcgtcggcgtccgcggtggagatgcggctgctggtgcgcctggccgcgcccgccgtgctcgtgtacatgatcaactacctcatgtccatgtccacgcagatcttctcgggacacctcggcacgctcgagcttgccgccgcctcgctcggcaacaccggcatccaggtcttcgcctacggcctcatgctgggcatggggagcgcggtgganaccctgtgccggcaggcgtacggggcgcacaagtacgacatgctgggcatctacctgcagcgctccaccgtcctgctgatggccacgggggtgccgctggcggcgctgtacaccttctccgccccggtctggttctgttggggggatcccccgagattcgcgcggccgccccccgtctcctgtacagcctggtcccgcaaattttccctacgcccccaattccccatcagaagttatgcgggcccaaaan

SEQ ID NO: 64398 - protein, 201 aa, Zea mays
  misc_feature: Ceres CLONE 1534050
  misc_feature (65)..(201): Pfam Name: MatE Pfam Description: MatE
  misc_feature (118)..(118): Xaa is any aa, unknown, or other
MGSAGGGGESKLESPLLGASSTGHGEAVVSGQLESILGDASVPWGTRMASASAVEMRLLVRLAAPAVLVYMINYLMSMSTQIFSGHLGTLELAAASLGNTGIQVFAYGLMLGMGSAVXTLCRQAYGAHKYDMLGIYLQRSTVLLMATGVPLAALYTFSAPVWFCWGDPPRFARPPPVSCTAWSRKFSLRPQFPIRSYAGPK

SEQ ID NO: 64399 - DNA, 853 bp, Zea mays
  misc_feature: Ceres CLONE 1534051
  misc_feature (11)..(11): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (455)..(455): n is a, c, t, g, unknown, or other
  misc_feature (456)..(456): n is a, c, t, g, unknown, or other
  misc_feature (458)..(458): n is a, c, t, g, unknown, or other
gtttccccccncccacncnnnnnnnnnnnnnnnnnnaaatatccnnnnnaaaatagaggagtgcaccgcggtgtcgggcgctctaaaaatagtggatcccccgggctgcaggaattcgtctcacccctagaaaaatgctttcttagaggggggttggcttctcctccccctccggttcgggttcgggttcgtgaggttctcccgtgttccgtttcggggggggagcggaatccaaatggcggcctctaatgtttaataaccctccttccccagcggcctcccctggaccaccccacaaccctttcctttaaaaggcctttaatcccttacggggatgtcctccaaggcagagaaactcctcccaatggtttaattttttatagccaggaagcttttccgggtttataaattttttttttttttcccccccccccccaggggggaagagggggggnncntctctatttccctcccaccccccaccccccccccttttttttagagataaatatgaaacccccccccccttggggggtggcgggattgatgattgtcgagcttccccacgcatctaatcttatcgccttcttcatattttcttctatatattattgtatgctctgaattatgtttcccatagttctttaacttctagtacatcttctgtgacgtagttaccgtcatctacatctatctcgcaagtcttccatcatctcccattcgtgtactacccgtttgagtatatccgtgggcctattatggttcattttccctaaaagatatcctcatcagactctgttcttctcgtgtcagtgcgaagtgaataaccattaactacaataacgagcaaatg

SEQ ID NO: 64400 - DNA, 732 bp, Zea mays
  misc_feature: Ceres CLONE 1534053
  misc_feature: Encodes the peptide sequence at SEQ ID NO. 64401
  misc_feature (682)..(682): n is a, c, t, g, unknown, or other
tccccgcggtggcggccgctctattactacctggatcccccgggctgcaggaattcgtctcacccctagaaaaatgactgcagaggagagagatctagagcgagggagggagggaaatgggccacgaggctgcggcgccggggtcgtcggtgctcggccgcgcggtggaggaggtgcgctcggccctcaacgagcacgccgacgtggttgccgacctcttcggtcgcgtctcctccgaagtgcgcaccggcttcgcgcccgccgtcgactccttcgttggcttcttccacgccgtcgactggaaggagccttggctgatcagcatactatctttccatgccattctgctactggttaccctcatctcgaggaggagggggatttccagctcatcttgccacccccaacattttctggtgtattccttgctgagagattaaatacgttcctggcgccaaactggaagagcttctctaccccaaactattttgatccccagggccttttcatttcggtcatctggtcgggccctctcctcctgataacgatccttattctgggggaacgctttcctgacgcttctgcacccttaacggtcaacgtggaaaaggggagaatttcaggcatccgcgctcgggcaggcctcgtggaccagcacggaactgaccgtcaaccttgcctnctatgggaaccattgcggggggccagtaagaataagtcctcggtacttag

SEQ ID NO: 64401 - protein, 107 aa, Zea mays
  misc_feature: Ceres CLONE 1534053
MGHEAAAPGSSVLGRAVEEVRSALNEHADVVADLFGRVSSEVRTGFAPAVDSFVGFFHAVDWKEPWLISILSFHAILLLVTLISRRRGISSSSCHPQHFLVYSLLRD

SEQ ID NO: 64402 - DNA, 750 bp, Zea mays
  misc_feature: Ceres CLONE 1534054
  misc_feature: Encodes the peptide sequence at SEQ ID NO. 64403
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (128)..(128): n is a, c, t, g, unknown, or other
  misc_feature (750)..(750): n is a, c, t, g, unknown, or other
agtgacgggggcccgccgctacacgcacgcaattnannnataannnnncaaaactggagctccccgcggtggcggccgctctagaactagtggatcccccgggctgcaggaattcgtctcacccctangaaaaaccaccagttccttgttcggtctgaacgcagcgcagcggcggcggcgatagggagagaggagagagtctgcaggatccagcatgccgagggaggagtcagcggcgggccggagaatatgagcggcaacggcgcgaagaaggtggtcgatgcggcggtgaaggccggcaggacgatcatccactgggacggcatggccaaggttgctcgtccaccgacgaggctgcgcagggagttcggccgcccttccggccgcgcttttcgaatggacggtttaacccacccaggctccccaacccaaattttttccctgggaaccccccaccccggaatttgttttgggaggttaactttgcccacccccgattggggatcacaaagggggggggtatttgatcaaaaaagcgcttttttgaaaacaatctcaattccccccaagaaaatcccaacccctgttttttcccccattttcgacccccaccccggtggaatgccggggcatgttgcaaatttaaaaggagcggggtgcaaacaaaaagccctcctcaagggggggccctcaaagagggtgtttaagagagggggtccttctgtttaaaggggggggggaaaaaaggan

SEQ ID NO: 64403 - protein, 159 aa, Zea mays
  misc_feature: Ceres CLONE 1534054
MSGNGAKKVVDAAVKAGRTIIHWDGMAKVARPPTRLRREFGRPSGRAFRMDGLTHPGSPTQIFSLGTPHPGICFGRLTLPTPDWGSQRGGVFDQKSAFLKTISIPPKKIPTPVFSPIFDPHPGGMPGHVANLKGAGCKQKALLKGGPSKRVFKRGGPSV

SEQ ID NO: 64404 - DNA, 700 bp, Zea mays
  misc_feature: Ceres CLONE 1534059
aagctggagctccccgcggtggcggccgctctagaactagtggatcccccgggctgcaggaattcgtctcacccctagaaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggtgggtagtagtcaatacctgcttagtatgtctttctctctctctctctcgccaacaagcttgcttgaaacatgtcccggtactcgtcaacgcaaagcattatttatgtgcatgtcaggattaatttcgtggaggcaggcctactcattttccttcccatatgctgcttgttcatatataggactaatttgccccaaattaaagttcaattggtgaatttttttctatttgttgccacaaaggaaaggacgggctatatatattatatactcacttttgggattcttttctggtatgggtgtctcgcaggcaatgggaccgccctggtgctcttcctctccccggtgcctacgttcatccgca

SEQ ID NO: 64405 - DNA, 698 bp, Zea mays
  misc_feature: Ceres CLONE 1534061
  misc_feature: Encodes the peptide sequence at SEQ ID NO. 64406
  misc_feature (672)..(672): n is a, c, t, g, unknown, or other
tccaccgcggtggcggccgctctagaactagtggatcccccgggctgcaggaattcgtctcacccctagaaaaagcgtcagggcctccttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggggaggccatcaagcactcgctggggcagtcccacccggtgcgcctggtgccctacaacccggacttcctgggacaatcggtgctgtggacggaaagccccaacctcggcaacggcttcccctgcgtccccatgggcaacaaactcaacctccaactncgatgccctccccgggcgaccagtgg

SEQ ID NO: 64406 - protein, 176 aa, Zea mays
  misc_feature: Ceres CLONE 1534061
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNKATGEAIKHSLGQSHPVRLVPYNPDFLGQSVLWTESPNLGNGFPCVPMGNKLNLQLRCPPRATS

SEQ ID NO: 64407 - DNA, 696 bp, Zea mays
  misc_feature: Ceres CLONE 1534065
  misc_feature: Encodes the peptide sequence at SEQ ID NO. 64408
agtggatcccccgggctgcaggaattcgtctcacccctagaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcatgagtgggcggccgtccccggcgggcaggccacgtacctggccgccccggtgccgtggggcacgctgcctaccatcctggtgaatcgattcgtggccatcgcctttctccgagcaccagcgcaccttggataaagacccctagaaaaaaaaattacccggtgggggcccttcaaccgctccggcttcttcataggaccccgccaaattccagggataacaagctcccggatattccttaag

SEQ ID NO: 64408 - protein, 160 aa, Zea mays
  misc_feature: Ceres CLONE 1534065
  misc_feature (54)..(161): Pfam Name: Chloroa_b-bind Pfam Description: Chlorophyll A-B binding protein
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGNWVKAHEWAAVPGGQATYLAAPVPWGTLPTILVNRFVAIAFLRAPAHLG

SEQ ID NO: 64409 - DNA, 695 bp, Zea mays
  misc_feature: Ceres CLONE 1534067
  misc_feature (218)..(218): n is a, c, t, g, unknown, or other
  misc_feature (220)..(220): n is a, c, t, g, unknown, or other
  misc_feature (242)..(242): n is a, c, t, g, unknown, or other
  misc_feature (243)..(243): n is a, c, t, g, unknown, or other
  misc_feature (257)..(257): n is a, c, t, g, unknown, or other
  misc_feature (259)..(259): n is a, c, t, g, unknown, or other
  misc_feature (286)..(286): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (316)..(316): n is a, c, t, g, unknown, or other
  misc_feature (331)..(331): n is a, c, t, g, unknown, or other
  misc_feature (358)..(358): n is a, c, t, g, unknown, or other
  misc_feature (395)..(395): n is a, c, t, g, unknown, or other
tggcggccgctctagaactagtggatcccccgggctgcaggaattcgtctcacccctagaaaaaaagggccaaggcagggcactgcactgcacgcatgcactgacctgacgactacgcgcgccacagtccacagctcctcactcagacatggcgatgggcgccgcttccatcctactgatgatggtttcgctggagaccctgcttctcgccgccggcngncccggcgcccggggcgtggacnncatccgtcttggtnancagcgatggtcgggaaagaacctttgnttcacggnnnnnnnnnnnnnnnnnnnnttnttttttttttttttntttttttttttttttttttgttttttnttttttttttttttttttttcttttttctttcttcgntttcggtggtctcagtttggtcttgttcgtcgccccttgtcactgtctctgcaccagtccgggtttcctactttcgatggccccctttaatttaacgctctctgcaccaaattacccgacttgtgtttcgtttacgttgcaagttacaagaagaatacagcacaatgacaaattgataaacattagctctcctcacctcacagaacgtaaactattctattttcccaaaaatcaaattcatacagtattatctcgcctaaactaaggtatacctgtaagaacagatgaagcacagccaaa

SEQ ID NO: 64410 - DNA, 888 bp, Zea mays
  misc_feature: Ceres CLONE 1534069
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (72)..(72): n is a, c, t, g, unknown, or other
gtttggttannnnnnnnnnnnnnnnnnnnnnaaaaannnnnntcctcccccccactcccccgcggtggcggncgctctagaactagtggatcccccgggctgcaggaattcgtctcacccctaaaaaaaacgcctctcttgctcaccattctcttctaaccagccaagccaaggcgcatctagcgagctgagcagcaatggcggctgctacttcttctaggcgccctgcagctgctctgctggtcctggcagcagccgtcgtggccctggcggccgagggggccaggtacccgccgctggcgccgggcctgtttttcgaccttcacaacaatagctgcccccaaggtggagaccatcatgccggacatccttgtcgtcccaagccacccaacaacttgacgctcgcctttttttcccccccccccctgggggggggggggggggcttttagggacggccagctcaatccctgcctacttgtccagagaaaccactaccaacccctcccgcaccggatacgttaacaccgcccggcccaaccctcctgcgatagccggccgcccctcgccgctgctacacccaccataagtctcaaataagcgccggccgcacccgccacaagcgcccgcacataactcagcccccaacccccccatcacctcgaatcatggtaaataccacgatcccttcatgttctcggtcactcccccccgtttagtatgccgacaccgcgtcctgatccaaagaaaaagtcctgtgcatccatactgatcgcaactaagctaagacacctctcgtccgcatctccggggaattatacgcgtataaccgtgtgtcacaatcctactacgaaccgccactacgataatcacaaacacacaacaaata

SEQ ID NO: 64411 - DNA, 730 bp, Zea mays
  misc_feature: Ceres CLONE 1534074
  misc_feature: Encodes the peptide sequence at SEQ ID NO. 64412
  misc_feature (1)..(1): n is a, c, t, g, unknown, or other
nagtgctggagctcaccgcggtggcggccgctctagaactagtggatcccccgggctgcaggaattcgtctcacccctagaaaaaccagcgagccaggcacggaggaggcgcgtgctctgctccactccacctcccccccccccctgcgccactgacgccgctcgttcgcgcagttttggtcttctggccagcagggcagggggggaacccgcgggagcgaggcgcgcgagcgagcgagcggagggaggaggaggatgatgcacgccaagtcggagtcggacgtgacgagcctggcggcgtcgtcgccgccgcggtcgccgaagcggggcgttgccgcggccggcaccggcggcggcggcggcggcggcggctactacgtgcagagcccgtcgcgggagtcgcacgacggcggcggcggcgtcggcggcgggtacaagtcgtcgtcgatgcaggccacgccggtgtacaacaacagccccagcgagtcgccgtcgcacccctcctacggccgccactcccgctcctcctccgtcagccgcttctccggcggcctccgcgggggcggcgccgccggagggcccaaggtgctcaaagacaaggggtggcccgaagtggacggccatcaaagaagaagggcccttaaaaggccttcggtgcccgaggaagggtgcctctcccggccgttaccaaaattggctctcggttcataaacattcatcacactcttag

SEQ ID NO: 64412 - protein, 151 aa, Zea mays
  misc_feature: Ceres CLONE 1534074
MMHAKSESDVTSLAASSPPRSPKRGVAAAGTGGGGGGGGYYVQSPSRESHDGGGGVGGGYKSSSMQATPVYNNSPSESPSHPSYGRHSRSSSVSRFSGGLRGGGAAGGPKVLKDKGWPEVDGHQRRRALKRPSVPEEGCLSRPLPKLALGS

SEQ ID NO: 64413 - DNA, 647 bp, Zea mays
  misc_feature: Ceres CLONE 1534082
  misc_feature: Encodes the peptide sequence at SEQ ID NO. 64414
  misc_feature (647)..(647): n is a, c, t, g, unknown, or other
tggcggccgctctagaactagtggatcccccgggctgcaggaattcgtctcacccctagaaaaaatttttccttatcctctgtccctacccacgcgcggcgcccacgactccccgctccgctgagcgcccgcggccggcgccctcacgcccacgcggctgggcctggcgcccgcgcccgtggccgtggccgccacttccaagctcatagcttggctcgagcaaagaggtgagtgatacgccctgcgtcagtacgtggtaggcagcacgatggcgctgcactgctccctgcccgcgacctgttcgacgttgtggctgcgagcagcggcgcggcctgatccccgctttccgaggtcccgtgcgcgcctcgtaggcctagctctttctggcccgcgccaccggaggctcgtgcacaccaggctgcgcgccgggcgggggaccaaacggaatctcaaaagcctggaactggggttggggggcctggcccccggaacaataggaaactgaacccaaacccccgataaaaaaaacccccggattcttgacgaaaaaaaagaaaaacctccccccaaaaaaaggaaaaaagaaccccccccaaaaacggaaataaaaaccccggaagaaaggggaaaaaggggccctggcaaan

SEQ ID NO: 64414 - protein, 78 aa, Zea mays
  misc_feature: Ceres CLONE 1534082
MALHCSLPATCSTLWLRAAARPDPRFPRSRARLVGLALSGPRHRRLVHTRLRAGRGTKRNLKSLELGLGGLAPGTIGN

SEQ ID NO: 64415 - DNA, 829 bp, Zea mays
  misc_feature: Ceres CLONE 1534088
  misc_feature: Encodes the peptide sequence at SEQ ID NO. 64416
  misc_feature (1)..(1): n is a, c, t, g, unknown, or other
  misc_feature (2)..(2): n is a, c, t, g, unknown, or other
  misc_feature (10)..(10): n is a, c, t, g, unknown, or other
  misc_feature (32)..(32): n is a, c, t, g, unknown, or other
  misc_feature (41)..(41): n is a, c, t, g, unknown, or other
  misc_feature (260)..(260): n is a, c, t, g, unknown, or other
  misc_feature (292)..(292): n is a, c, t, g, unknown, or other
  misc_feature (325)..(325): n is a, c, t, g, unknown, or other
  misc_feature (350)..(350): n is a, c, t, g, unknown, or other
  misc_feature (364)..(364): n is a, c, t, g, unknown, or other
  misc_feature (404)..(404): n is a, c, t, g, unknown, or other
  misc_feature (411)..(411): n is a, c, t, g, unknown, or other
  misc_feature (413)..(413): n is a, c, t, g, unknown, or other
  misc_feature (414)..(414): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (460)..(460): n is a, c, t, g, unknown, or other
  misc_feature (514)..(514): n is a, c, t, g, unknown, or other
  misc_feature (541)..(541): n is a, c, t, g, unknown, or other
  misc_feature (670)..(670): n is a, c, t, g, unknown, or other
  misc_feature (708)..(708): n is a, c, t, g, unknown, or other
  misc_feature (709)..(709): n is a, c, t, g, unknown, or other
nnaatcctcnaaccccgcccggactacgccgnggtggcggncgctctagaactagtggatcccccgggctgcaggaattcctctcacccctagaaaaaacctcgtcaggcaccctcaaaccctcgccgcaagaaagaagaggtcaatcaaatcgaaccaaaacctcccgaccccacaaggccaagctcatttccatggtggtgtacacgcaggaacatgtgtaccggcacccgtgggaccgggtgacagcggcggcgtgncgcaagttcacggatccggcctcctgtacggngctctcccccgtcggagacgttcacaccctacnccgccgcctcgactccgacacgggncgcctccaggccgngcgcttttttcccccccccgccgcgggcggtgggggtgcnccttgcncnnaattcctcccctccnnncacgggcgtccccaaaggggggcccgggnttctgggcggtgcggtggagaccctccctccgtgaactccctcgccgcccgcgnccttggatgagtttctcttgcgcaaantttcagccctcctggggccctcaatccgaggtgctagggaggctgtgcctcctttattaatctttattggtgtttcggggacctaactatttgtgtcccgtccttcctagcatgccatcaccccccctnccctgcgttgatctccgttattcgagtatcttaatatnntgtcctttccccagaagagaggtcgcagggtaacgcggggggcctcgtcggtgctctcttgttatcaatgacttgcgcctactcgccggaggcgcgtgttttccgtccccgtgtcttgcg

SEQ ID NO: 64416 - protein, 109 aa, Zea mays
  misc_feature: Ceres CLONE 1534088
  misc_feature (22)..(22): Xaa is any aa, unknown, or other
  misc_feature (33)..(33): Xaa is any aa, unknown, or other
  misc_feature (44)..(44): Xaa is any aa, unknown, or other
  misc_feature (57)..(57): Xaa is any aa, unknown, or other
  misc_feature (73)..(73): Xaa is any aa, unknown, or other
  misc_feature (74)..(74): Xaa is any aa, unknown, or other
  misc_feature (79)..(79): Xaa is any aa, unknown, or other
  misc_feature (89)..(89): Xaa is any aa, unknown, or other
  misc_feature (107)..(107): Xaa is any aa, unknown, or other
MVVYTQEHVYRHPWDRVTAAAXRKFTDPASCTXLSPVGDVHTLXRRLDSDTGRLQAXRFFPPPAAGGGGAPCXXFLPSXHGRPQRGARXSGRCGGDPPSVNSLAARXLG

SEQ ID NO: 64417 - DNA, 747 bp, Zea mays
  misc_feature: Ceres CLONE 1534089
gggctgcaggatttcgtctcacccctagaaaaaacttctctctctctctctctctcgggacgacggcgacggctacgactggggcgaccgtcgctgccgccctacttgccggttgctcggatcttcttcggcccgttagccggcgacgagcaccaccagggcaaccagatacttcagtggcttcgcaaggatgtcctggtgccctattgaatctgatcctggtgtgttatgtggcctgattcgcgaatggcatggataggtgactgtttggaaaagcttaattctctcgaggtgggctttctttttttttctccccccgcgggagaggggggagaatgtctcaccgagaggacacacccccccccctttttgagctgcgcgggtgccagaaaaatacttagggcggggctgttgtcttggtggtcggtgttgttatcgggaccccgggtccaaggctggatgtatgcccgtggtatcctcccggaatactcctcatctaagttcatggcgcgccctagccatttcggaggatatacgaattagccatagcaactttctctagacggacaccttggggggaatgtggaaaacccaaggacggaggaagtacggatagcttaagcagcgcttatgggggaccatgttcagagttagttagaccatgactaagtcgcacgataaggagtgagggaacacgtgctgtcagggggcgcgcagaatcgtattgagtccgctcgatcgcgatgg

SEQ ID NO: 64418 - DNA, 692 bp, Zea mays
  misc_feature: Ceres CLONE 1534095
  misc_feature: Pfam Name: DUF1336 Pfam Description: Protein of unknown function (DUF1336)
ccccgcggtggcggccgctcttgaactagtggatcccccgggctgcaggaattcgtctcacccctagaaaaaccacagttcttgaggaggagtctgatgaagatgacgaatttctgatacctgaatctgaaccagagccatcaaatcttgaggatgctgcagatgttaggaagtcagggcgcaatgaagaggattcagatctgattgatttatctgggttttctgggaatttacgtcgggatgaccgtgatagcagtcgtgactgctggagaatgtctgatggaaataatttcagagttcgaagcaagaattttgtatatgataaaagcaagattcctgcaggaaagcctcttatggagcttgtcgctgttgactggtttaaagatgcaaagcgaatggatcatgttgctagaagaaaaggctgtgcagttcaagtagcggctgagaaggggctctttgcattggctataaatctacaagttcctggcactacaaactacagtatggttttctactttgttacgaagaaactgataccaaactccttattgcaacgctttgtggatggtgatgacgaatttcggaatagtaggttcaagttgataccatcagttcctaagggctcatggattgttcgacaaagtgttggcagcactccttgtctattaggaaaagctgttgacattacctat

SEQ ID NO: 64419 - DNA, 703 bp, Zea mays
  misc_feature: Ceres CLONE 1534096
  misc_feature: Encodes the peptide sequence at SEQ ID NO. 64420
cgctctttactagtggatcccccgggctgcaggaattcgtctcacccctagaaaaaatcccttggttgccgcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggacagatgttatgtcgaacaatgtttcaatctacaaatcccaagcatctgcccttgagacccatgcagctcccaactgcaaagttctggtgggtgccaacccaagcaacaccaatgctcttatcttggaagaatttgctccatctattccagagaagaacgttacttggctgacccggtctggaccacaacaaggctcttgtgcaaatttctgaagagacttaatggcccaggtagtcgaggtgaaaaatgctatcccc

SEQ ID NO: 64420 - protein, 169 aa, Zea mays
  misc_feature: Ceres CLONE 1534096
  misc_feature (6)..(155): Pfam Name: Ldh_1_N Pfam Description: lactate/malate dehydrogenase, NAD binding domain
  misc_feature: SWISSPROT Homolog: EC 1.1.1.37 Malate dehydrogenase
MAKEPMRVLVTGAAGQIGYALVPMIARGVMLGADQPVILHMLDIPPAAEALNGVKMELVDAAFPLLKGVVATTDVVEACTGVNVAVMVGGFPRKEGMERTDVMSNNVSIYKSQASALETHAAPNCKVLVGANPSNTNALILEEFAPSIPEKNVTWLTRSGPQQGSCANF

SEQ ID NO: 64421 - DNA, 875 bp, Zea mays
  misc_feature: Ceres CLONE 1534097
  misc_feature: Encodes the peptide sequence at SEQ ID NO. 64422
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
gaaagaactcacaatttttaanaaannnnnnnnnnnccaactnnnncaaaccgcggaactcaacgaggtgccggccgctcttttatagtggatcccccgggctgcaggaattcgtctcacccctagaaaaaatccacacacacacaacacagcagagagattactacgatccaacagttctagagcaagagagaggaagacacaccgcagagttagcaggctaataacttgcaggagcagcaggaatggcggcgacgcgtcgcctctcttgctttctcctcgccgtgcttctggcaggagtggccgctgccaccgccttcgacgaagcggctgctgcccgcttcggacttggccacggcgcgcgtttctcgcgcaaacatgaacgtgctgccgctgagatgccctttccggaccccccccccgggggggggggggggagccccgtatgccagccattgtctcctccccccaaccttaaacccaaacacctgtggcctcattcctagagtcccaaagcccttgaactcttcttccccaaagccccaaccccctggaaaccattcgaccctccatgtctccagggccctcggtcctaaagatcccaaaacccagaagagcatttgtgcctcaaactcgcaacaccgcggtcctccgaacggccccggaacctatcgtctctccaaaccgcgtatgtccctctaacgtctttagaattatattccttgaggccactatgtcctgcagacccgagtgctcgtggagtcatattccagcgaagattcgaaacgttgtgatctctcaatacccgcgagcagcaaagcgctcttacctcgtatcctcagagctactagagtgccgagtgacctatgtcgtcc

SEQ ID NO: 64422 - protein, 86 aa, Zea mays
  misc_feature: Ceres CLONE 1534097
MAATRRLSCFLLAVLLAGVAAATAFDEAAAARFGLGHGARFSRKHERAAAEMPFPDPPPGGGGGSPVCQPLSPPPNLKPKHLWPHS

SEQ ID NO: 64423 - DNA, 767 bp, Zea mays
  misc_feature: Ceres CLONE 1534098
  misc_feature: Encodes the peptide sequence at SEQ ID NO. 64424
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (14)..(14): n is a, c, t, g, unknown, or other
  misc_feature (31)..(31): n is a, c, t, g, unknown, or other
  misc_feature (34)..(34): n is a, c, t, g, unknown, or other
  misc_feature (38)..(38): n is a, c, t, g, unknown, or other
nnggccccnnactnccggctgagctaccagnggnggcngccgctctataactagtggatcccccgggctgcaggaattcgtctcacccctagaaaaagagtcgacactcgacacaggcccgcgatccgctcccctttcttccttccccggattcgcggcgatctagccggcggcgggcggcgcagcgatggcggggcaaaaccagcggctcaacgtcgtgccgacggtgacgatgctcggcgtcatgaaggcgcggctcgtcggcgccacccgcggccacgcgctgttgaagaagaagtccgacgcgctcacggtccagttccgcgccatcctcaagaagatcgtagccgccaaggagtccatgggcgagacgatgcgcacctcctccttcgcgcgcggggaggccaagtatgtcgccggcgacggcgtccgtcacgtcgtcctccagtcaatccgcggcgccgccgtccgcgtccgatcccaccaggagaatgtcgccggggtcaagctccccaaggtcactcacttcggcgaacccgccgcgggatccggaggagccctccaacgcgtgttccaagccttacgggggcccggccccgggggggcagcagggagccagctggccgaggcgggggaggtctagggcgatcaaggggggtcgttcgaagacccccctggcacccagagcgtccttttgtcgaaggtcgaggaaaggccatcaaaagagcagctaaccggtcggggtaagataggccaggaagtaatgg

SEQ ID NO: 64424 - protein, 151 aa, Zea mays
  misc_feature: Ceres CLONE 1534098
  misc_feature (15)..(150): Pfam Name: ATP-synt_D Pfam Description: ATP synthase subunit D
  misc_feature: SWISSPROT Homolog: EC 3.6.3.14 H(+)-transporting two-sector ATPase
MAGQNQRLNVVPTVTMLGVMKARLVGATRGHALLKKKSDALTVQFRAILKKIVAAKESMGETMRTSSFARGEAKYVAGDGVRHVVLQSIRGAAVRVRSHQENVAGVKLPKVTHFGEPAAGSGGALQRVFQALRGPGPGGAAGSQLAEAGEV

SEQ ID NO: 64425 - DNA, 573 bp, Zea mays
  misc_feature: Ceres CLONE 1534099
  misc_feature (233)..(233): n is a, c, t, g, unknown, or other
  misc_feature (268)..(268): n is a, c, t, g, unknown, or other
  misc_feature (322)..(322): n is a, c, t, g, unknown, or other
  misc_feature (506)..(506): n is a, c, t, g, unknown, or other
  misc_feature (531)..(531): n is a, c, t, g, unknown, or other
  misc_feature (532)..(532): n is a, c, t, g, unknown, or other
  misc_feature (534)..(534): n is a, c, t, g, unknown, or other
  misc_feature (556)..(556): n is a, c, t, g, unknown, or other
aagctggagctccccgcggtggcggccgctctagaactagtggatcccccgggctgcaggaattcgtctcacccctagaaaaagccgcccccgtctcctctcctctcctctcccccgcatccacggccgcaggccgcagccagccactcgacgatctagtcgtctctctctccccgctctgccgcctcgctgccgcggcttcccgtcggctggaggatgaaggtcacggtcgntgtcccgggagcggccggggaggtccgtcaagggncggcatcgacctcaaagactcgggccaggtcgcggaactgcaagagggcatccntggccagggaactaagaagatttatcttttaaggaagggggtcccccctcccccctttttaaacccgggaaaaaaaaggggcgggaaaaacactttttttctccctcctccaaaaaggggccccccccccggttaaaaaaaaaaaagcgggggagggataggaaaaaaaaaagggtgtgggggnggggcggcccacacccaacagaggnntnttctctatcctccaaaaaaaanaagataagggggggggg

SEQ ID NO: 64426 - DNA, 710 bp, Zea mays
  misc_feature: Ceres CLONE 1534101
  misc_feature (578)..(578): n is a, c, t, g, unknown, or other
  misc_feature (581)..(581): n is a, c, t, g, unknown, or other
  misc_feature (582)..(582): n is a, c, t, g, unknown, or other
  misc_feature (650)..(650): n is a, c, t, g, unknown, or other
acccgcggtggcggccgctctagaactagtggatcccccgggctgcaggaattcgtctcacccctagaaaaaactcccagcttccgccgacgctcgcttcagctgctgctttccttcccatccttcaacaggtgcaatttgcatttcccatggagctcactgattaataacgtgtgagctgaacttgcttttctgtggacaatttggaacttcagtactagtttccgataggattcagggagaaatgatctcttttaacaatttattttggagctcccttcagccttctttcaagttttacagaaagtgcctgacaaactgcccatattttgcactgaccatgcattcaactacaaagcccttgggttcatctatgccggtaaagagggcgcatttgaagccacatgccgcagacatcaagaggaacccccatgtacatgagctttacaaattggtttaccgacttccggagaaccttagctggctgttggcaccaccagaaattcctaaaagacctgccctcaagaagaaaaacaaaagacgaaatagtggccggtaacagctttggtgtgatcttnganntggagggaatttgttgtgaatgatgatgatccagacttggagccccgggtttggttatgtctatcacntagagaggggaagtctttccctccgaatgcatgctgaagaaaatcgagggaatgaaactt

SEQ ID NO: 64427 - DNA, 712 bp, Zea mays
  misc_feature: Ceres CLONE 1534102
  misc_feature: Encodes the peptide sequence at SEQ ID NO. 64428
  misc_feature (275)..(275): n is a, c, t, g, unknown, or other
ggatcccccgggctgcaggaattcgtctcacccctagaaaaaattatgcagcacctcagaaacctagtggatgttgaaaatagaaatggagatttggcagctctgtctgaagacacgactgaaacaaatcgtcctcctatcagagttgtaccatttcctgtccctgttcaatgcttcacatttgatgggcagccgttctggaatggagaacggtgggatcttccttctaccccagaacactcccgccctttggaatatcaaaacaccaacgtggnttggaatcaattccgcaagtagacttctctgcccgcaaaaatctcaatcttaatgaaccaatttggggtggggttgctacaccgtggttgaaaaatgccgaacgcaccccttttggtgtaaggtccttccccagcccccacttggggaacgcctgttgccttgttaaaaaatatcccaagaagaatgcatcttacgggcgtgattttcctcctgtgggcccggtttgatacttctataatctctttctgggggggcttaacggaccagcccctaataaactcttttatactatgtaatagggcttggcactctagagcccgtcccatctgaacatcacacccccctctcatgggaaggcgatttttttgaaagggtatattagggcgcgcggattgcgcatacagtcccgacgatagctctagcagagatactatcg

SEQ ID NO: 64428 - protein, 98 aa, Zea mays
  misc_feature: Ceres CLONE 1534102
  misc_feature (92)..(92): Xaa is any aa, unknown, or other
GSPGLQEFVSPLEKIMQHLRNLVDVENRNGDLAALSEDTTETNRPPIRVVPFPVPVQCFTFDGQPFWNGERWDLPSTPEHSRPLEYQNTNVXWNQFRK

SEQ ID NO: 64429 - DNA, 652 bp, Zea mays
  misc_feature: Ceres CLONE 1534104
  misc_feature: Translation starting site: 170
tccccgcggtggcggccgctctagaactagtggatcccccgggctgcaggaattcgtctcacccctagaaaaacgtctcttcctctcccgtctccgcagacgcctcccttttcttctcactccactccgccgcccggattcagagcgagaggaggcggagagggcggacatggcggcgatgttggtgggcgcgctgcggaggggaagtggatgccgcggcggcttgcgccttatcgctcattcgcttcgcagattcttgagcacgctcgtcgtagcggagcacgaaggcgggttcgtcaagccgtcgtcgctgagcgcattggccgccgcggaggccattgccaaggacaacaaagtttctgtccctgctgggtggttccgggccggcgctttcacaggccgccgaccatgccgcgtgcagccatccactggtgtctgaagtgctcgtggccgattccgaagcctttggcgcattctctgggctgaacccctggggccgaactactccgcgttccgttccagcaaaaaggaaggctaccctccctgtcctaaaccttcttccccatttttttggggaaaaaatttggtttccccggggtgtggggctcccccttggggggggcccccccggtgaacgggggtggcccccccc

SEQ ID NO: 64430 - DNA, 724 bp, Zea mays
  misc_feature: Ceres CLONE 1534105
  misc_feature: Encodes the peptide sequence at SEQ ID NO. 64431
cgcggtggcggccgctctagaactagtggatcccccgggctgcaggaattcgtctcacccctagaaaaatagttagccttcaattcatcgagcaccactgcacatctcgatcatcattttgcgatacacattctaccaaactcgatcgcaagaagaagaaacagctagctagctaccaatcaatggcgtccaacgacaacgtcgccatggccagcgaggtgagcagcgccgtggccaagctcaacgaccacctcgccaccgccctcaccggcagcggcagtgagaacgccggcaccgtcatcacgctggcggggaagaacagcggcgccaccatggaggcggcggccgcgggcgacgtggaggacctcgtcgtcgtcggcagcgtggacgcggaggagcaccacgaaggccatggccaccaggacgaggaggaggaggtggaggagaacgtggtcatcaccgcctacgccaacagcaactaccaggccgtcaacaactcggtgctcgtcgctggcagctgcgccgtcgacgaccccggcgtgcacgtcgtcgtggtggagcatgtcgacgagatacgcgactacgacgaggacatcgacggccaagagttctaagcactactgcattgttattactgcaagctatatggatggattaattgaagggcatatatatatatatatatatatatatatatatatatatatatatatatatatatata

SEQ ID NO: 64431 - protein, 143 aa, Zea mays
  misc_feature: Ceres CLONE 1534105
MASNDNVAMASEVSSAVAKLNDHLATALTGSGSENAGTVITLAGKNSGATMEAAAAGDVEDLVVVGSVDAEEHHEGHGHQDEEEEVEENVVITAYANSNYQAVNNSVLVAGSCAVDDPGVHVVVVEHVDEIRDYDEDIDGQEF

SEQ ID NO: 64432 - DNA, 724 bp, Zea mays
  misc_feature: Ceres CLONE 1534108
  misc_feature: Encodes the peptide sequence at SEQ ID NO. 64433
tccccgcggtggcggccgctctagaactagtggatcccccgggctgcaggaattcgtctcacccctagaaaaaacaccgagatttcctgcccgctcgttccgctgctctcatcgactcctcctgcgtgcctgccgaccggtccgaggcacgccgcggtggaggttctgccggccgggtcgtcggattcggccttaagttggttggttgggttgggtctcatgtccaccgcggtggcgctgccggcgcacggcggattccggcggtcggggagcgggaacccggatccggacgacgcgcacaagatgacgctgagcgccaacgggtacttggtccaagaagaggaggacgaagagcatggcgaacaggcggcggccaggatagaggatgaggacgatgaagaggaagacgaggaggcggaggcggtgtcggaggcctcgtcgatcggggcggcgtcgtccgacagctcctcctccatcggggagaactccgcgtcctacaaggaggaggaggaggaggaggttgagagtaaggcgcatgggcttgccatgatgggactggccacgctcgaatccttggatgatgccctgccctccaagctggggctgtccagattctactcgggcatatcaagtcgttcacgatcctggtggaagccgtcgacggctgccgccgtcagggagatcgcccagccggaagaccccttacacaagctgtcgcgcgtgg

SEQ ID NO: 64433 - protein, 168 aa, Zea mays
  misc_feature: Ceres CLONE 1534108
MSTAVALPAHGGFRRSGSGNPDPDDAHKMTLSANGYLVQEEEDEEHGEQAAARIEDEDDEEEDEEAEAVSEASSIGAASSDSSSSIGENSASYKEEEEEEVESKAHGLAMMGLATLESLDDALPSKLGLSRFYSGISSRSRSWWKPSTAAAVREIAQPEDPLHKLSRV

SEQ ID NO: 64434 - DNA, 679 bp, Zea mays
  misc_feature: Ceres CLONE 1534110
  misc_feature: Encodes the peptide sequence at SEQ ID NO. 64435
  misc_feature (370)..(370): n is a, c, t, g, unknown, or other
  misc_feature (380)..(380): n is a, c, t, g, unknown, or other
  misc_feature (392)..(392): n is a, c, t, g, unknown, or other
gcggtggcggccgctctagaactagtggatcccccgggctgcaggaattcgtctcacccctagaaaaaagacgcaccccttcctcgtttcgccgcctccgccgacaccgactgcctacctcagctgccgtcgccatgggcagaaggcctgctagatgctatcgccagatcaagaacaagccatatcctaagtccaggtactgccgtggtgtccctgaccccaagatcaggatctacgatgtcgggatgaagaggaagggtgttgatgagttcccctactgtgtgcaccttgtctcttgggagaaggagaatgtctccagtgaggcgctcgaggctgcccgcattgcctgcaacaagtacatgaccaagtnctgcaggaanaggaatgccttnccacccttaagggtccgggggttcacccgtttcccaggtcctcccccgtaaaaacaaaaaaagagtttttccgggtggcgggggggcaaaaagcccccaaaatggaaaaaggggggggccttttggaaaacccccggggccccccttggttttagaggggaaaattttttaaaggcccccctttttcgggagagaagaaggaaaaaaaaattttctctttttccccaaaaaatttccgcgcccgcccaaaaaaaaaaaaatcctccccgcccccccccaaaaaaaaa

SEQ ID NO: 64435 - protein, 102 aa, Zea mays
  misc_feature: Ceres CLONE 1534110
  misc_feature (5)..(99): Pfam Name: Ribosomal_L16 Pfam Description: Ribosomal protein L16
  misc_feature (79)..(79): Xaa is any aa, unknown, or other
  misc_feature (82)..(82): Xaa is any aa, unknown, or other
  misc_feature (86)..(86): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKXCRXRNAXPPLRVRGFTRFPGPPP

SEQ ID NO: 64436 - DNA, 719 bp, Zea mays
  misc_feature: Ceres CLONE 1534115
  misc_feature: Encodes the peptide sequence at SEQ ID NO. 64437
acccgcggtggcggccgctctagaactagtggatcccccgggctgcaggaattcgtctcacccctagaaaaagtcgctcggtccaccacctcagctccgccgcttgcccgcttttgctctctccctcccggctctcggcttcttctacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggcccagctctatgagaagtacaaggaccaaggctttgaaatcctggctttcccatgcaaccagtttggtgggcaggagcctggtaccaatgaggagattgtccagtttgcctgcacacgcttcaaggctgagtaccccatcttcgacaaggttgatgtcaacggaagcaatgctgcgcccatctacaagttcttgaaatctagcaaatgtggcctttttcgggaaaggcatcaagtggaaattttccaaggttcttgggttgaaaaggaggagacgtgtttgaggaatcgctatgcctccaacactttcacccctgaagaattggaaaag

SEQ ID NO: 64437 - protein, 162 aa, Zea mays
  misc_feature: Ceres CLONE 1534115
  misc_feature (10)..(118): Pfam Name: GSHPx Pfam Description: Glutathione peroxidase
  misc_feature: SWISSPROT Homolog: EC 1.11.1.12 Phospholipid-hydroperoxide glutathione peroxidase
MAASSTATSVHDFIVKDASGKDVDLSTYKGKVLLIVNVASQCGLTNSNYTELAQLYEKYKDQGFEILAFPCNQFGGQEPGTNEEIVQFACTRFKAEYPIFDKVDVNGSNAAPIYKFLKSSKCGLFRERHQVEIFQGSWVEKEETCLRNRYASNTFTPEELEK

SEQ ID NO: 64438 - DNA, 717 bp, Zea mays
  misc_feature: Ceres CLONE 1534122
  misc_feature: Translation starting site: 125
gctctagaacttctggatcccccgggctgcaggaattcgtctcacccctagaaaaagcccttcacgatacgcacccaccagaggaaaagggcaaaagccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacgggcggcgtggagtcgttcccgttcaaggccggcaagtaccagatgaagaagctgtgcctggagccgacgtccttcaccgtcaaggcggaagggcatcccaagaacgcccccgccgagttccagaaaaccaagctcatgacccgcctcacgtacacgctggaagaaatcgagggcccgcctcgaggtcggcttccgacggcaccctcaaagttctaaggaaaagggacggcatcgactacgccgcccg

SEQ ID NO: 64439 - DNA, 893 bp, Zea mays
  misc_feature: Ceres CLONE 1534125
  misc_feature: Encodes the peptide sequence at SEQ ID NO. 64440
  misc_feature (29)..(29): n is a, c, t, g, unknown, or other
ttttatcatgtgggacggggggcggtgtntatgatgggggggaataactggactccccgcggtggcggccgctctagactagtggatcccccgggctgcaggaattcgtctcacccctagaaaaactccccacaccacaccacaccggccggctcacacgcgccgcaaagcagagcacggggggctgagaccagagcagagcggagcgccaccagccaatcctttgcctgcccaagcagcagcagcagctggcccgatggctctgtctctctccggtacctccgcccgcttcgccctcgcgtcgctggtcccccgggccagggcccacgcggcgtcggcggcgtccggggccatgaggctgcgcggcggagggcccggccgcgggcaagggcaaggaggccgggcgcgccttcgccgccgccgccgagggctcgtgggatgcccaacccccccggggggcaactaccgcccggcggactgagggccgccgaccggcagaccccggccggaccctctgacggcggggcgaccgtatctccgcggtcttaggacgcgggggccttgaatcgtggccccacggatggaccgttatcgcgcgggagctccgggcccgtgatcatgggggaatggattggagggggccgccactgtcacccacggggttgcacccccaagaatgcgtgggcctgggaggggctgagaaggatggaataaactatgtgaatgatgcaagcacgccgcgttagccagtctcggtagcggcgtgctgtatcggcgagggccttggggacagtagctacgcgcgacgctgagggactcaattggggagtgactgctcgtagactacatcgactcggtgcggccgcgcgaccagtggtgtatcgaggcgctgc

SEQ ID NO: 64440 - protein, 74 aa, Zea mays
  misc_feature: Ceres CLONE 1534125
MALSLSGTSARFALASLVPRARAHAASAASGAMRLRGGGPGRGQGQGGRARLRRRRRGLVGCPTPPGGNYRPAD

SEQ ID NO: 64441 - DNA, 715 bp, Zea mays
  misc_feature: Ceres CLONE 1534129
  misc_feature: Encodes the peptide sequence at SEQ ID NO. 64442
  misc_feature (715)..(715): n is a, c, t, g, unknown, or other
tctgaactagtggatcccccgggctgcaggaattcgtctcacccctagaaaaactgcagttgtcagcagcaaaattagcagcagccacagcaagaggcaatagaggaatccatgtgctgtttgtgactgattgcttcccaatcccaaacctcttctcttgcaaggacctagtgaaacgtgaaggcaatgcttggatgtacaaacctgacgtgaaggctctaaaggagaagctcaggttgcctgtcggttcctgtgagcttgctgttccactcaacgcaaaagcacgactctacacggtagacagacgcagagaagcatatgctacaatactgcattcagcaagtgaatatgtttgcggtgcgataacagcagctcaaagcattcgtcaagcaggatcaacaagggaccttgttattcttgttgatgacaccattagtgaccaccaccgcaaggggctggaatctgctgggtggaaggttagaataatacagaggatccggaatcccaaagcggaacgtgatgcctacaatgaatggaactacagcaaattccgcgctgggggcagcttacagattacgaacaagggcattttcattgatggctgatctgctcatccctgagggaacattgatttccttgtttgcaatggccggaaaacacccccaaccgggaaacaatgctaacacttcttcaaactcgggggggaaagggcaan

SEQ ID NO: 64442 - protein, 136 aa, Zea mays
  misc_feature: Ceres CLONE 1534129
MYKPDVKALKEKLRLPVGSCELAVPLNAKARLYTVDRRREAYATILHSASEYVCGAITAAQSIRQAGSTRDLVILVDDTISDHHRKGLESAGWKVRIIQRIRNPKAERDAYNEWNYSKFRAGGSLQITNKGIFIDG

SEQ ID NO: 64443 - DNA, 667 bp, Zea mays
  misc_feature: Ceres CLONE 1534137
  misc_feature: Encodes the peptide sequence at SEQ ID NO. 64444
  misc_feature (667)..(667): n is a, c, t, g, unknown, or other
cccccgggctgcaggaattcgtctcacccctagaaaaagccccgggcaccgcgagctagctagctactgacacccggcgccggcgccgagtacaatacaaggaaagcagcatggtgttcgagcagcatgaggaggaggcggtggcgccgggcgcggtgcacgggcaccggctctccacggtggtgccgagctcggtgacgggggaggtggactacgcgctggcggacgcggacctggccttcaagctgcactacctgcgcggggtgtactactaccggtccggggacggcctcgccacctaggtgctcaaggaccccatgttcccgtggctggacgaccacttccccgtggccggccgcgcccaccgcgccgaggctgagggggacggcgcgccgcgccggccctacataaagtgcaacaactgcggcgtgcgcatcttggaggccaggtgcgaccgcgacttggccgagtggatccgcgacgccgcgcccggtaggatcaggcagctctgctacgacaaggtgctcggccccgatctcttcttctcgcccctgctctacttccagatgacaaacttcaaatgctgtgggctggccctgggattcagttgggcgcacctcatcggcgaaattccgtcgggcgccacctgcttttacaaggtgggcgn

SEQ ID NO: 64444 - protein, 116 aa, Zea mays
  misc_feature: Ceres CLONE 1534137
  misc_feature: SWISSPROT Homolog: EC 2.3.1.162 Taxadien-5-alpha-ol O-acetyltransferase
MFPWLDDHFPVAGRAHRAEAEGDGAPRRPYIKCNNCGVRILEARCDRDLAEWIRDAAPGRIRQLCYDKVLGPDLFFSPLLYFQMTNFKCCGLALGFSWAHLIGEIPSGATCFYKVG

SEQ ID NO: 64445 - DNA, 848 bp, Zea mays
  misc_feature: Ceres CLONE 1534139
  misc_feature: Encodes the peptide sequence at SEQ ID NO. 64446
  misc_feature (28)..(28): n is a, c, t, g, unknown, or other
  misc_feature (29)..(29): n is a, c, t, g, unknown, or other
gttaccatgtacacgggtcgtcacgaannaaaacacaaaaaaaaatagctggtactccccgcggtggcggccgctctataatagtggatcccccgggctgcaggaattcgtctcacccctagaaaattttttcccaccctgcctctctgctcttcccaagctccatccccttgctctcaccactgaaatgagcggcggcggcggccttgggtccggctgctcgaaccaaaagttcgtccacttcgcgctggagcagacccgccaccgctccactctcgtcccccacccgtcccaggaaaagttcatgttcataaaagcaaatgaggataacaccgttctcaatgccttgtcattcagcactttccaaaattagactgcttcggagcttgacaattgagcaaaaaaaactcggttcaggttcttgattatgcctgccttctcaagacctgagtacgcaccccccccataattttgtgccaatgctcttctcatccccctgcacggcaatattgttgccctagcgaaatccatcacctttgtatagacacccctgagcaacccggactacccgggtaaaaaaatactacagggacttgaaaaggccccattgggaccccaacttaccaatggagtcttcttgcccctggggatgggtaaagaatttacattgcgatatccctgtaaaatttctccctccccccaaattggtttactttacgaacaatcatacagaagccttaatcaaaataccacaccccgccaaaggctcgtacaactccggccctttcctcgtcattaatgtaattaagggccccggtctatagaatcatcattcaaacccgaaccat

SEQ ID NO: 64446 - protein, 61 aa, Zea mays
  misc_feature: Ceres CLONE 1534139
MSGGGGLGSGCSNQKFVHFALEQTRHRSTLVPHPSQEKFMFIKANEDNTVLNALSFSTFQN

SEQ ID NO: 64447 - DNA, 783 bp, Zea mays
  misc_feature: Ceres CLONE 1534141
  misc_feature: Encodes the peptide sequence at SEQ ID NO. 64448
  misc_feature (783)..(783): n is a, c, t, g, unknown, or other
tggaaaagtttattttatattaatgtatttacaactcacactataagaaataatggaactccccgcggtggcggccgctctatactagtggatcccccgggctgcaggaattcgtctcacccctagaaaaacctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccatgaatgagggaatggaaaggaaagatgttatgtcgaaaaatgtttcaatctacaaatcccaagcatctgcccttgaagcccatgcagctcccaactgcaaggttctggtggttgcctacccagcaaacacttattgctcttatcttgaaagaatttgctccatctattccagagaagaacgtttacttgcctgacccgtctggaccaacaatcagggctcttggtcagatttctgagaaactttaatgtccaagtttactcaatgggaaaaattgttatcttctggggtaaccactccatcctctcattcccctgatggtcaaccacgcccacaacggaaaaatttcctcctggtgggagaaaacctggttcgtggaagctttgcctctttatagaccaagatggccttaatttggtagaaattctatcctctatcttgttcacagccaaccctggtagacttgtttatcttatattctn

SEQ ID NO: 64448 - protein, 116 aa, Zea mays
  misc_feature: Ceres CLONE 1534141
  misc_feature (1)..(116): Pfam Name: Ldh_1_N Pfam Description: lactate/malate dehydrogenase, NAD binding domain
  misc_feature: SWISSPROT Homolog: EC 1.1.1.37 Malate dehydrogenase
MLDIPPAAEALNGVKMELVDAAFPLLKGVVATTDVVEACTGVNVAVMVGGFPMNEGMERKDVMSKNVSIYKSQASALEAHAAPNCKVLVVAYPANTYCSYLERICSIYSREERLLA

SEQ ID NO: 64449 - DNA, 958 bp, Zea mays
  misc_feature: Ceres CLONE 1534142
  misc_feature (19)..(19): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (958)..(958): n is a, c, t, g, unknown, or other
ctaagcgttattcctattnttggggagccctctccnnngctccnnnnnnggaaggtgtcctccccgcggtggcggccgctctagaactagtggatcccccgggctgcaggaattcgtctcacccctagaaaaagagagatagagcgaggcaccaagaagggaaaaaaaagagggacaggaaaaaaatcattcgcgtttcgctctccgctagaccccgcccaaatcaatggagattagggctccgccgactagcctgaggctcgcgccgccgcccgcctccgacagctgccgacgaaccccgctttacgacctcctgtccgttcgcggcggcgtgtcgcttcgagtttgtgcccgccacgaaggcgaatgtcttgcctagtacggggcgctagagttacgaagttaagttctttttaaccaccctcccacggggggggggggggggggtcctggtaagtcctactttcttcacttttccccccccccccgtccccgtggaaggcatttcatggtttcacgcgcaacgtgttttggagcgtggttatcggttggatctgggagccatgctacgtggccgagccgtcggccatggtcgttcttggagcggctgtgtggggctgtcctggccacgcacagcggtgatcgcgggctataaccttcgttcgtgtcgccggacgtcgtgcgtggtgaacgcgtccgcctccttggccggggcgcgtcactccccctcgaaggggggcgccaatgaatgtgcctacagctgacacagggtcgagctgtatctgtagctaatggtcttgacacggagacgagagcctttgcgcgcggcgggtgtctcagtgtgagagacggtccggcgactggttgcatagcgttcacgcttcgcaaatctgacctctggctgtcacgttggcacccgcgggcgcctacatcgctctcggggcggccggctgcgccn

SEQ ID NO: 64450 - DNA, 801 bp, Zea mays
  misc_feature: Ceres CLONE 1534143
  misc_feature: Encodes the peptide sequence at SEQ ID NO. 64451
  misc_feature (13)..(13): n is a, c, t, g, unknown, or other
  misc_feature (14)..(14): n is a, c, t, g, unknown, or other
  misc_feature (38)..(38): n is a, c, t, g, unknown, or other
atgttatgacccnnagaatgttaaatataataatatantattgaataactggaactccacgcggtggcggccgctctataactagtggatcccccgggctgcaggaattcgtctcacccctagaaaaagctctgctcctcccagtcccagactcccatcctcgcctccgccatggccgccgtcggcatcccctcccctccggcgccacacgtcttcgcgcccgccgcatctccttcctcctccacgtactccacactgggcccccgccgtctccgcctctccacccgactcggactcgccgccgcggcggcgtcgtgccgtacgcggtgcgctgccgctgccgatggcggggccgcggcttcggagggtgcctctgaggtggcggagctggagggggaccccgacgctggcacagacgttgccggaggcgccgcgacctccatgcggacgccctactcgctcatctccgcggacaacgtgcagaaggcgatgcgcggcctcgcaattacagatgctgaccactatgggaggcttggagtcacccaagctagcttctactgatgagggaaaagctgcgtaacgaaaagatgtgtgaacaactataatagcaaaaaactattaagaaaaagaagcttaacaaggaaacatgagctccgaaagggaaaccatttactattacaatcaacggaaggaaaaaacggaaaaattatatgaattggtagccttgttcaacaaatgaggaaaaaccttgtaccgaaaatggtctgggcctaataagaaagtttgaatctcattgagaag

SEQ ID NO: 64451 - protein, 129 aa, Zea mays
  misc_feature: Ceres CLONE 1534143
MAAVGIPSPPAPHVFAPAASPSSSTYSTLGPRRLRLSTRLGLAAAAASCRTRCAAAADGGAAASEGASEVAELEGDPDAGTDVAGGAATSMRTPYSLISADNVQKAMRGLAITDADHYGRLGVTQASFY

SEQ ID NO: 64452 - DNA, 943 bp, Zea mays
  misc_feature: Ceres CLONE 1534144
  misc_feature (865)..(865): n is a, c, t, g, unknown, or other
  misc_feature (896)..(896): n is a, c, t, g, unknown, or other
  misc_feature (943)..(943): n is a, c, t, g, unknown, or other
gtttttgtataaataaacccctcccctctcccccccctccccaatagctgggtctccccgcggtggcggccgctctttaactagtggatcccccgggctgcaggaattcttctcacccctacaaaaagctagcgcgagtggtggcacccacgcacactcttctccccccagtccggaccccggaggagccaagccatggcgtccacctcctgctgcctcctccaccagtcaaccgcccgcctcggcgcgtctccgcgcctggccgccgccccgccgcgcaacgcccaactgctcttcttgcaatgcccggaagcaggacgccgcctctgaccataatgacttttctcactgcgccgagtttcgcgctccctctgacggattgacgacacgcactcggaaccaaggtaggtacccgcaccccccccgtaattacggaagaaagtcatcctacgttagtccgggtaaggcctaagggcgtatccaccctatttacactcccccgttacatgccgtccgaacgggtctctctatgactcgccgtgatccccattcctaagttggcaatacccctcagtctatggaaacttgtgaatttattcccgcagcggagtaagtatggcctccttccacacctaagagaatcaaactttctttgaccgcgagaaattgccgtacttgtgtgataacgcttcacccatatcactagtccccatcagtcttatagataaaaacaatactatcgataatattatgtactctatcctgtttattgtatttcctttctgccccattgtatactctactctttgactcatcttcgacgcccagcaccttattggcgaggatatataagactgaatttatnaatgaccagatgatttgaagatacgacggcntcccacaggacacgtcttatcctatatgatacatggagaaatactcn

SEQ ID NO: 64453 - DNA, 807 bp, Zea mays
  misc_feature: Ceres CLONE 1534148
  misc_feature: Encodes the peptide sequence at SEQ ID NO. 64454
  misc_feature (20)..(20): n is a, c, t, g, unknown, or other
atttatttttctataccacnggaactgggagaatggtcattatgaaaaaacttggactccccgcggtggcggccgctctagaatagtggatcccccgggctgcaggaattcgtctcacccctagaaaaagttctggggccggaacaaggccgagggcacgctgcgcgaggcctgcgactcgggcctctacaccatggtgatcatgtccttcctcgacgtctacggcccgcagcgcggcggctaccagtaccacctggacctgtcgggccacccgacggccggcatcggggacgacatcaagcactgccagttcgtgggcgtgccggtgacgctctccgtcggcggcttcggctccggctactcgctcccgtcgacgcaggcggcgctggacctgttcgactacctctggaacgccttcctcggcgggtcgaagccgggcgtgcgccgccccttcggcgacgcgtggctcgacggcgtcgacctgttcctggagcgcggctcgcccgccgaccgctacgacgtgctggcgctcgagctcgccaagcacaacatccgcggcgggcccggcaagccgctgcacctgacggccacgccgcgctgcgggtttcccgcccgccgggctacttgcgccgcgcgcttcgaacacgggcattcttcgagcgcgtcccaccttccgggattctaacgacgaacgcccaacctgccgaaggccaaggtggggcacccttctcgttggggaactaaattggaacgggcgtgcctaaacccgggcccaccaaagtgtttcctacccttcaggcctttcac

SEQ ID NO: 64454 - protein, 163 aa, Zea mays
  misc_feature: Ceres CLONE 1534148
  misc_feature (1)..(158): Pfam Name: Glyco_hydro_18 Pfam Description: Glycosyl hydrolases family 18
  misc_feature: SWISSPROT Homolog: EC 3.2.1.14 Chitinase
MVIMSFLDVYGPQRGGYQYHLDLSGHPTAGIGDDIKHCQFVGVPVTLSVGGFGSGYSLPSTQAALDLFDYLWNAFLGGSKPGVRRPFGDAWLDGVDLFLERGSPADRYDVLALELAKHNIRGGPGKPLHLTATPRCGFPARRATCAARFEHGHSSSASHLPGF

SEQ ID NO: 64455 - DNA, 740 bp, Zea mays
  misc_feature: Ceres CLONE 1534149
  misc_feature: Encodes the peptide sequence at SEQ ID NO. 64456
  misc_feature (605)..(605): n is a, c, t, g, unknown, or other
tccccgcggtggcggccgctctagaactagtggatcccccgggctgcaggaattcgtctcaccccaagaaaaaagtcttccgatccccacgaggtaaaaacaccgtacgctcaccaccaagacaacgccaaccaacctgccccctcacccccgctgggcgctgcttaacaaaccgccgccacaggacaagacaaacttattacagctccacctcagtgctgaagacactgacggtcagccaaaccgctcaccgcacacgctgaatgcaaacagcatgtacgccgacgccgggttcgccttcaccttcgccgccgcctactcccccaccctcacttcctcgcagccccagccgccgccgccgccgttcgactacaccttctcctccgagccaaccctcctctccatgcccgccatggaccacgacgcctacctggggaacttggtacagacatccatggtatcagaatatgacctggcgatgagaacggaacctgttcaaagctccagaagccatcatcgaggaaccgctgctcaacctcgatcctggcgcatctgccttatcctagatggaggcgcccgaaaatgctgtcgagggtcaaaactangaaagacgcgcgcgccaggaacgtaaaaaatgaaccccatcctggagctaggggctctagcaagtgcaacagggaactcagggcagaaccccccaatcccaagaggacattatgtgaacgttaacggaggtgcgg

SEQ ID NO: 64456 - protein, 118 aa, Zea mays
  misc_feature: Ceres CLONE 1534149
  misc_feature (111)..(111): Xaa is any aa, unknown, or other
MYADAGFAFTFAAAYSPTLTSSQPQPPPPPFDYTFSSEPTLLSMPAMDHDAYLGNLVQTSMVSEYDLAMRTEPVQSSRSHHRGTAAQPRSWRICLILDGGARKCCRGSKLXKTRAPGT

SEQ ID NO: 64457 - DNA, 671 bp, Zea mays
  misc_feature: Ceres CLONE 1534155
  misc_feature: Translation starting site: 422
ggatcccccgggctgcaggaattcgtctcacccctagaaaaaatcgcaaatcctcgggcaagaagagccaacagaaaagtattcatccaagaacaccacccccacccgctccaagcagaaattttgtcttgaagagagccaccaccaatggcttgttacaacaacactgcatctttagcggcgactctgctggcgttcgcgctgacgtttcaggcctgcctcgccgggaggaggctcaccgcgctggtgcaggagccggccataaccatgaagtaccacaagggcgcgctcctgtcgggccccatcgccgtcaacttcatctggtacggcgacttctcggcgccgcaacgggcggtgatcaccgacttcctctcagtcgctgacggaggcggccccggccgcggagcagccggagccgtccatggccacgtggttcaagacagagcgcaggtactacaccagctccaaggtgccgttcccggcgctgcgcctcggctcccacgccgtccaccggaactgctccctcggcaggcgcctgacggagagggacctgatcaggctcgcccccaggggagccccgagccgcgccatcaacctggtgctcaccgtcgtcgaagtggccgtgaacaggttctgcgagtcccggtgcggcacgcacggcgcgtccccgc

SEQ ID NO: 64458 - DNA, 914 bp, Zea mays
  misc_feature: Ceres CLONE 1534159
  misc_feature: Encodes the peptide sequence at SEQ ID NO. 64459
  misc_feature (171)..(171): n is a, c, t, g, unknown, or other
  misc_feature (414)..(414): n is a, c, t, g, unknown, or other
  misc_feature (426)..(426): n is a, c, t, g, unknown, or other
  misc_feature (679)..(679): n is a, c, t, g, unknown, or other
  misc_feature (715)..(715): n is a, c, t, g, unknown, or other
  misc_feature (832)..(832): n is a, c, t, g, unknown, or other
  misc_feature (907)..(907): n is a, c, t, g, unknown, or other
  misc_feature (914)..(914): n is a, c, t, g, unknown, or other
atagctggagctcaccgcggtggcggccgctctagaactagtggatcccccgggctgcaggaattcgtctcacccctagaaaaaagcgctgccaaatcaggaaacgggcacgacgcgggcggggcggggagccaaaatggcgctcccgggcccggcggcgacccgcgcggnggtgaggctctgccggatcgcggcgagcgcttcctcgtatttgccgtctgcggcggccgacggaaggagggagcttggacctcccgttcgcgcctggtggcggagcgggggtatggtgctcgggcggccaccgcaataatgcgtaattaaccctgtggggggcacccgcccggaggcgcgctttcggtggcctttttttttccccccccccacggagggaaagtacaggggggtcttaacctncccccccttttnctcccccacccccctttcttcccaaaattcaagcatatcaggtcctccctagcgggtggggcgtgcccccaatctacttccttcctttcatgctaatgtgcgcatgcgtttcgcacccgcgtcgagttcgcttgtgggttgtttacttcttgctccgcgcctagcctcttcgtgcggttctatgcgtccatcggaaatccgcatctctcgtgttttgtgtgtggggatggcctggccggcatcgcgactccgncgcgagcgagcatcttcctccttcgctgcatacccnccaccgctgcgcccctggcatatcactctctcctcatttgccgtggcgagtgcaggaatgtcgacactaaccgacgcgctacggcgtatcgcgtctgcacgtgggctgcacggatgnggtgcaccttcgtggaccggcgtctcgcgttcgcggtttgtcctctcgcatcacccgtcgccgtcctcgacgctnctccttn

SEQ ID NO: 64459 - protein, 57 aa, Zea mays
  misc_feature: Ceres CLONE 1534159
  misc_feature (12)..(12): Xaa is any aa, unknown, or other
MALPGPAATRAXVRLCRIAASASSYLPSAAADGRRELGPPVRAWWRSGGMVLGRPPQ

SEQ ID NO: 64460 - DNA, 829 bp, Zea mays
  misc_feature: Ceres CLONE 1534160
  misc_feature: Encodes the peptide sequence at SEQ ID NO. 64461
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
ttatgttaaatgttttggtggtgagtnnnnatgttnnnnntacatagtggactccccgcggtggcggccgctctagaatagtggatcccccgggctgcaggaattcgtctcacccctagaaaaacagccccaatgggtctgaccaggcaatcttctacaattccaccagctactgggatgagtttgtgtggggtggtgcgtggatgtactttgccacagggaacaattcatacctcacggtcgccactgccccaggaatggcgaagcatgctggagcctactggtttggaagtccaaactatggagtatttacctgggatgacaaacttccaggagctcaggttcttctcagcaggttgcgactcttcctaagtccagggtacccttacgaagaaatactgaggacattccacaaccaaaccgacaatgttatgtgctcatatctggcctccccccggttcgttcaactttctctagaggaggactaataacaactccaccaatggaagggccccaggccacttccaataatgctggccgaccgcaggttttccttggcttcggttataccgccgacctatcttggaaccttgcataacactccgcgggaagggcactgcggggacctttctctttctaccgccgggggaagtgcctcccgcgaaggttgcgcagggtcacaacctctcgacttactttccttggccaaaaacacccctgtgaaagagaagcctacgattgtggggttttccgcgaaagaaataacctgaaagcggccctctatatgagagggcggcgtcaaatcccttatctaacggcggtcaggggg

SEQ ID NO: 64461 - protein, 94 aa, Zea mays
  misc_feature: Ceres CLONE 1534160
  misc_feature: SWISSPROT Homolog: EC 3.2.1.4 Cellulase
MYFATGNNSYLTVATAPGMAKHAGAYWFGSPNYGVFTWDDKLPGAQVLLSRLRLFLSPGYPYEEILRTFHNQTDNVMCSYLASPRFVQLSLEED

SEQ ID NO: 64462 - DNA, 675 bp, Zea mays
  misc_feature: Ceres CLONE 1534170
  misc_feature: Encodes the peptide sequence at SEQ ID NO. 64463
  misc_feature (565)..(565): n is a, c, t, g, unknown, or other
ggatcccccgggctgcaggaattcgtctcacccctagaaaaatttttttttccccgcacggcggagttcacaatccccaccggccggcgtagcggatattgcgagttacgacggggaaggagaggaagatccgtcgatccgcgcagattcgtttcgatcgtggtttggtgacttggtaagaggggaggggagaagcggcgatgtcgggcgtgttcggcagggtgttcgggaagtccaaggagcagagccaggcgaccgcgctggcctcgctcgacaagctcaacgagacacttgaaatgttggaaaagaaggaaaacttgctagtgaaaaaggccaatcttgaggtcgagaaggctaagaattttaccaaagccaagaataaaagagctgcaatacagtgcttgaggaggaaaagactatacgagcaacagattgagcagcttggaaatttccagcttaggatacatgatcagatgattatgctggaagcagcaaaagctacaacagagaccgtggatgcattgagaactggagcatcagcaatgaaagctatgcataagtcaancaatattgatgatgttgataaaaccatggatgaaattaatgacaatatggagaacatgagactaattcaggatctgttgtcagcgcctatgggagcagcagctgattttg

SEQ ID NO: 64463 - protein, 158 aa, Zea mays
  misc_feature: Ceres CLONE 1534170
  misc_feature (22)..(158): Pfam Name: Snf7 Pfam Description: Snf7
  misc_feature (122)..(122): Xaa is any aa, unknown, or other
MSGVFGRVFGKSKEQSQATALASLDKLNETLEMLEKKENLLVKKANLEVEKAKNFTKAKNKRAAIQCLRRKRLYEQQIEQLGNFQLRIHDQMIMLEAAKATTETVDALRTGASAMKAMHKSXNIDDVDKTMDEINDNMENMRLIQDLLSAPMGAAADF

SEQ ID NO: 64464 - DNA, 731 bp, Zea mays
  misc_feature: Ceres CLONE 1534173
  misc_feature: Encodes the peptide sequence at SEQ ID NO. 64465
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
nnnnnnnnnnncccggggttgccccgcgccccccccccgcgtattttttttaatgtggaactccccgcggtggcggccgctctagaatagtggatcccccgggctgcaggaattcgtctcacccctagaaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcagcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtactgtggtggccgtggaagcagcggctacggcggtggcgggcgccgtgatggcggtggcggctacagaggtggacgctgctacattggctgaggaagctacgttggttgtgtccgtcgtttacttgcttgggaaaccttgtaagctggtttttgttaattctaacgggaacctggagaaaactgaaacgctgggggcccccacacgacc

SEQ ID NO: 64465 - protein, 126 aa, Zea mays
  misc_feature: Ceres CLONE 1534173
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFSFVTFSTEEAMRNAIEGMNGKELDGRNITVNEAQSRGGRGGGGGGYCGGRGSSGYGGGGRRDGGGGYRGGRCYIG

SEQ ID NO: 64466 - DNA, 746 bp, Zea mays
  misc_feature: Ceres CLONE 1534178
  misc_feature: Encodes the peptide sequence at SEQ ID NO. 64467
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
ttttatactcttttttttctttaaaataaaaaaaaaaaaaaaannnnnngnaaaaactggaactccccgcggtggcggccgctctagaatagtggatcccccgggctgcaggaattcgtctcacccctagaaaaaccgtctccgcctcttcctcctcgcctccaacgccgccaccacagccccggccccgtgttgttcctgcaccccacccgtcctgcgaggctcctccgccatgccgtcatacgcgcaccaccatagcagccctctggtaaggaacggtgccggccgtgttgtccgtagacgattgagggggacagaaagagattctttggatgtttttctttgtttcctttatttataccgagagataaacaaaaaaaaaaaacccagagacgaaaaaactttttttcttgaaccgccctgcttcccctctggtgttgggaatttgtgattttgacatacgacctgtatgggtatttttccggccggtgaaggatgataccaagatggacgcgctgaagtgtaacaacaacagcgccccgccggaggagaccgcggaggacgccgacgccgccggggcgctcgtcgagaaagacgggttctcggtcgaggacttgctggacctcgaggagtttggcgagcctgaaaaggacggcgccgagcctgaggacgatgacgccccgccggtacccgccgcggccgaggagaggtcgaaagacaactcacagccgttgtcggtcgtgaca

SEQ ID NO: 64467 - protein, 80 aa, Zea mays
  misc_feature: Ceres CLONE 1534178
MDALKCNNNSAPPEETAEDADAAGALVEKDGFSVEDLLDLEEFGEPEKDGAEPEDDDAPPVPAAAEERSKDNSQPLSVVT

SEQ ID NO: 64468 - DNA, 748 bp, Zea mays
  misc_feature: Ceres CLONE 1534184
  misc_feature: Encodes the peptide sequence at SEQ ID NO. 64469
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (44)..(44): n is a, c, t, g, unknown, or other
  misc_feature (45)..(45): n is a, c, t, g, unknown, or other
  misc_feature (748)..(748): n is a, c, t, g, unknown, or other
nnnnnnnnnnnnnnnnnnnnnnnnnnnnnnnnggggaaaaaaannaaagaaagggttaaaactggagctccccgcggtggcggccgctctttaatagtggatcccccgggctgcaggaattcgtctcacccctagaaaaaacatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggacagagggcttcttctggctggtgaaccacggcgtggcggaggatctgatgggcggcatgctccgcggggtgcgccagttcaacgacggccccgtggaggcgaagcaggcgctctactccagggacctggctcgcaacctgcgcttcacctcctacttcgacctcttcaaggccgctgcggacgacaggcgcgacacgctcttctgcgaagtggctcccaacccaccgccgcggaaggagctaccggaaccactgaagaacgtgatgctggaaaacggccn

SEQ ID NO: 64469 - protein, 187 aa, Zea mays
  misc_feature: Ceres CLONE 1534184
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTEGFFWLVNHGVAEDLMGGMLRGVRQFNDGPVEAKQALYSRDLARNLRFTSYFDLFKAAADDRRDTLFCEVAPNPPPRKELPEPLKNVMLENG

SEQ ID NO: 64470 - DNA, 672 bp, Zea mays
  misc_feature: Ceres CLONE 1534185
ggcggccgctctagaactagtggatcccccgggctgcaggaattcgtctcacccctagaaaaaatccatccatccatctattgtctcccttccaattcgatgcctttgtagcgctgctgcctcgccgcgtcgtcgcgggtccccgatttccgcttgctgctgcgcttcccacaccatggacagcgggggatccggcaatgcctccggcggcagcggaggcgcatcgacgtgctgctactacgcgctcctcggcatccgcaagaacgcctccgccaccgacatacgcgccgcttaccggaggctcgcgatgaactggcacccggaccggtgggccagcgaccccggcagcggccggcgaggccaatcagcggttccagcggatccacgaggcatactccgttctgtcggacaatgcgaagaaagccatgtacgacgccagtctcttcgaccccctcgacgacgacgaccaggatttctccgacttcatgcaacgagatgcctggtgatgaaggattaccttgaaaaacaaaaaaacccgaaaccgcctgaaggaaccgcaaaaaaatcttgaaggaaatccggaaaggccaaccgccgggttcgggaaccagccacaaggggggcggggcccccaaagaagggggcctcaaggggaaacccccttttcccccc

SEQ ID NO: 64471 - DNA, 699 bp, Zea mays
  misc_feature: Ceres CLONE 1534187
  misc_feature: Encodes the peptide sequence at SEQ ID NO. 64472
gcggtggcggccgctctagaactagtggatcccccgggctgcaggaattcgtctcacccctagaaaaagcctccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaagcgctctgtagaggttgtgaaggtcacagatgagatgaaagcgtttgcggcctatggcaagc

SEQ ID NO: 64472 - protein, 181 aa, Zea mays
  misc_feature: Ceres CLONE 1534187
  misc_feature (6)..(181): Pfam Name: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKRLAPTIGISVDHRRKNKSLEGLQANVQRLKTYKAKLVIFPRRARKVKAGDSTLEELTTATQVQGDYMPITRGEKRSVEVVKVTDEMKAFAAYGK

SEQ ID NO: 64473 - DNA, 689 bp, Zea mays
  misc_feature: Ceres CLONE 1534188
tggcggccgctctagaactagtggatcccccgggctgcaggaattcgtctcacccctagaaaaataaaaaacgctgctttgaggagactctttctggtttgtttccggttactgtacatggggatttcctgccccgccatgtgttctaccgctttcatgctgtttgtgcttatcttcgctgcatttttgttgcgctctgtgtgctactcagatggcccttctttgatgtcatattggtagaccaggtttctgttgtgattccactacttaaactaatggcatcatcgaagataatattttactgtcatttccctgatctgttacttgcacaacatactagtctgcttcggaggttatatcgcaagccaattgacatgattgaggaaatcaccactggtatggctgatttgattcttgtcaatagcaagttcactgcagcaacttttgcaaggaccttttctggtttacatgctagaggaatcgagcctggtgttctttatccagctgtctctgttgagcagtttcacgaaccccatgcttataagttgaatttcctatcaatcaaccggtttgagaggaaaaagaatcttgatcttgccatttcagcatttgctttgctccgttctgctgcttggactatacctggtgatgctctacaagaagcaacattaacagtggcaggtggctat

SEQ ID NO: 64474 - DNA, 669 bp, Zea mays
  misc_feature: Ceres CLONE 1534191
  misc_feature: Translation starting site: 92
  misc_feature (669)..(669): n is a, c, t, g, unknown, or other
ggatcccccgggctgcaggaattcgtctcacccctagaaaaaagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgtagctacctcaccaggcgagttccccggcgactactgctgggacaccgccgggctgtccgcggaccccgagacttcgccaggaaccgcagctggaggtgatcacttccgctgggcatggtcgggcgctttgctggattcttcccaaattgtttcccccaaggggttaaattcgggaaaggcgtctggttaaggcccggtcccaaattttttacaaagggggggtggaaataccctgggaaacccccaccttgattaaccccgcaaaaaatcctccccctttggggcccccccaagatttggtttcattgggggccctcccaaagcgcgtcccccctttttgggggggggcgcgcccctccgaaaaagtgttgttaaaaaccccttttan

SEQ ID NO: 64475 - DNA, 831 bp, Zea mays
  misc_feature: Ceres CLONE 1534193
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (831)..(831): n is a, c, t, g, unknown, or other
nnnnnnnnnnnnnnnnnnnnnnnnnnnnnnnnnnnggggnnnnnnnnnnnnttttcctctcttggcaatagtggagctccccgcggtggcggccgctctagaactagtggatcccccgggctgcaggaattcgtctcacccctagaaaaagaaagactaatcgaaccatctagtagctggtaccctccgaagtttccctcaggatagctggagcccacacgagttctatcgggtaaagccaatgattagaggcatcgggggcgcaacgccctcgacctattctcaaactttaaataggtaggacggcgcggctgcttcggtgagccgtgccacggaatcgggagctccaagtgggccatttttggtaagcagaactggcgatgcgggatgaaccgtaagccgggttacggtgccaaactgcatcgctaacctagaacccactaagggtgttggtcgattaagacagcaggacggtggtcatggaagtcaatatccgctaaagagtgtgggaacaactcacctgctgaatcaactaaccccgaaaatggatggcgctaaaacgccgcgaccccacacccggccattttgggtaagcgaaatgccgccgaaggaaaaaacaatccccctctctcttttccgtcggcttgcccgactgttggctctctccccttcccgggttcccggggagcggtcggagaggtttaaggtttttaacaagccgctcatccgccccctccccggaatcccccctaaggtttgccggtccggctggcgccgttccgaccacgtccgagtttcgcgttttttgtaggggtactttagcccctccan

SEQ ID NO: 64476 - DNA, 771 bp, Zea mays
  misc_feature: Ceres CLONE 1534197
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (14)..(14): n is a, c, t, g, unknown, or other
  misc_feature (15)..(15): n is a, c, t, g, unknown, or other
  misc_feature (32)..(32): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
nnnnnnnccccccnnccccccgaaaggggggnggggggttcnnnnncaaaacttgagctccccgcggtggcggccgctctagaactagtggatcccccgggctgcaggaattcgtctcacccctagaaaaaagaagccagtgcagtgatccgtgcctcgatcatcaaccgtagtgagtagcttcagtcagcagtattgctcttccttccccaaatcataccctggacgcgcccaattccatcgatcaaggcactgaatgtgtctggtgaccacacctgcagatcttccactttaccgtgggcagaaaacgaagaagagagtgaagtgactgaagagaagacaccaccacctttggattctcaggcagggacttggctctacttcgacatctgcggatccgagcctgactcacctgtgaacgaagaaaacgaagaagagagtaaagtgactgaagagaagacaccaccacctttggaatctcaggcagggacttggctctacttcgacatctgcggatccgagcctgactcacctgtgaacaaaggtgaggaagcgacaaatttttgttgcttttgctccaaggtggtaccaaatgaagaaaaacaagagtgaaaatgccgggaggacgtggtccctccataagaaccctttgtttgaaaagtttatcccggagggagttttttggcctcccccctgggtatggtagcaaccgatccccgatcggaaaaacccccgaaaggaaccttccccatgggagaaaatgcccccctg

SEQ ID NO: 64477 - DNA, 679 bp, Zea mays
  misc_feature: Ceres CLONE 1534200
  misc_feature: Encodes the peptide sequence at SEQ ID NO. 64478
gctcttaactagtggatcccccgggctgcaggaattcgtctcacccctagaaaaagtgggagcgaggactcgcggccggcggcagcggcaggttctcctatatctccgggtaagcggtgaaagaagaggaggtgttggaggaattagttccgaatctttctccattacgattttcgtggtctcgagcatcctcagttgcaaatggctgacggtgaggacattcagccccttgtttgtgacaatggaactggcatggtccaggctggttttgctggtgacaatgcaccgagggctgttttcccaagcattgtctgacccccccgtcacactggtgtgatggttggcatggggcaaaaggatgcgtatgttggtgacgaggcccagtccaagaggggtatcctgactttgaactaccccatcgaacatgggattgttagcaattgggatgacatggagaagatctggcaccacaccttctataatgaactccgtgtggcgcctgatgagcaccctgtgctgctgacggaagccccactcaaccccaaagctaacagggagaagatgacccaaatcatgtttgagaccttcaatgttcctgccatgtatgtcgccatccaggctgtgctttccctgtacgccagtgggcgtacaactggtattgtgttggactcgggtgatg

SEQ ID NO: 64478 - protein, 114 aa, Zea mays
  misc_feature: Ceres CLONE 1534200
  misc_feature (2)..(114): Pfam Name: Actin Pfam Description: Actin
  misc_feature: SWISSPROT Homolog: EC 2.7.10.2 Non-specific protein-tyrosine kinase
MVGMGQKDAYVGDEAQSKRGILTLNYPIEHGIVSNWDDMEKIWHHTFYNELRVAPDEHPVLLTEAPLNPKANREKMTQIMFETFNVPAMYVAIQAVLSLYASGRTTGIVLDSGD

SEQ ID NO: 64479 - DNA, 675 bp, Zea mays
  misc_feature: Ceres CLONE 1534204
  misc_feature: Encodes the peptide sequence at SEQ ID NO. 64480
aaactggagctccccgcggtggcggccgctctagaactagtggatcccccgggctgcaggaattcgtctcacccctagaaaaaccaatcacaggaatcggctcattcaatctcccgacatatgacattgacatcacgccattcttgggcaagctcctggacggcgaggaacatgatttcgggtttggcgtgacaaatgctcttgatgtgtggtacgttgatgccaatttgcatctgtggctggatcacaagagcgagaagaccactgggggcttgctcagctatgatgcatccggattgaacattaatgtgagctcagaattcactggattagacgggcagtttgtgacaagcgcaagtcggcatgtctctgccaccggatgggtgaaatcgtcgtacggggaggtcaccacaaccttcaatcagagattcagctatgagaacatcaatgtgtttagaaagaacggcactgtgcagatcgtgaaccaaacaatcgatgcgaagtctggcatttttgccaaggatgcttctgccgtgctgctctccgaggaattccatgaggttttcccgttgtacctttatactggaacctcagatcaagcggacgatgagtactcattggattcaattgttaaatttggtatcaatgggaagaagacctccggtgggaaaccgg

SEQ ID NO: 64480 - protein, 224 aa, Zea mays
  misc_feature: Ceres CLONE 1534204
  misc_feature: SWISSPROT Homolog: EC 3.5.1.52 Peptide-N(4)-(N-acetyl-beta-glucosaminyl)asparagine amidase
TGAPRGGGRSRTSGSPGLQEFVSPLEKPITGIGSFNLPTYDIDITPFLGKLLDGEEHDFGFGVTNALDVWYVDANLHLWLDHKSEKTTGGLLSYDASGLNINVSSEFTGLDGQFVTSASRHVSATGWVKSSYGEVTTTFNQRFSYENINVFRKNGTVQIVNQTIDAKSGIFAKDASAVLLSEEFHEVFPLYLYTGTSDQADDEYSLDSIVKFGINGKKTSGGKP

SEQ ID NO: 64481 - DNA, 850 bp, Zea mays
  misc_feature: Ceres CLONE 1534207
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
nnnnnnnnnnnnnnnnnnnnnnnnnnnnnngggggggaggggnnnacaaactggcacaccccacggtggcggccgctctataactagtggatcccccgggctgcaggaattcgtctcacccctagaaaaagcatctgcacctccctggctcagatcctgcgagcgtcttccatctggccatgtatgggcacgtccctgcccagcagggcgatggtgctaacccggcctggtttcgtgctccatctcgcctgcccttgctgcgtcgtcgtgctcctctacctccgcagtggctacaagttcccttcaacatccatatttacacctccttcccgaatgcccatctcataccataagctgattggggcgagtgctcgcctttcccaagtcaaaaacagaggacctacattgatatatgctccatggatgaatgctgcgatgacttcaactcagatctccgtcatactttctttccaccaatgttgctagtagactaacgccatgtctctccttccgaggcttgcatatgcttatgccttgtatgaaactcttgcgatggttttgtggatgagaaggcgttggttacttgattatcttacattcctcctgaatcctccccattggcccccatgtgaccacaaatttctcccatttggattaaaaaacttattataatggtggaatccaccgtaccctggctgattaacacaagcctcacttgccttgcggaaaaaccacatggaggtaaaattcaacctttaatgtgccattttgctggccatatggcaccctttttcgcccaattccggggatttagggagacctaaaaagccctcccccattccgaattaac

SEQ ID NO: 64482 - DNA, 803 bp, Zea mays
  misc_feature: Ceres CLONE 1534210
  misc_feature: Translation starting site: 244
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (48)..(48): n is a, c, t, g, unknown, or other
tttttttttnnnnnttnnnnntnttttnngcnncngggggggtacttnttcatatctggtgctccccgcggtggcggccgctctagaactagtggatcccccgggctgccggaattcgtctcacccctagaaaaaacaccacgcgcgccgcaaagcagagcacgggggcctgagagcagagcgccatctgccatcctttgcctgcccaagcagcaagcagcagcagcagcggcggctggcccgatggctctgtctctctccggcacctacgcccgcttcgccctcgcgtcgatggtcccccgggccagggcctacgcggcgtcggcggcctctggcgccctgaagcgcgcggcgtagggcgcgccctcctgcgatgcctacgaggcctgggctcgccgccgacgccgctgccgagggctcttgggtgcccgaccccgtctcgggccactaccgccccgccaactggggccgccgacgtggaccccgactacctccgctccgctcagctcggccgcacctacgcgcgggcctgagagctgctcgctcctttcgccctgctgctccgtcgagtcctagtaatttaacgccccgctccttaatcggtcgacacggaggcgacgggtcgggctttcccgagcccaaacggagccgatgcacccaatgctccttggccgacctgggccctgggaagccccggcatcaaggttggcgaacaataaggcataaacggtactttctattttttctcgcatggcgaggaaagttgggtgaaatacagatagtaaccccgtgtcacgctttcc

SEQ ID NO: 64483 - DNA, 791 bp, Zea mays
  misc_feature: Ceres CLONE 1534218
  misc_feature: Encodes the peptide sequence at SEQ ID NO. 64484
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (43)..(43): n is a, c, t, g, unknown, or other
nnnnnnnnnnnnnnnnnnnnnnnnnnnnnnnnnaaaaacaagnggggtacctggagctccccgcggtggcggccgctctagaactagtggatcccccgggctgcaggaattcgtctcagccctagaaaaatcccagctcaaagccagcggatctgggctccaggcagggtcgcgaccgagtgtgctattgagtatcacgacaacaacggtggtgttccctgaaggccgcgaagcccatcggagttgcggcgcatggctaggagccggcgcccaatctcagcgagacggagacgaagccgtcagccgggaagagcggcggcggtaagagggctgagcagaagccccgggaaaccaagaggaaggtgaagagcatcatactggcggcggcggccaaaaagagactgacagtacgtgtggagtgtaatggaacttccatgcatgactgaatccctgccatgttatgaatcaaggccatcctttcttgtatcttccatgttatgccgggtgtgaggcccctcgtgagtgatggtgcaagaggactactacttgtaagagcgggtggtgactgtgtgcataacaagataaattatcgagacgctcgatgcacccaattcgcactagagtgattcttattacaaaccatgcaaaggtcgtccgttttccaaggttggagacctgggaaaaaaccttgtcggtaacgagacctttaaaacgccgtgtccgagcaaatcccccccttttcttccaatcctgggaaggtattaaggcccaagaaagggccccctcaccgg

SEQ ID NO: 64484 - protein, 37 aa, Zea mays
  misc_feature: Ceres CLONE 1534218
MARSRRPISARRRRSRQPGRAAAVRGLSRSPGKPRGR

SEQ ID NO: 64485 - DNA, 852 bp, Zea mays
  misc_feature: Ceres CLONE 1534219
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (33)..(33): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (852)..(852): n is a, c, t, g, unknown, or other
nggggnnnnnnnnnnnnnnnnnngggggaaggngnannaccccagacgccaaaaacaagaacaaaacaggagccggccccgcaggcctaggaaatccgccggaaaaaaagaattcgaatcacccctagaaaaacccgtccaaacacggacagaggaacagggactagggcaaggcaagagagaggcgtcgtcgtttgatctgctgccggagtgcgaagaggaagaggaagaggagcgccggagttgtaaagatgttcctggtggactggttctatggggagctggcatcacataaactgcagctgaaagaggctaaaatcctcttcctagtcctagaaaacgcaagctagaccaccctcctccacatgctgtaatgaccaacggctcttacaggacctgcctaccacttaacccacttcagtaaaaatgaagcatcaaggatgatccaagtttcacagctttcacaccttaaacagccaaccaaatcaacccctcccctcgtctcggaatattactatttctcccctactggtgtgattgctaatttgagattcttagaatgtctttcataattttacgtattataactgtgcatcaccaagatcacaaataacaaaatcgtatgacactccttatcctaacagaataaactcacattattaatctcttatcattttttttattttctgtgttgttttcttgggtgcaacaggcccgtggatgtttttcttcatatatatattattctttatcttatttatctttttttttttttaatattttttctgtatctttttaatatttcaatgtttaatctttgttatcatactctcaattttcccacgaatcccn

SEQ ID NO: 64486 - DNA, 732 bp, Zea mays
  misc_feature: Ceres CLONE 1534227
  misc_feature: Translation starting site: 204
  misc_feature (682)..(682): n is a, c, t, g, unknown, or other
ccccgcggtggcggccgctctagaactagtggatcccccgggctgcaggaattcgtctcacccctagaaaaagactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccttaccagactacaacatccaaaaggagagcaccctccaccttgtgctccgtctccgtggtggtcagtaagtcctggggcgtttaagctgccgatgtgcctgcttctcccggtgccctctccatatggacggtgtccaagtttctgctgtccatgtgcagaggcgggcggtggtttctctaccaattgcaccccccggccctccgtgggtcttactaccgccgaccctcgcccgggcccgggcgaccgtttcgctgtttgcgatatgaaacgctggtttcccgtttaaatctaaacataaacctatacccctgttgattccctcccaggcctctgtgtgttgctccccatgcccccctttcgcccccgtctcgacatctttcttcccgccggtacgggctaaatccccgccccctctcgctgtgcttatttccttgtgctccccttccccccttttgtcttgttggatnaatttccccaccagcccgcgtcctgttcccccgcgccctccgctcgcctg

SEQ ID NO: 64487 - DNA, 945 bp, Zea mays
  misc_feature: Ceres CLONE 1534233
  misc_feature: Encodes the peptide sequence at SEQ ID NO. 64488
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (281)..(281): n is a, c, t, g, unknown, or other
  misc_feature (291)..(291): n is a, c, t, g, unknown, or other
nnnnnnnnnngggggggnnnnannnnnnnnnnnnccaccnnnnnccaaactgggactccaccgcggtggcggccgctctagaactagtggatcccccgggctgcaggaattcgtctcacccctagaaaaaagtccatcaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggaaccggcgnccaagctcancgagacggcgaccaagccgtgcagccccaagagctgcggcgttaataatgctccccccgaagccccgagaaaaccaaaggggagggggaatttgtggtcaacagggtcctgggtcgcccaaaacaattactttttttttcccccccccccccggggggggggggggggggtaatttcactcgcccacccctttccttgggtttcgtgtgccttccgccctgttggaaataaaagagggaggatttttcctgatgggtgacctgcgggtgggttatcctactacacaccggaaggattccatttatatagatgctgggggtgggatggtgcccgggctggggcgggctgggaatatggggtgcctcggcgagcgccccggatagcgaaagccgccgaaagtgggtgcgaccacgcggggggggagggagtggagggggtggcgcgtctctgggggccgtaaaatcttagtgttgaagtgtggtggtcgttatccgcaacgcggcgagtccggcctgtcctttcgtgcctcccgggtcagtcacctcgtctctctgcgcgggtgcgtacaagtgttggatcagcatacggtgccgccgtcgggcacaccgcccccggccccactgcgcgcggcggcgactcggccgccacccagcc

SEQ ID NO: 64488 - protein, 109 aa, Zea mays
  misc_feature: Ceres CLONE 1534233
  misc_feature (21)..(21): Xaa is any aa, unknown, or other
  misc_feature (24)..(24): Xaa is any aa, unknown, or other
MASLKAAKPSGVAAQGKEPAXKLXETATKPCSPKSCGVNNAPPEAPRKPKGRGNLWSTGSWVAQNNYFFFPPPPRGGGGGVISLAHPFPWVSCAFRPVGNKRGRIFPDG

SEQ ID NO: 64489 - DNA, 817 bp, Zea mays
  misc_feature: Ceres CLONE 1534241
  misc_feature: Encodes the peptide sequence at SEQ ID NO. 64490
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
nnnnnnnnnnnnnnnnnnnnnnnnnnnnnnnnnnnaaaagggggaaaaagtggagctcaccgcgggggcggccgctctagaactagtggatcccccgggctgcaagaattcgtctcacccctagaaaaacggcaagcaagcaagcaagcacttggcctctcaaccaacggggcgcgcacacgcacactgccaacgaggcaccaagaaggcaggaagggatggagtactgctaccagtacaacagcgtcagcaacgcggagaaggagaagaggccgccgctgaggaggggcggcgtcaagctccagatcgtgaagaccctcagcaacctcgtcgtggcgcccagcaacggcagcgactccaagcaagcggaccgcaacagcttcacaagggagcgaagctacaactgaaacgaactgtatcttcagtatttggatacagatgtcgaccttgtgtctgaaagaactccgctttgggactcgagaggttttcttagcttgttggacttccctggaaaaagaaaaaacgaccacgctccgaggtaacccatttcgccctataatgagttcatattacccgcgactcactgacccggacctttatacaacgtctctgacttgggagaaacccctgacagttaccccctaacttaaatccgcctttaaaaacacaatcccaccctttccgcccaagctgagcggtgattaatccaacacaaggcacccgccacctgattcaccacctattcccccaacagatttggcggccaactaccttgaaatggggccaaatatgggaaaaatttgggtaaaaccatatg

SEQ ID NO: 64490 - protein, 62 aa, Zea mays; identical to SEQ ID NO: 59189
  misc_feature: Ceres CLONE 1534241

SEQ ID NO: 64491 - DNA, 731 bp, Zea mays
  misc_feature: Ceres CLONE 1534251
  misc_feature: Encodes the peptide sequence at SEQ ID NO. 64492
agagctggagctccccgcggtggcggccgctctagaactagtggatcccccgggctgcaggaattcgtctcacccctagaaaaagtacatttaggcttccattgttccatcaactagtagctacatgtcctcctactctcctagtaaagtaccagtgtttgtttgtgtaatgtttgttacgcccattaaattcttcttggattggatgaactacaagcaaagacattccctggatgcagtacaatgataacagcagccagtaggcaaacacattccagatggaagcaaagagattatttgccttttccataatgtactactaccaactagccatacataaacaacaaaaaaaaaagaaaaaaaaaaaaaaaaacgagacgctccaggtacccaattcgccctatagtgagtcgtattacccccgctcactggccgtcgttttacaactcgtgactgggaaaaccctggcgttacccaactttatccccttgcaagaaatccccctttcgccagctggcgtaatatccaaaaggcccccacccaccgcccttcccaaaagttgcgcagccttgaaaggggaaatggaaaattgtaacccttaaaatttttggttaaaatccccgttaaatttttgggtaaaaccccctcgttttttttaacccaaaaggcccaaattctgaaaaatccccttattaattccaaaaaaataaaacccgaaaaatgggttggag

SEQ ID NO: 64492 - protein, 40 aa, Zea mays
  misc_feature: Ceres CLONE 1534251
MSSYSPSKVPVFVCVMFVTPIKFFLDWMNYKQRHSLDAVQ

SEQ ID NO: 64493 - DNA, 858 bp, Zea mays
  misc_feature: Ceres CLONE 1534254
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (43)..(43): n is a, c, t, g, unknown, or other
  misc_feature (825)..(825): n is a, c, t, g, unknown, or other
nnnnnnnnnnnnnnnnngggggtttgttnnnnggggaacacanacaaaactggactccccgcggtggcggccgctctagaactagtggatcccccgggctgcaggaattcgtctcacccctagaaaaaagtattggacgggttgacttggtttgggttgggtgtggagttgaattgtttcaagttgatggcttggtaaatggacaattatgcggatagatgtacgggagcgatctggatttgtgcagccagctgtaacatatcataacttatgtgcttggtttgactgcacaaaagactgctaaaaaacgagacgctcgaggtacccaattcgccctatattaactcgtatttccccgcgctcactggccgtctgttttccaacacctaggactgggataacccttggtgttacctcaaatttaatctttcttgcagcatatccctccttttcgccagttggctgtaataagcgaaaaaggccctgcacctgatcgccctttcccaaacagttgccgcaggcctgtaatggcttaatggaaaattgttaaccgtttaatattttttgttaataatttgggattaactcccctcgttcaacccccctcctttttttttttacctattaatttcaaaattccggtaaaaatcgcgtgtctcgactctatctcatttatcactgaaatataggggtatgaatgctagcttccacatttaagaacccttgaattccccctcattcaaacgaacctgcggtactccccaccgccccccgagggccgaaaataacctcttctattccagggggggtaagggcccccctttngtggaaaccctttatctccttgattcaatgttt

SEQ ID NO: 64494 - DNA, 731 bp, Zea mays
  misc_feature: Ceres CLONE 1534264
aaagctggagctccccgcggtggcggccgctctagaactagtggatcccccgggctgcaggaattcgtctcacccctagaaaaatctatccaacatccagtagtgcagccagctctatttccctgcccatcgctcatatcgatcaactggtccggctggtcgcgacatcgttatctccacggagagttttccccgctggagagatgccctaaatctcttgacctgaagtgctcagtttgaacttcaaataccccttccatgtgatcctcaaggacaagccggacgccgacatcgtggtgctgcccgtcggctccgtggtgaccgcggattatcgccctaaccgtgtccgcatcttcgtcgacctcttcacccacacgccccccctcggctggaggggtataacctcgccccctatttcctttccttgccccagaacttggaataaaaatacttgccattaaccatctggtgccctgccaaaaaatgcctgctttattcctcaccaattaagtgatgcaaggcccaaccgttttcaaatgcccccccttcttggtacaaaaatagaaaaaagccaattccctccagtttccctttttcccccctatcccgtttcttttttcccaaacaccccccctgggtctttttttttaacggggccaaaactcgcaaaacccgcgggctttatccaaccttaaaacccccctagcatacccttccccaccgtccccccc

SEQ ID NO: 64495 - DNA, 698 bp, Zea mays
  misc_feature: Ceres CLONE 1534265
  misc_feature: Encodes the peptide sequence at SEQ ID NO. 64496
  misc_feature (79)..(79): n is a, c, t, g, unknown, or other
  misc_feature (200)..(200): n is a, c, t, g, unknown, or other
  misc_feature (209)..(209): n is a, c, t, g, unknown, or other
  misc_feature (367)..(367): n is a, c, t, g, unknown, or other
  misc_feature (400)..(400): n is a, c, t, g, unknown, or other
  misc_feature (411)..(411): n is a, c, t, g, unknown, or other
  misc_feature (412)..(412): n is a, c, t, g, unknown, or other
  misc_feature (472)..(472): n is a, c, t, g, unknown, or other
  misc_feature (573)..(573): n is a, c, t, g, unknown, or other
  misc_feature (607)..(607): n is a, c, t, g, unknown, or other
  misc_feature (633)..(633): n is a, c, t, g, unknown, or other
  misc_feature (634)..(634): n is a, c, t, g, unknown, or other
  misc_feature (649)..(649): n is a, c, t, g, unknown, or other
  misc_feature (650)..(650): n is a, c, t, g, unknown, or other
aaaagctggagctccccgcggtggcggccgctctagaatagtggatcccccgggctgcaggaattcgtctcacccctanaaaaatctcgcgccgccacttccctcccgacccactcgcccaaaaccgtagcgccctcgcctgctcgccgccgccgtcgttgcaagctccccatcttcctccggtaaccatggcgacccanatcagcaanaagaagaagttcctcagccacggcgtgttctacgccgagctcaatgagatgctgacgcgggagctcgcggaaggaggctactccggcggggaggtgcgtgtctccccgatgctctttgagcccagcagccgcgcaaggggcacccaaattttttttcnccccctcggggggggaggagggggggctccccntccgtcctccnnaagatgtttctctttccccaaaaacggcgtggagcgctccgcccggggggggcgttaacnagcacgcctctgccgccactcgcgctggggtaaagtcctcccccctacaacgtaccacgtaaaaattttgcccacccttcgaggcctgcgcgccacgccgntcttctcctttgttctcgacatcagtcattgcgnatggcgtcgcaccgccctactcggcnntcacgcgacccgccnnagcgcccatcagatcggcgtgcagccttccacgacactcatagtttct

SEQ ID NO: 64496 - protein, 93 aa, Zea mays
  misc_feature: Ceres CLONE 1534265
  misc_feature (4)..(4): Xaa is any aa, unknown, or other
  misc_feature (7)..(7): Xaa is any aa, unknown, or other
  misc_feature (60)..(60): Xaa is any aa, unknown, or other
  misc_feature (71)..(71): Xaa is any aa, unknown, or other
  misc_feature (75)..(75): Xaa is any aa, unknown, or other
MATXISXKKKFLSHGVFYAELNEMLTRELAEGGYSGGEVRVSPMLFEPSSRARGTQIFFXPLGGGGGGAPXPSSXRCFSFPKNGVERSARGGR

SEQ ID NO: 64497 - DNA, 928 bp, Zea mays
  misc_feature: Ceres CLONE 1534267
  misc_feature (16)..(16): n is a, c, t, g, unknown, or other
  misc_feature (22)..(22): n is a, c, t, g, unknown, or other
  misc_feature (26)..(26): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (515)..(515): n is a, c, t, g, unknown, or other
  misc_feature (919)..(919): n is a, c, t, g, unknown, or other
  misc_feature (928)..(928): n is a, c, t, g, unknown, or other
ccgcaccgggacgcgnggcggncgcnacnnnnnnnntnttgtttttttttcaaaactggagctccccgcggtggcggccgctctagactagtggatcccccgggctgcaggaattcgtctcacccctagaaaaattccttcctcctcatccaggcagcacagctccctccccactcgaggctccgagctttattttttcttgttttgttttgttttcttggaaggagtaacaatagtttctggcagccttcttcctcctcgctctctacccgaggagagaggagaggagagaaatccggaagcaaaccttctggggttgtataatgggattcaagatctaatcgactacccccagagaaaaaaaaaagataagcccgggcgctccagggacgcgaattagtccttaattgtgtagttttattatgccacccttcacttggaccgcctggtgttagtgacgtctttagtctggaaatatacacttgggcggtatacccaaacacaatgacaaacangcacactacaaaccccccttttttgactcacattgtggttgataatatgtgaataaaatcatcctaaatcccgtattgtcctccatatcccatcccacgtccaccccccacccccctgtcaatggacacaaaatggatctaaccgcggtaaaatctccctccactccccctcaggcccctcaaattcccacccctcctaaattagctgctacctatcacaccccccatctctcttatttctaccacactcacccccatacacacgaacaatcgagaagctaacactctcccacatccacacaccccaccaaccccacagctatctctctcacttcagactcacaagagccttccgacccgctccgcgccctcccgcgctgcctcacggcgacgagcttcaatcngccccggcn

SEQ ID NO: 64498 - DNA, 947 bp, Zea mays
  misc_feature: Ceres CLONE 1534273
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (26)..(26): n is a, c, t, g, unknown, or other
  misc_feature (44)..(44): n is a, c, t, g, unknown, or other
  misc_feature (45)..(45): n is a, c, t, g, unknown, or other
  misc_feature (623)..(623): n is a, c, t, g, unknown, or other
  misc_feature (851)..(851): n is a, c, t, g, unknown, or other
  misc_feature (852)..(852): n is a, c, t, g, unknown, or other
nnnnnnnnnnnnnnnnnttttggttnttttttgggggggggccnnccaatctgggactcaccgcggtggcggccgctctagactagtggatcccccgggctgcaggaattcgtctcacccctagaaaaaggttatctaaaacgcacgcatgctctattatagctagtcatcactatatatatacttgtgtttgtgtattgttgttcttgttctgctggtgtctccgccgtttaatttgacctacgtaatggagtgagtgatttctgcgacctccctcctatgctctagactggagtcacgcgtgggcctgttgtaccaccggccctctttgtctcctacgcctgttggtgccatcgccttcctgaatggctcttcgcgtcccgcccattataaacattccaatcgccaacacttttttttcttttctccacccccccaaggggggggggggggtgttcacccctccattctccgggctcgcccccgtctgcactcttgccttaaaaaaacaaaaaaacccccgagacgcggtgcccgagtcttctttccgttcttttgcctaaccctccctactccctctttaactcttcaaaaccagcatcttctgacctccgggcacagtntttcctggtctccgtcccattctcccgcttcatctcctaggcggcttcgttgcgcggaccttggccagccgccccctactggcgcgggttgagtgaacacgactggtaaatgcactctcactgcccccctcttaccacccctccgtcggcatccaccttatcgccttgtggtattcttctttgctgtctctcttcttttgcgcgctctcgccgccccccgcgcgaggnnggaggagtgcgctcgcccctcctctcgttgttgttctattcttgtccttcccccccctgttcgacccgccttccccctcctccgctatacaccac

SEQ ID NO: 64499 - DNA, 665 bp, Zea mays
  misc_feature: Ceres CLONE 1534275
  misc_feature: Encodes the peptide sequence at SEQ ID NO. 64500
  misc_feature (665)..(665): n is a, c, t, g, unknown, or other
aaagctggagctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccatagcatatggtacggccctgatcgccccaagtatcttggcccgttctccgagcagacgccgtcgtacctgaccggcgagttccccggcgactacgggtgggagaccgcgggcctctcggccgacccggagacattcgcgcgccacctggaactggaggtgatcccccccccggggggggatgctgggcgcgctgggctgcctgttccccgagaatccggcccaagaacggccgtcaagttccggcaaaggcggggtaggttctaaggccggcccccgcaaatcttcctcggaaggccggccctggacctacccggggaaacccccaaccctggggggaccgcccatagaattatcctggatctctttttgggacagtgccn

SEQ ID NO: 64500 - protein, 128 aa, Zea mays
  misc_feature: Ceres CLONE 1534275
MAASALHQTTSFLGQALVSRAAGVDAGGRITMRRTVKSVPHSIWYGPDRPKYLGPFSEQTPSYLTGEFPGDYGWETAGLSADPETFARHLELEVIPPPGGDAGRAGLPVPRESGPRTAVKFRQRRGRF

SEQ ID NO: 64501 - DNA, 675 bp, Zea mays
  misc_feature: Ceres CLONE 1534278
  misc_feature: Encodes the peptide sequence at SEQ ID NO. 64502
  misc_feature (396)..(396): n is a, c, t, g, unknown, or other
  misc_feature (402)..(402): n is a, c, t, g, unknown, or other
aaccctggagctccccgcggtggcggccgctctagaactagtggatcccccgggctgcaggaattcgtctcacccctagaaaaaaataatcgtcaccgcccgccactggcgtccattcacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaatagctatcttccgctctaccgggggggcgggggctgtnaactanccagtgttgcctccatgcttttattaagattctgaagaagggtgacgttgggagaaaattggccataccgtgtcggaaccccaagaatccttgcaccattggctatgctaacgaacgaaccccttaaccttattataaagggcaagagtcggcgcggaccgggggccccctgcccggctataagcgcgagactaacacccccgggaggcggacacccctctccatttgcacgccccgccaagtgggtcgcacgccctccttttgccccatgag

SEQ ID NO: 64502 - protein, 51 aa, Zea mays; identical to SEQ ID NO: 2355
  misc_feature: Ceres CLONE 1534278
  misc_feature (9)..(51): Pfam Name: Ribosomal_L39 Pfam Description: Ribosomal L39 protein

SEQ ID NO: 64503 - DNA, 613 bp, Zea mays
  misc_feature: Ceres CLONE 1534284
  misc_feature: Encodes the peptide sequence at SEQ ID NO. 64504
ggatcccccgggctgcaggaattccccccacccctagaaaaagaaggcactagcacgcaaaaaccccagcgagagagacgaatcttccgaatctctcggtggcgatggcgctctccgaccgctcccgcgagtcgctcctcccgagcttcctctacgcctcctcggcgcgctctttcgctgccgcaaagagccgccgcgcgcctccctgtctcctccccagcagcctgccacgggtggagcaagaggcggcgtgccgttctcgatccatgggcccaaggagaagatcgagatgtactcgccggccttctatgccgcctgcactgccggaggaatcgccagctgcgggctcacccacttggccgtcacgcctctcaacgctcgcaagtgctgtatgcagattgacccagcgaaatacgacagtatctcatctggagttgggatccctgttaaaggaccaaggggccgggggccttcttcaggggatgggtgccacctttgcttggatccggtgcccaagggggccgccatggttgggcttctttgacctcggtgaaaaatgatgagcgcgaaaaatggcggggcctgggcactggccaaaagcaaaaaaaaggct

SEQ ID NO: 64504 - protein, 84 aa, Zea mays
  misc_feature: Ceres CLONE 1534284
MYSPAFYAACTAGGIASCGLTHLAVTPLNARKCCMQIDPAKYDSISSGVGIPVKGPRGRGPSSGDGCHLCLDPVPKGAAMVGLL

SEQ ID NO: 64505 - DNA, 644 bp, Zea mays
  misc_feature: Ceres CLONE 1534298
  misc_feature: Encodes the peptide sequence at SEQ ID NO. 64506
acagctggagctcaccgcggtggcggccgctctagaactagtggatcccccgggctgcaggaattcgtctcacccctagaaaaaaattcacaacaaaaccctagctactgcttcgcccgccgaattccccctccgctcgcttcgcacgccgcccgtcgccgcggcggcgtctgctattgtccctcccgctgcaaggagcacatgcttctcgccgcgccgttagcccgccgccgccaccaccggttcaccttcagctatgtcttctcaggtcgacaggcgcagccagtccgccgggaagcgcgcgcgcaccgacggcagccggcgtgaggacgactgggtttgccccagctgcaagaacgtcaacttcgccttccgcaccacttgcaacatgcgcagctgcaaccagtccaggccagcagatcacacggccatgcagaccccgcctcactatcccatgtcagggggttacatgggccccggggacgccaccatcgatgtaccttggtgggggcgctcccccatatggatcctcaatgtttaaagggcctgcggtgaccccctatgggattccgcaatttcctgggggttcctggtattcctagggaaaaggggggcccctaccaatggggagccccctacgggcc

SEQ ID NO: 64506 - protein, 94 aa, Zea mays
  misc_feature: Ceres CLONE 1534298
MSSQVDRRSQSAGKRARTDGSRREDDWVCPSCKNVNFAFRTTCNMRSCNQSRPADHTAMQTPPHYPMSGGYMGPGDATIDVPWWGRSPIWILNV

SEQ ID NO: 64507 - DNA, 698 bp, Zea mays
  misc_feature: Ceres CLONE 1534304
  misc_feature: Encodes the peptide sequence at SEQ ID NO. 64508
  misc_feature (248)..(248): n is a, c, t, g, unknown, or other
aaacctggagctcaccgcggtggcggccgctctagaactagtggatcccccgggctgcaggaattcgtctcacccctagaaaaagctcccatttcaaaacctcttcctcctctcctcgccgcagctcccaccattcccgcagacgccttgtccccttcccagcttcccctccccaccccgccgcacgtccgcaagccccacgccaccgtcatgtctccgaccaccaccccgccgcccgcgcccgtggnagccccgacctccaagggcgccaagcgcagcctcatgtcctcgctcatgggacgccactgcgctgctccgctcctcctctttcaaggaggactcgtacgtcgcggccgcgctcccggcgtccgacctccgggggggggggggggtcaaggctctgctccccaccccaccggaaccccatctccatctggggggggccccgctgaaccctcggtcccgtcccgaccccggaggaaaaaccccgcccccgggcccaacgagacggaccggaagtaggaggttccccaagatccctccggggcgccgacgacttcccatcggagcgccaataggcccccgaccccggggggctccgcgcgtgtcgcacccggggctcctgtcgaaaattctgtcccccgtaacacccggggggtgaacgagggccaacgggcgaccttcgaaggaactgtggg

SEQ ID NO: 64508 - protein, 79 aa, Zea mays
  misc_feature: Ceres CLONE 1534304
MSSLMGRHCAAPLLLFQGGLVRRGRAPGVRPPGGGGGQGSAPHPTGTPSPSGGGPAEPSVPSRPRRKNPAPGPNETDRK

SEQ ID NO: 64509 - DNA, 640 bp, Zea mays
  misc_feature: Ceres CLONE 1534308
  misc_feature: Encodes the peptide sequence at SEQ ID NO. 64510
  misc_feature (640)..(640): n is a, c, t, g, unknown, or other
aaagctggagctccccgcggtggcggccgctctagaactagtggatcccccgggctgcaggaattcgtctcacccctagaaaaaaagcagacgtccccatggccatggcttccaccgccaccgctgctgcttctctccgcctcgccttccctctcctctcctcgccggcttcctcctcctcgtcctctaatatccttcgcttccctctccgccgccgcagcgccgcccgccccatcgccgtcgccgccttcaagaagctctccgaggcgtcccccgtgcccatccctcatgagcccaccgagcccctcctggtcgacgaggacgctctgccccccaaggccggggtctacggcgtctacgaccccgccggcgagctgcagttcgtcgggatttcgcgcaacgtcagggccagcgtcgagggccaccgccggaatgtcccgccaacctctgcgcctgcgtcgaggtcgcagtatcagacgcagagacaccagatcgatctgccccttaaaaagcctggaaatcatggatgtcagaacacatagcggccaccggcaaggcgccaccagggatgttgcaggataccacacctgggttggtggcccccagcggcctccagacctgcggctgacgcccggacgcn

SEQ ID NO: 64510 - protein, 145 aa, Zea mays
  misc_feature: Ceres CLONE 1534308
MASTATAAASLRLAFPLLSSPASSSSSSNILRFPLRRRSAARPIAVAAFKKLSEASPVPIPHEPTEPLLVDEDALPPKAGVYGVYDPAGELQFVGISRNVRASVEGHRRNVPPTSAPASRSQYQTQRHQIDLPLKKPGNHGCQNT

SEQ ID NO: 64511 - DNA, 780 bp, Zea mays
  misc_feature: Ceres CLONE 1534319
  misc_feature: SWISSPROT Homolog: EC 3.2.1.23 Beta-galactosidase
  misc_feature (780)..(780): n is a, c, t, g, unknown, or other
ctgaactagtggatcccccgggctgcaggaattcgtctcacccctagaaaaaaccgtcatatttggtttttttgcaactaagtcttgttcgcagttgcagactacatatgcctgtattgagatcctggttgccaaattaaccatcttgaactggcattattccactttgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagagggccgcccccgatcgccctttcccaatttttcccccacccctgaatggacgaatggaaaattgtaagccgttaataattttggtaaaagatccggggtaaaattttttggttaaaatccgccgcattttgttttaacccaaagaggcccgaaatcgcgcgcaaaatcccccgtgataaatccaaagaagaatgagacccggatatcgggggttggagtggttgctttccagattggggaaaacaaaattcccccctttttaaaaaaaacgtggtgactccgatcgcttcaaaggggaaaaaagaccggtcttttcgggggggaatgggcgcgcgtaagcgggaaacaatccccccctaacgcaaggtctgtttggggaggaaggggggccacaaaaactctcaaaaacgggacacccggaaagggatctccccn

SEQ ID NO: 64512 - DNA, 959 bp, Zea mays
  misc_feature: Ceres CLONE 1534322
  misc_feature: Encodes the peptide sequence at SEQ ID NO. 64513
  misc_feature (1)..(1): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (788)..(788): n is a, c, t, g, unknown, or other
  misc_feature (816)..(816): n is a, c, t, g, unknown, or other
ntcttggggggggggtggtgtgtttggccacaacgctnnnnnnnntaccgctgagctccacgtcggtggcggccgctctataactagtggatcccccgggctgcaggaattcgtctcacccctagaaaaaatccatccagactgcgatcagagcagcgagagagagagagagagagagagcaactgagcaagcaagcaaggaagcaagcaagcaatcggagcgatggagcacgggtacccctgcaacggctgcggcaaggagaagcggccgccgctcaagaggggccagctcaagctgcagatcgccaggaccctgctcggcagcctcgcggcgccggtcgccaagaaccgggaccgtgccttcgggagataggccgcccgtgccgtggtagccaggagtagaagtagtagcctagctgaggacgtgccggcggtccgagtggccggcggacttgtgcccgtcccccacccaactggatggagctttttggtgtctctcctccctcctaccttctttctgtgtgaaaaaagaaggcgtggtggggccgtcctcggcgagatggaaccccgactgaatattaagtctgtaggatacgtggacacgaaccaccgaaagacccgcctgcggagggtgcagccccccactttccgcgccccgtaatgagggggcaggccccgatatttagaccgcgctgcgctgccactagagggctgcggtgtgtttattcacaatgcactgctcgtgggcgcggggggagaaaagaccctactgggggtgtttaccgccnaaatcttgaaaggcgcgccgtagggagngacaacaagtccgccgtctattttgccgtctcgcgggagaggtgtatctacgcacgtcgaagaagtgggcgcgctggcccggtagcgggactcccaccgtgagaggtgtggcgccgccggcctcggagacgtggtcatgcggg

SEQ ID NO: 64513 - protein, 49 aa, Zea mays
  misc_feature: Ceres CLONE 1534322
MEHGYPCNGCGKEKRPPLKRGQLKLQIARTLLGSLAAPVAKNRDRAFGR

SEQ ID NO: 64514 - DNA, 797 bp, Zea mays
  misc_feature: Ceres CLONE 1534338
  misc_feature: Encodes the peptide sequence at SEQ ID NO. 64515
  misc_feature (20)..(20): n is a, c, t, g, unknown, or other
  misc_feature (31)..(31): n is a, c, t, g, unknown, or other
  misc_feature (695)..(695): n is a, c, t, g, unknown, or other
  misc_feature (713)..(713): n is a, c, t, g, unknown, or other
  misc_feature (716)..(716): n is a, c, t, g, unknown, or other
  misc_feature (717)..(717): n is a, c, t, g, unknown, or other
  misc_feature (797)..(797): n is a, c, t, g, unknown, or other
tgggggttgtgtatgccttnacttttactgngcgcccccgttaataatggagctccaccgcggtggcggccgctctttactagtggatccccgggctgcaggattcgtctccccctagaaaaatcaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacggaagccgttcagcccgcgaaaagagccggcggcgtttagaaggctgagcagaagccccccgggaaacccaaagggaatgggaaagagccgccaaacaaggggggcgggcggggccccaaaaaaggggacctaacaggaccgggggggggaggggaaatgggacctttccccctggggcgggagagggaaaacccccccccccccccctgggtgttttattaaaaaattctttagagggcccccctccccccctatcttgtttgttggggagggggatgtcgcctccccaccctcaggaagtgaggagagagcagccgaagtggcatggcgggggggaggcggagaggcatccccccacgtgactgtacgaaaacgaagagatggtggatggcgcggcagcgganccagttgcgtcgggtttngtnntttttggtgtgtggggggtgtcgcgcgtggcactacaaataaaaattttgtgggcggtttttggtagaaaaagaaaaaan

SEQ ID NO: 64515 - protein, 40 aa, Zea mays
  misc_feature: Ceres CLONE 1534338
MASLKAAKPSGVAAQGKEPAPKLSETATEAVQPAKRAGGV

SEQ ID NO: 64516 - DNA, 674 bp, Zea mays
  misc_feature: Ceres CLONE 1534339
ggatcccccgggctgcaggaattcgtctcacccctagaaaaacaagcccctggtgcacgttctagtcatcccaaaagcgagagatgggctaaccggattagacaaggctgagccaaggcatacagaaatcctgggccggcttctttacgcagcgaaagtagtggcagagaaggaaggtgtagcgagtgggtaccgtgttgtcatcaacaatggagctgaaggatgccaatctgtctatcatctgcacctgcatgtacttggtggaaggcagatgaagtggccccctggttaaaattactaagggtgacatgtttgatttcttgtacccctctctctgtgagttgagtttgctgcttgtatgactgttgttgcaaagggagaaagagtggtttggtgtactagtatctgcccctgggatgatggcccctttgagcactcctctctggaatttctggagcttatgcagcattttgctaaagaaaaaaaaacttgtgccagtaaattctctgaaaattttaacagggttttaaaatttccttggccaaaaataaaatttcaaaaaaaaaaaataaccaaaaccttcgaagtaccccatatccccccatatggggagccggatttactccccgctcccctggcccggcttttttacaaacgctttgacactgggaaaa

SEQ ID NO: 64517 - DNA, 622 bp, Zea mays
  misc_feature: Ceres CLONE 1534349
  misc_feature: Encodes the peptide sequence at SEQ ID NO. 64518
  misc_feature (1)..(1): n is a, c, t, g, unknown, or other
  misc_feature (18)..(18): n is a, c, t, g, unknown, or other
  misc_feature (389)..(389): n is a, c, t, g, unknown, or other
  misc_feature (391)..(391): n is a, c, t, g, unknown, or other
  misc_feature (394)..(394): n is a, c, t, g, unknown, or other
  misc_feature (597)..(597): n is a, c, t, g, unknown, or other
ngagtgatggagctcaancggggtggcggccgctctagaaatagtggatcccccggggtggaggaattcgtctcacccctagataaagcggcgagggacgcacgcggcacgcctactatctatatcttgcgcgcgtgcggccggccggccatggatccgttctacttcggcccggaccagctggatgccgccgccgtcgacgaggactacctgacgagcctcggcctggtggtcctctcgccggagccagtggcgccgttgcctggcggcgcatttgaggcgtaccagcggcgtgcgccggccttgctggagcactccctgcagacggtgagccggcggtacagtggagagcagaacatgcaccgcaggatgttcagttacctgaaacncntanctcatgacgccggcgccgccgtggtggcggccccagcgttcccggcgcccgcccacgagagcgctcccggcttcggggttggcacgtcccaagcgccccgaaactcccggttcccgaacatcatgccccagcggctgcggcgggagcccctccaccagggattccccgacctccccgcttttctgccccccggggcggttttnaaaggggggaaagaccacctccccc

SEQ ID NO: 64518 - protein, 157 aa, Zea mays
  misc_feature: Ceres CLONE 1534349
  misc_feature (80)..(80): Xaa is any aa, unknown, or other
  misc_feature (81)..(81): Xaa is any aa, unknown, or other
  misc_feature (82)..(82): Xaa is any aa, unknown, or other
  misc_feature (149)..(149): Xaa is any aa, unknown, or other
MDPFYFGPDQLDAAAVDEDYLTSLGLVVLSPEPVAPLPGGAFEAYQRRAPALLEHSLQTVSRRYSGEQNMHRRMFSYLKXXXHDAGAAVVAAPAFPAPAHESAPGFGVGTSQAPRNSRFPNIMPQRLRREPLHQGFPDLPAFLPPGAVXKGGKDHLP

SEQ ID NO: 64519 - DNA, 701 bp, Zea mays
  misc_feature: Ceres CLONE 1534350
  misc_feature: SWISSPROT Homolog: EC 3.2.1.23 Beta-galactosidase
acccgcggtggcggccgctctagaactagtggatcccccgggctgcaggaattcgtctcacccctagaaaaaaaaaaatagattatggagtagtgtgaggtactgaggtccatcatgttgctatgcgcatgtgctgtttcgataagactatggagtagtgtgaggatatatggtgagataataacgtcttagtcttgtaatgaactgccattgactttgcatttagactcatgcgctttgctgaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaa

SEQ ID NO: 64520 - DNA, 660 bp, Zea mays
  misc_feature: Ceres CLONE 1534357
  misc_feature: Translation starting site: 166
  misc_feature (207)..(207): n is a, c, t, g, unknown, or other
  misc_feature (230)..(230): n is a, c, t, g, unknown, or other
  misc_feature (381)..(381): n is a, c, t, g, unknown, or other
  misc_feature (389)..(389): n is a, c, t, g, unknown, or other
  misc_feature (390)..(390): n is a, c, t, g, unknown, or other
  misc_feature (393)..(393): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (404)..(404): n is a, c, t, g, unknown, or other
  misc_feature (407)..(407): n is a, c, t, g, unknown, or other
  misc_feature (410)..(410): n is a, c, t, g, unknown, or other
  misc_feature (415)..(415): n is a, c, t, g, unknown, or other
  misc_feature (453)..(453): n is a, c, t, g, unknown, or other
ataactggagctccccgcggtggcggccgctctagaactagtggatcccccgggctgcaggaattcctctcacccctagaaaaagagatccattcccaactgcacctgcgcgcctcgactggtagcccgaaccctagctagcaggtcggaggcgagagagcagccatggcgcggtgcctcgcgctcgtctccctccttctcctcggnctcgcctccgccgcctccgctgncgatgcgccctttgtcgtcgcgcacaagaaggtttcgctctcccgccccaagccgggcgtcgagagcgtcgccgtctccctcgacctctttttcagggatccgcgactgcctatgatgtgttttttttttcccccccccgggggaaagaangggggggnnttntnnntnnnnanaantcnaaaantttaaaaagataaaccctggtgccccgggggggcgccnttttttctgggaaaccaaaacccgggggtgggttccatggttcccccaccttttatttcctgaacggtgggtcccccaaagactggttcttctttgaggggtttctttgatctccctgtcgttcgcgtggggaagttttctcggggataaatattttttctggagagataacttgtttatagtgctcccaacagccttccttgtgcc

SEQ ID NO: 64521 - DNA, 645 bp, Zea mays
  misc_feature: Ceres CLONE 1534358
  misc_feature: Encodes the peptide sequence at SEQ ID NO. 64522
tggagctccccgcggtggcggccgctctagaactagtggatcccccgggctgcaggaattcgtctcacccctagaaaaaggaccggcttcttgtgccaggcaaaaaacgaggatcccaagttcccttcacaaactgcagggggaggcgaacctcgtgcagcgcggccatggcgaagcagggggcgaagaagatgaaggacgagaacaagaagcgcttggacctactcctgcgcatcatcctcatatccaacgctatttacatagtggtgaggatggctataatgcattcatccttcacctggaagcattggattggccttatggtaacatcggcagcatattttcttccatataagcaactcgccagtatggcaaagccagtttactctgataacggagaactactggatggtggcttcgatttgagcactggtggggtttgcgagtatttatatgatgtgatctacatcactgtctttgtgcaattgatgtctatcatttctgaaaaattttggtggacatatttagtgattccagcttttgctggatacaagatttccggtttgttgagaggagtttttttcagtggtggctcaaagggtgaagttgaagatgagaagacccgaaagaaaagggagaagatgg

SEQ ID NO: 64522 - protein, 159 aa, Zea mays
  misc_feature: Ceres CLONE 1534358
  misc_feature (1)..(159): Pfam Name: DUF788 Pfam Description: Protein of unknown function (DUF788)
MAKQGAKKMKDENKKRLDLLLRIILISNAIYIVVRMAIMHSSFTWKHWIGLMVTSAAYFLPYKQLASMAKPVYSDNGELLDGGFDLSTGGVCEYLYDVIYITVFVQLMSIISEKFWWTYLVIPAFAGYKISGLLRGVFFSGGSKGEVEDEKTRKKREKM

SEQ ID NO: 64523 - DNA, 634 bp, Zea mays
  misc_feature: Ceres CLONE 1534364
  misc_feature: Encodes the peptide sequence at SEQ ID NO. 64524
  misc_feature (216)..(216): n is a, c, t, g, unknown, or other
aaagctggagctccccgcggtggcggccgctctagaactagtggatcccccgggctgcaggaattcgtctcacccctagaaaaagtgactatcagagaggaaccttgtagagcgatttcaatggatagctgtgaactgttgttatagaagtttatctacacaacttgcaatgcggagggctatgataaatccctgcgagtcttgtttatgcttcanaaaaaaaaaaaaaaaaaaaaaaaaaaattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcacggcctacaaggccgaccccggcagcgacgaggccaagctcaaggtcaagttctacctcccgccctt

SEQ ID NO: 64524 - protein, 103 aa, Zea mays
  misc_feature: Ceres CLONE 1534364
  misc_feature (24)..(103): Pfam Name: Lipocalin_2 Pfam Description: Lipocalin-like domain
MAAEEGEKAKSGGGGQQMTVVRGLDVARYMGRWYEIASFPSFFQPRDGRDTRATYRLLEDGATVHVLNETWSKGKRDYIEGTAYKADPGSDEAKLKVKFYLPP

SEQ ID NO: 64525 - DNA, 715 bp, Zea mays
  misc_feature: Ceres CLONE 1534365
  misc_feature: SWISSPROT Homolog: EC 3.2.1.23 Beta-galactosidase
gctcttgaactagtggatcccccgggctgcaggaattcgtctcacccctagaaaaaccctagaaaaagttcgttcccatatattttcccttccgaagctgtgcagaaataagttaataagctatacatacatatacatgtgtactagatttgctatatattattaccatatttaatatgaacctcacagtttgaattaattaagtactatatatatagggcagatttccagtagtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaattttttgttaaatcagctcatttttttaacaaatagggcgaaatccggcaaaatcccttataaatcaaaagaataaaaccgaaaaggggttgaaggtttttccagttttgaaacaagagtccccctatttaaaaaacgtggacttccaacgtcaaaagggcgaaaaaaaccttcctttcaggggggaatggccccactaccttgaaacattc

SEQ ID NO: 64526 - DNA, 719 bp, Zea mays
  misc_feature: Ceres CLONE 1534368
  misc_feature: Encodes the peptide sequence at SEQ ID NO. 64527
  misc_feature (395)..(395): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (403)..(403): n is a, c, t, g, unknown, or other
  misc_feature (535)..(535): n is a, c, t, g, unknown, or other
  misc_feature (538)..(538): n is a, c, t, g, unknown, or other
  misc_feature (590)..(590): n is a, c, t, g, unknown, or other
  misc_feature (631)..(631): n is a, c, t, g, unknown, or other
  misc_feature (648)..(648): n is a, c, t, g, unknown, or other
  misc_feature (687)..(687): n is a, c, t, g, unknown, or other
  misc_feature (702)..(702): n is a, c, t, g, unknown, or other
tccccgcggtggcggccgctctagaactagtggatcccccgggctgcaggaattcctctcacccctagaaaaaatggcggccgccaccggctacagcgacgccccaaccgacgagcaactgctggcgtactctgagctgcccatacatggccgcgacatggcggaggtgttcgccgtgcgcatcccggccatcgccggaggagacccgccgccccgtggcatcatctctttctacggcggccactgctgcagcgatttcatttacagctggaactcactggaagaagaagaagacacctcgaagcaaacctggcgacgccaggggaacctcgtggtaactgggggctttttggcccccccccccggaggggggggggggggcgtcccccttctancctnnntnaatggccatccccccgatctcgggagaaacccccctgaaggagcgacggaggaaccctcggggaacgaaaaatcctcggcaactggcgcctccgcgaaacgaattttctccaactttctcacgggggtgccnttngtcggaataattggtcccagaagtggctatagatccctctctcgaaaaaggncaactatttcctagggcggaagcaacgtcagttccctaggncccaaatggccctgtgnagatttaggttctcctctcctccgcgaccctacaccccntaatatatatcatgntgcctctcggctctctg

SEQ ID NO: 64527 - protein, 176 aa, Zea mays
  misc_feature: Ceres CLONE 1534368
  misc_feature: SWISSPROT Homolog: EC 3.2.2.22 rRNA N-glycosylase
  misc_feature (108)..(108): Xaa is any aa, unknown, or other
  misc_feature (109)..(109): Xaa is any aa, unknown, or other
  misc_feature (110)..(110): Xaa is any aa, unknown, or other
  misc_feature (155)..(155): Xaa is any aa, unknown, or other
  misc_feature (173)..(173): Xaa is any aa, unknown, or other
MAAATGYSDAPTDEQLLAYSELPIHGRDMAEVFAVRIPAIAGGDPPPRGIISFYGGHCCSDFIYSWNSLEEEEDTSKQTWRRQGNLVVTGGFLAPPPGGGGGGVPLLXXXNGHPPDLGRNPPEGATEEPSGNEKSSATGASAKRIFSNFLTGVPXVGIIGPRSGYRSLSRKRXTIS

SEQ ID NO: 64528 - DNA, 856 bp, Zea mays
  misc_feature: Ceres CLONE 1534369
  misc_feature: Encodes the peptide sequence at SEQ ID NO. 64529
  misc_feature (18)..(18): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (83)..(83): n is a, c, t, g, unknown, or other
  misc_feature (84)..(84): n is a, c, t, g, unknown, or other
  misc_feature (856)..(856): n is a, c, t, g, unknown, or other
tgggttttcctccccccnccccttcttctgttcacnnaaaattnnnnnnnnaaaaactggaactccccgtaggtggcggccgnntttctctattgcatcccccgggctgcaggtattcttctcacccctagaaaaaacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcattcgccgtgcgcgccgcggcggaccccaacaggccgatctggtttcccggaaggatagcctccgccgtgagatcgaaagaaagccttcacgggagacttcgagctttgaattactggaggcctcaggatcctgacccaagtaaaatccttcctgttggaaaactgacgagccccaaccgggtgatattgtccggatggggcaaataacttaggtcgcgatatgggacatcattactaaccaagaaataatactcgaatcaccaaatacagcatcctataatagataataacctctgttggattacccgttgctctgccctacactatacaccttatccttcatacataatcaacaatagacatactcttttatatatttcgataaaatacttctttcacacattagcctgactgaccgtatagacgtaataatatttgatattcaaaaaagaaatcgttaataaccactaaaatagcccttacaaacactcataaatcatacattaatgtaaaccagtacatacaatcaacaatcaaaaccaataatagaan

SEQ ID NO: 64529 - protein, 112 aa, Zea mays
  misc_feature: Ceres CLONE 1534369
MALVSASSSSTTAVTALPRNGQRASSSFLGGKTLLRQAEAARPSFAVRAAADPNRPIWFPGRIASAVRSKESLHGRLRALNYWRPQDPDPSKILPVGKLTSPNRVILSGWGK

SEQ ID NO: 64530 - DNA, 685 bp, Zea mays
  misc_feature: Ceres CLONE 1534371
  misc_feature: Encodes the peptide sequence at SEQ ID NO. 64531
  misc_feature (470)..(470): n is a, c, t, g, unknown, or other
aagctggagctccccgcggtggcggccgctctagaactagtggatcccccgggctgcaggaattcgtctcacccctagaaaaaagctcacccagatcagaatccagacctcgtcagagagcattcccttgtgcatctcggcctctccttcctcccttcctcgcccgcccagtcctctaaccatcttctccaaacgcccggagatggtctcgctgcgatgcaccaccgcgcaccactccctcctcggctcgccgacctgcctcgcgcgcccgcggcggcggccgtgccccgtcgtgcgcgctgccgtcgccgtggaggccggccctcaggccaaggtctcactcatccggattgggacttttgtccccccccccgggggggggggggagggggatgaaactcgggaaaaacctgaaaccgcacactctaagttagctgaggagggggcttttggagatccgcatcctaaanacccccggaaaactggatcttgggacaaaccccctggcaaatttttgaaggccaaggggtttttcccccccgggaaatttcatgatgcccctccctgccgggaaaggattggtacctgccttgggcccctcctataaaaataaggtccccaccattttcttcccatgaaggcccctcatttttggccctctggaaccccccccccctacataaat

SEQ ID NO: 64531 - protein, 134 aa, Zea mays
  misc_feature: Ceres CLONE 1534371
  misc_feature (90)..(90): Xaa is any aa, unknown, or other
MVSLRCTTAHHSLLGSPTCLARPRRRPCPVVRAAVAVEAGPQAKVSLIRIGTFVPPPGGGGEGDETREKPETAHSKLAEEGAFGDPHPKXPRKTGSWDKPPGKFLKAKGFFPPGKFHDAPPCRERIGTCLGPLL

SEQ ID NO: 64532 - DNA, 642 bp, Zea mays
  misc_feature: Ceres CLONE 1534375
  misc_feature: Encodes the peptide sequence at SEQ ID NO. 64533
aaagctggagctccccgcggtggcggccgctctagaactagtggatcccccgggctgcaggaattcgtctcacccctagaaaaacgttccactttttccagacatggtcggcattctgcaagcatggtgaccgtgctgccgtggagctcccgtgccacgaccgcaccctactccgcgcacggtcgccgcccacagtccaccccggcacactcttgacattgcagcctcggctaaccctctctgacctcgagggacctcttgccatcgaagtcttcaccatttccaaggatcaggtcgcctccctgaagcacctctgcggtggcacgagcaccttttgcgccgtcagcgctctcatctggcagtgtacgtgcgttgcgcgccgccttccaccggattctcaagtgcgcatggtatttcccgccgagctccgccgccggatgaggccgcccctcccgaaccactacttcggcaacgcagtgttcaggctatacgtcactggcgcggctggggatattggcacggcggcgttgggatccgtcgctacccgcatcaagggcgccatcaagcggttggatgacgagctggtgcggtccgccattgactacttcgagaacgagaaagccgccgagatgaacaagagag

SEQ ID NO: 64533 - protein, 78 aa, Zea mays
  misc_feature: Ceres CLONE 1534375
  misc_feature: SWISSPROT Homolog: EC 2.3.1.144 Anthranilate N-benzoyltransferase
MVFPAELRRRMRPPLPNHYFGNAVFRLYVTGAAGDIGTAALGSVATRIKGAIKRLDDELVRSAIDYFENEKAAEMNKR

SEQ ID NO: 64534 - DNA, 676 bp, Zea mays
  misc_feature: Ceres CLONE 1534380
  misc_feature (396)..(396): n is a, c, t, g, unknown, or other
  misc_feature (425)..(425): n is a, c, t, g, unknown, or other
  misc_feature (465)..(465): n is a, c, t, g, unknown, or other
  misc_feature (553)..(553): n is a, c, t, g, unknown, or other
  misc_feature (628)..(628): n is a, c, t, g, unknown, or other
  misc_feature (659)..(659): n is a, c, t, g, unknown, or other
  misc_feature (671)..(671): n is a, c, t, g, unknown, or other
aaagctggagctccccgcggtggcggccgctctagaactagtggatcccccgggctgcaggaattcgtctcacccctagaaaaaaaggcccaatagagtccagcgcgccctcatctcctccccaacccgttgtccactgcctccaggcaaaccggcagcgccgccgccggcgatgaccaccgcgcggctcgtctcaacatcccccgcccgcctaccctccacgtcggcttccccgattcccagaacctcgctgtgtgttgtcggtcgtgcccctgctttctccgctagggcgctcggcttctcgcttcgtctcaagccgtcgcctgccatggccgccgccggcccccctaccgcgcatggatactccccacaccttcgagggggggagaggttaanagggtgaccaaatatacaaatggtgcacntaaagatcaaccttgatggcactggtgtcccccattgtancacagggatcccgttccttgaatcccatgctccgatcaatgggcatcccctgggacccccttgaagtccaaccttaaaaccaaaaggngaccccccctatttggggaacccccccccccaacggaggccccttgccttttggcaattgtggaaacggcccctnactttgaaacccccctttggggattctaaanggggcgtttgancccga

SEQ ID NO: 64535 - DNA, 652 bp, Zea mays
  misc_feature: Ceres CLONE 1534381
  misc_feature: Encodes the peptide sequence at SEQ ID NO. 64536
  misc_feature (652)..(652): n is a, c, t, g, unknown, or other
ataagctggagctccccgcggtggcggccgctctagaactagtggatcccccgggctgcaggaattcgtctcacccctagaaaaaaccgtcaccacacgcacacggcacacacaccttcttcgtccccttcaccccctgccgctagcctctccctcccctcggtcgtagccatggagaccacttcccctgcctcttcacctgggcacacctccctcccagctgctgcaggtaggactaagtagtaaatagccatatacataggttgagtggatcgttaagagacggtagccatatacataggagtactggatagtatacaagaacggtagatacagggcaggggacatgatgctgggaaagagatctgggcgcccgtcgccggcggcgcggcagcacatgcggcggaccacgagcatgacggagttcgcggcaccgcacgtgctggtagacgtcgcggaggaggaggaggacgaggagctgcagctgctgccggcgcacgccgaggccacaggggaggcggccgagcaggaggacccccacgggtgggccatcggcggcgccgcggccggccgggcgcgcgaactgggctggcgggcgtaaccgcgcccgccccggggcccggaactgggcgggggctacccccggaaactn

SEQ ID NO: 64536 - protein, 84 aa, Zea mays
  misc_feature: Ceres CLONE 1534381
MMLGKRSGRPSPAARQHMRRTTSMTEFAAPHVLVDVAEEEEDEELQLLPAHAEATGEAAEQEDPHGWAIGGAAAGRARELGWRA

SEQ ID NO: 64537 - DNA, 788 bp, Zea mays
  misc_feature: Ceres CLONE 1534382
  misc_feature: Encodes the peptide sequence at SEQ ID NO. 64538
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
tttttttttttttttattggaggnccnnnnnttttttnnnnnnttcaattnnnnnnnaaatattggatctctccgcggtggcggccgctctataatagtggatcccccgggctgcaggaattcccctaccccctagaaaaatccgcgcccgcgcgcgccgcaaaatctaggcctgtcgccgcggtcgtggccgtgggctgacgggatctctgtcctcccgacaggaggaacctcaaggaaggtgcctaggacgaggacgaagcgggggctatggaggcgtcttcctgggacgccgttcgcaagcaggttatgaggtcggaagctcagttagatgacctcgtgattgcataccggaaattggtttctatgaaatcagacggtctcacaggacaatatttgagtctgatataatattttctccccaatcaatgtgcggggggggggggagttcgcttatgcctaacttgggttatcattcaggcaggtttctgaaagttcttttcctcattactcttgacttcgtccttatgggaagatctttgccatagaacctttagctcacgggaagttcttattcggactttcgaatttataggtgttcgagggtcgaaatacaatgctagggattcctttcctcctccccttggaccgttgaaggagaatcttttggtactagagccaattagtttcgtattgttgtgaagggagactcgcttcctgtatttacaggcttgaaatcaaaagttgtgctttcttcaagggggaaaactatagactttgggttattt

SEQ ID NO: 64538 - protein, 46 aa, Zea mays
  misc_feature: Ceres CLONE 1534382
MEASSWDAVRKQVMRSEAQLDDLVIAYRKLVSMKSDGLTGQYLSLI

SEQ ID NO: 64539 - DNA, 660 bp, Zea mays
  misc_feature: Ceres CLONE 1534385
  misc_feature (397)..(397): n is a, c, t, g, unknown, or other
  misc_feature (398)..(398): n is a, c, t, g, unknown, or other
  misc_feature (421)..(421): n is a, c, t, g, unknown, or other
  misc_feature (546)..(546): n is a, c, t, g, unknown, or other
aaagctggagctccccgcggtggcggccgctctagaactagtggatcccccgggctgcaggaattcccctaacccctagaaaaatcaaatgagacatgtcggcaagtcacatgtgcaactatcctgttaacaacaatcagccaagcagaggtaccacttcctagggtgagtattactatatccacatgtgacttggtgtagatgaaacacccattcagtcaggcatccgggtgcgcggccgtgaatcggtgattgtcagattaatatacaggttagttttgtctagctaaccagcgggtgtggtttgcgaacaccaacatgctagagatggagctgctagaggagaagcggatactgaaacacctcgtggaggtttttttgttgggtcatgttttanntttgattcctacgcgtgcgtggngaagccttttggtttttgaatgagatgtaattattgcggcacatatttagaagccatgttccaactggggattacattttcgttttgtaatcccaaaaactgttttggttgacacaaatgtcccntcggtccaccaccctagtctccgcccgcttggccgcttttttggtctcttccctcccgggttctcgggtttctttctacacgcctaccggtctccaaagccgtaaaaagccccg

SEQ ID NO: 64540 - DNA, 682 bp, Zea mays
  misc_feature: Ceres CLONE 1534386
  misc_feature: Encodes the peptide sequence at SEQ ID NO. 64541
cgcggtggcggccgctctagaactagtggatcccccgggctgcaggaattcgtctcacccctagaaaaacggggaaacttaccaggtccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgtagttagcttcttagagggactatggccgtttaggccacggaagtttgaggcaataacaggtctgtgatgcccttagatgttctgggccgcacgcgcgctacactgatgtatccaacgaggatatagccttggccgacaggcccgggtaatcttgggaaatttcatcgtgatggggatagatcattgcaattgttgggcttcaacgaggaatggtgctttcttacaggggggttggcttctccctccccctccggttcaggttcgggttcatgaggttctcccgggttccgggttcctggttgagcggaaccgatattgacgtccttcgaaagtttaaataaccccttgctttcttctgggggcctctcccttggtcccccggaactacccccttcccctccaaaaaatccctctttaaggaatctatacccgccaaag

SEQ ID NO: 64541 - protein, 38 aa, Zea mays
  misc_feature: Ceres CLONE 1534386
MGGGAWPFLVGGAICLVNSVNERDLSLLTSYAEPSLRS

SEQ ID NO: 64542 - DNA, 678 bp, Zea mays
  misc_feature: Ceres CLONE 1534387
  misc_feature: Encodes the peptide sequence at SEQ ID NO. 64543
  misc_feature (678)..(678): n is a, c, t, g, unknown, or other
ggagctccccgcggtggcggccgctctagaactagtggatcccccgggctgcaggaattcgtctcacccctagaaaaattcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcgggtaacgtcccgacggcggcaacggcggtgggcgaggcggatacggcggcggcgaccgcggttacggcggcggcggtgaccccggctacgggggaggaggcgaccgtggtttacgcggcggcgaccgtggttaccgtggaagtgggcaccgcggcttcggcggcgaccggggctatgggggaaggcggcggcttatggcggggggtacgggggaatgccctcgtggaaggcggccctctgcttgcttccagtgggggctagagagggcccccctggcttagggcactggctcn

SEQ ID NO: 64543 - protein, 80 aa, Zea mays
  misc_feature: Ceres CLONE 1534387
  misc_feature (5)..(72): Pfam Name: CSD Pfam Description: 'Cold-shock' DNA-binding domain
MASDRVLGTVKWFNGTKGFGFITPDDGSEDLFVHQSSIKSDGYRSLNDGDAVEYTVGSGNDGRAKALDVTAPGGGPLAGG

SEQ ID NO: 64544 - DNA, 609 bp, Zea mays
  misc_feature: Ceres CLONE 1534389
tccccgcggtggcggccgctctagaactagtggatcccccgggctgcaggaattcgtctcacccctagaaaaatgtgtgtgtccgtgtccgagtccgcccccgcaaggcccagctcctcactccctcgtgcctgctgtggaaggaaaataacccaccccatcaattggcccacgtggccatcatcggatccacaggtacctagccatgactgaggaaccctctgcccctgcggaggggacctaaccccctccggctaagatgacaatggtggaaggggtccaccagagcgagcacagcttcaacgcgctgcactgagcactgcagcacttcttccccccgggtcagccccagcaataccgcctcgtcgtcgtcaccgccaagaccaccgcctgcctcagccataggcctcgccgggccacttcctggaatgtgattccacacgtggaagcagatctcaagcgatccgccctgcctgtcgtccaaaaagccaaaggcctcttcacaaactccagagactctgtgtttgaacctcttgaggcggacgctaggaacgaccactccgatcctgtcgagatccaccagcccgaaatgctcgtagtcggttgcct

SEQ ID NO: 64545 - DNA, 631 bp, Zea mays
  misc_feature: Ceres CLONE 1534391
  misc_feature (146)..(146): n is a, c, t, g, unknown, or other
  misc_feature (149)..(149): n is a, c, t, g, unknown, or other
  misc_feature (182)..(182): n is a, c, t, g, unknown, or other
  misc_feature (215)..(215): n is a, c, t, g, unknown, or other
  misc_feature (236)..(236): n is a, c, t, g, unknown, or other
  misc_feature (297)..(297): n is a, c, t, g, unknown, or other
  misc_feature (305)..(305): n is a, c, t, g, unknown, or other
  misc_feature (307)..(307): n is a, c, t, g, unknown, or other
  misc_feature (359)..(359): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (406)..(406): n is a, c, t, g, unknown, or other
  misc_feature (407)..(407): n is a, c, t, g, unknown, or other
  misc_feature (409)..(409): n is a, c, t, g, unknown, or other
  misc_feature (414)..(414): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
tgaccgcggtggcggccgctctagaactagtggatcccccgggctgcaggaattcctctcacccctagaaaaaaaacagcagccaggattccacaaacagagaggccaggttccaagcaaaggcagtgcaggcagggcgtgtgganaancaaagcagcgggtggcgcacctgcacgtgccangctgccagctctggccatggcggatcaccaaangatccacccctgtcgacctgnaggccggcaatcggccaacgacgccgctggtgcccggaggctccttccgggcggacaaggncaacccancncatttcttaaacaaccaccaccaacaaaagcaaccactatttttcccctcancccccgggggcatagaacagggggcnnnnnnnnnnnnnnnnnccacnntntcccncaaaaaaaacaaccaaaaactnnncgggcggggggggctccttcccttttcctcttctccccccggaaaaacccggggcggggctggcgtgggtactcccagaagaagcccggagcaactttaaccggttcccggcaccgcaagtgcccgcgttatccgcttgacccaccctcatgctttccctttttggtggaaccacccaacgcccccggttctg

SEQ ID NO: 64546 - DNA, 682 bp, Zea mays
  misc_feature: Ceres CLONE 1534394
  misc_feature: Encodes the peptide sequence at SEQ ID NO. 64547
  misc_feature (395)..(395): n is a, c, t, g, unknown, or other
catagctggagctccccgcggtggcggccgctctagaactagtggatcccccgggctgcaggaattcgtctcacccctagaaaaagtcaccccggagcctctccttcccggtctcctccgcccgttgccttcgtcccctccatctccggctgcgtcgccggcgagcccgacaccgcgaatcggatccgccgacaaggtgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcacccccatccccaccatcgtatttcacgccccaaccggtggggggggggagcatcnccttcactgtctgggatgcccgggggccaggacaagatcaggccactgtggtaggctttgcttccagaacacccagggccccatctttgttggcggacgccaatgataagggaccctggttgtttaaagcaagggatgagccccccccgaatgctggaatgaaggatgaacttccgcgaacgctggggggggctggtttttgcctagaaaggcaatttctatccaattggctatcatcggccccttgaaaatctctgttaaaagttgggctctgccttcccccttcc

SEQ ID NO: 64547 - protein, 96 aa, Zea mays
  misc_feature: Ceres CLONE 1534394
  misc_feature (5)..(97): Pfam Name: Arf Pfam Description: ADP-ribosylation factor family
  misc_feature (62)..(62): Xaa is any aa, unknown, or other
MGLTFTKLFSRLFAKKEMRILMVGLDAAGKTTILYKLKLGEIVTPIPTIVFHAPTGGGGEHXLHCLGCPGARTRSGHCGRLCFQNTQGPIFVGGRQ

SEQ ID NO: 64548 - DNA, 660 bp, Zea mays
  misc_feature: Ceres CLONE 1534395
tggagctccccgcggtggcggccgctctataactagtggatcccccgggctgcaggaattcgtctcacccctagaaaaagctccggcgttgcccgtggagtgcctcccggatttgcaatctcattcccccctcagcccggtccccccgcgccgtcggctggtctgttccttccgtgcccggcatgacgatgattgtctcattcgtataccctactgctcactcttgttctctgatacgcgtcatccctgcataggactgctacagaccgtgcaagttcacacgcctgacgtcgacatctgcggttctggtgtcactactggattttgctcacctttctcgccgtactggagagacttggctagactccggatcgtgactacccctgcatcatgatccacacctcgcatttatcctgcactttgggtatcgcgaaacacgacggaatgttcctctactacagtctctccttcagccctagctcccgcaccaacacctccacattgagctcactctgcttgatgtttcgactacgcgcctggatttgcgagttcttttcctgggcagtggtcccgccgtcctcggactccgctgacgacgtcctccaccatattcccttgttgcctccgactcacagaactggaatcagttcgcagcgacgg

SEQ ID NO: 64549 - DNA, 664 bp, Zea mays
  misc_feature: Ceres CLONE 1534408
atagctggagctccccgcggtggcggccgctctagaactagtggatcccccgggctgcaggaattcgtctcacccctagaaaaagaaggccggatattgaagtccaaaaaggcccaaccagcccccctccctctcctttcttcacttggaaatccatggtgtaggcccagagagatctagctagagtttcctgcatccgcctccgccccccaccgcctccacctccgccccccaccgccccgccccacagcaggaaggatggaagccccgggctccccctacgcctcctcgccggaatccgcccccaagcgtgccccacgctcccctccgcagcagcagcagtctccctccgaggaaggagatgaccaccacaaaccggggggggggagatttctagtgtctaatacggcagcagggtgcatcattggcaagggtggatcaccctttaatgattttcagtcccagtctggggctcgtattcagttattcacgtaccaatgagtttttcccctggtacaaaggacagaatcctcctggtttccgggactggttgaagaaaaaatgaaaggccttgggacctgaatccttgaaaaaatggtgggctgaaggtgaaaaaatccaccgaagccaaagccttgaccctaaagtttaaaccttggaatcc

SEQ ID NO: 64550 - DNA, 638 bp, Zea mays
  misc_feature: Ceres CLONE 1534415
  misc_feature: Encodes the peptide sequence at SEQ ID NO. 64551
atagctggagctccccgcggtggcggccgctctagaactagtggatcccccgggctgcaggaattcctctaacccctagaaaaagctcaccacgcgcctccaaggtagggtttctctccccctcactcctgctccgtctccggctccgcgcggaattcagagtcatgtttccatgttccggatgctaaaggacccgtttttatccgcgtgcccgtgctagggcctcgcctcgcccgcccgccggtccaggatgggcgcacggatttagctgatcccgtcgctgctcgcgcccgatctcgcggcgccccgccccatcagctccgcgagatgatctgagccccgcgatctggtggagaaatggagccgccgccggatctgaacacccacctgccgccgcggaagcgcctgctcgccgggctcaggacggcagccaccgccgccgagccgctaccgccgccgcccgcccacgccgacctcgccgcccgcctccgcgagatggcgctcgccgccaacgcgtcggcgtcctcgcccgaggagacgatcgaggcggcgagggcggccgcgcaggccgccgcggacgccgccgttgctgcgcgcgccgtggccgccgagaaagcccccgtcgccgccaaggctag

SEQ ID NO: 64551 - protein, 47 aa, Zea mays
  misc_feature: Ceres CLONE 1534415
MALAANASASSPEETIEAARAAAQAAADAAVAARAVAAEKAPVAAKA

SEQ ID NO: 64552 - DNA, 630 bp, Zea mays
  misc_feature: Ceres CLONE 1534416
  misc_feature: Encodes the peptide sequence at SEQ ID NO. 64553
tggagctccccgcggtggcggccgctctagaactagtggatcccccgggctgcaggaattcgtctcacccctagaaaaaagaaaaaacttcgaggccgcggcgttggctgtctcggtgtcatcgtctcctctcgtctcgttctcttctcctcacctccttcgtttcgcggagcagagcgagcagccggcaccggacctccaaggagcgcaccgcggaggccagcgaagatgcccgggctcacggcaccgtccgactacgcggaggagccgccgcgtcacccggccctcaagatcaactccaaggagccattcaatgctgagcctcaccgatcagagctagtcgcatcttacatcaccccagtggatttcttctacaagaggaatcatggacccatccctaaagtcgaggacctctcaagatacgctgtttccatttctggtctcgtcaacaagtccattcagctatcgatggctgacatttggtctcttccaaagtacaatgtcacagcaactttacagtgtgcaggaaacaggaggactgcgatgagtaacgtacggaaagtgagaggtgttgggtgggacatatctgctcttggaactgcaactgggggagtgccaaactatctgatg

SEQ ID NO: 64553 - protein, 134 aa, Zea mays
  misc_feature: Ceres CLONE 1534416
  misc_feature (49)..(132): Pfam Name: Oxidored_molyb Pfam Description: Oxidoreductase molybdopterin binding domain
  misc_feature: SWISSPROT Homolog: EC 1.8.3.1 Sulfite oxidase
MPGLTAPSDYAEEPPRHPALKINSKEPFNAEPHRSELVASYITPVDFFYKRNHGPIPKVEDLSRYAVSISGLVNKSIQLSMADIWSLPKYNVTATLQCAGNRRTAMSNVRKVRGVGWDISALGTATGGVPNYLM

SEQ ID NO: 64554 - DNA, 646 bp, Zea mays
  misc_feature: Ceres CLONE 1534419
  misc_feature: Encodes the peptide sequence at SEQ ID NO. 64555
aaagctggagctccccgcggtggcggccgctctagaactagtggatcccccgggctgcaggaattcgtctcacccctaaaaaaaaaaaggtgcgcgcgctgtcactctagcgtgtctttctccccttcctgctttccctctccagctctcatacacaaacacacggagctagcagcacggatcgagagaacaatggaggaaacaagcaggatccctgggtacttcaagaacaagggcatcctgatcacgggcgcaacaggcttccttggaaagatcctcgtggagaagatactgagggtccagccggacgtaaagaggatctacctccccgtgcgtgcgccggatgctgcatcagccaagaaacgggtggagactgaggtgatcgggaaggagctgtttgggcttctccgagagacgcacggcaagaggttccactccttcatcgaggagaaggtggtcccgttggccggcgacatcatccacgagaacctgggcgtggaggggccccagctgaggcggatgactcgggagctcaacgtcatcgtcaatggagctgccacaacaaacttctacgagaggtacgacgtggccctggacgtgaacgtgatgggagtgaagcatatctgccagttggccaagcagtgcc

SEQ ID NO: 64555 - protein, 151 aa, Zea mays
  misc_feature: Ceres CLONE 1534419
  misc_feature (18)..(151): Pfam Name: NAD_binding_4 Pfam Description: Male sterility protein
  misc_feature: SWISSPROT Homolog: EC 1.2.1.31 L-aminoadipate-semialdehyde dehydrogenase
MEETSRIPGYFKNKGILITGATGFLGKILVEKILRVQPDVKRIYLPVRAPDAASAKKRVETEVIGKELFGLLRETHGKRFHSFIEEKVVPLAGDIIHENLGVEGPQLRRMTRELNVIVNGAATTNFYERYDVALDVNVMGVKHICQLAKQC

SEQ ID NO: 64556 - DNA, 720 bp, Zea mays
  misc_feature: Ceres CLONE 1534422
  misc_feature: Encodes the peptide sequence at SEQ ID NO. 64557
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (53)..(53): n is a, c, t, g, unknown, or other
  misc_feature (56)..(56): n is a, c, t, g, unknown, or other
ggttttttnnnntttcttctttttttgtgggggcctaccatnnnngggttttnttnggataactggagctccccgcggtggcggccgctctagaatagtggatcccccgggctgcaggaattcgtctcacccctagaaaaatatccggatccgctgactccgcctctcgagtctcatcaacccgtcatcctcctagctcctctactcaacagtggccatgggcaagattaagatcggaagcaacggcttcagaaggatcggcgggatcgtggccagggtcgccctccatagcgaggatgtggagctcgtcgccgtcgacaaccccttcatcaccccggacgtaatgacctagaggttcaagaacgacaccggcgacggcggctggaggcacagcgacctcacactcaaggagtctgagacccttatcttcagtgaccaaccggtcaccgccattggaatgtggaaccctgacgaaatcccgtggggtgaggctggcgctgagtatgccgtggatgccaccggacacttaactgacagagaataggatgctgcccatcctccgcgcgggtgccaaatagcgtcgtgtgatcatctgcccccaagcactacgatgcggcccaatgccctgttcgcgtggctgcccaggggggcgaacaactatacccccttactgttattggtgaaatcaatatgggtttcgccagtgtggcttacgtctag

SEQ ID NO: 64557 - protein, 44 aa, Zea mays
  misc_feature: Ceres CLONE 1534422
  misc_feature: SWISSPROT Homolog: EC 1.2.1.12 Glyceraldehyde-3-phosphate dehydrogenase (phosphorylating)
MGKIKIGSNGFRRIGGIVARVALHSEDVELVAVDNPFITPDVMT

SEQ ID NO: 64558 - DNA, 645 bp, Zea mays
  misc_feature: Ceres CLONE 1534425
  misc_feature: Encodes the peptide sequence at SEQ ID NO. 64559
aaagctggagctccccgcggtggcggccgctctagaactagtggatcccccgggctgcaggaattcgtctcacccctagaaaaagtcactcttgttgatcctaaaaccctaacccctagccagcgctccgccgccatccgccggcgagatggcgttgtacctgctgttcgagtcggcctccggctacggcctattccatgcgtacggtatcgatgagatcgggcagagcgttgaggccgtgcgctcctccgtgctggacctcgaccgcttcggcaaggccgtcaagctcactgccttcaatcctttctcctctgccgtcgacgcgctcaaccagtgcaacgctatctctgaaggaatcatgaccgatgagttgaggagcttcctggagctgaacctgccgaagcctaaggaggggaagaaggccaaatacagcctcggcgttgtcgagcccaaggtcggctcccacatctccgaggtcaccggcatcccctgtcagagcaacgagttcgtccaggagctgctccgcggtgtccgcctccacttcgaccgtttcatcaacgagcttaaggattctgacttggagaaggcccaacttggcctggggcatagctacagcagggctaaagtgaagttcaatgtgaatcc

SEQ ID NO: 64559 - protein, 165 aa, Zea mays
  misc_feature: Ceres CLONE 1534425
  misc_feature (3)..(69): Pfam Name: NOP5NT Pfam Description: NOP5NT (NUC127) domain
MALYLLFESASGYGLFHAYGIDEIGQSVEAVRSSVLDLDRFGKAVKLTAFNPFSSAVDALNQCNAISEGIMTDELRSFLELNLPKPKEGKKAKYSLGVVEPKVGSHISEVTGIPCQSNEFVQELLRGVRLHFDRFINELKDSDLEKAQLGLGHSYSRAKVKFNVN

SEQ ID NO: 64560 - DNA, 870 bp, Zea mays
  misc_feature: Ceres CLONE 1534427
  misc_feature: SWISSPROT Homolog: EC 2.7.11.1 Non-specific serine/threonine protein kinase
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
gtcccctccctntgnnnntatatttnnnnnnnnnngggccannnnnnaaagcctggaactccccgcggtggcggccgctctagactagtggatcccccgggctgcaggaattcctctcacccctagaaaaaggtggctgcaccgccgagaccgggagggggcgccggcgccgctggactggccgaccaggctcgccatcgccgtcgacgcggccaaggggctcagctacatgcaccacgactgcgcgccccccatcgtgcaccgcgacgtcaagtccagcaacatcctgctggacccggacttccacgccaagatcgccgactttcgggctcgccctggatcctcagcaaggaccccggccaaaccccctttcctttttgtcttccctctcctctgggatcctctaccgggggaccaaaaggtattttttttttttttccccccctcccccccccccggggggggggggggggggggccccccccctacccttccttacatctcttcttgcttcctcccccccccctgtgggtagcaaccatatatatacgtcctctctaaaattcactcccccccctacccaccccccccatatccctcctctcaactctcttatttctttttcgctcatttctcgtcatcaacaatacctccttcattacttatctctgttaacctatccaaccagtatcaagccactccccctcacaccccaaatgcacccgtccccccccataacaacccattacatccgatcttcgtgccctcacctctaaatatttaaccgaaaagtctcctctatccaatatattcatcactactgtttacctcactaaccatgtcattagttaacattctccttacccctca

SEQ ID NO: 64561 - DNA, 913 bp, Zea mays
  misc_feature: Ceres CLONE 1534429
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (18)..(18): n is a, c, t, g, unknown, or other
  misc_feature (19)..(19): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ntttccccttnncccccnncactccttctaataatnnnngccctctnnnnnggcaacgggagatcaccgcggtggcggccgctctagaactagtggatcccccgggctgcaggaattcctctcacccctagaaaaacttttgcgcaaaagagtactcctctccctcctaccacacacagcctcccggactgctccggacgcgcgcctcaaatctactccaacacctgcgggggtgtccgcgggtggaggagcaggagctggatttggcgtgtcactgggtcgggaccgggaaaaggcaccctcatccccatacggaggatcgaccacccggccggccaccgcgggtcaccctcccccccgaggggcggcgagccccgatcatcaaatgccgacgcaactcccccttccctccgcccagttcctaattcctttttttttcccccccccccttcgggggggggggggggggggcctttttccttttctccacaccccccactccacgtacgctctttttatatactttaatagacataaccactcgcaacacccccaaacaaagtgctcctctcatccattcccccccccctccccacccccaacatcacgagacccgctcacacccacctccaccccgcgcacttaccaccctcttccaccctctctacactctccatacccacctccacaacccccaaccctacgacatgccacgggcccagaggtcagacacgacgtggtgtctgcacccctcgctctacacttcctcctctttaattctctcctatatgcaacacaactaatactacagcggcgcaactcacccagatatatttctgacacatttgcccccgattcacctccgtactccccacccttcatatcctcccacaactcgcctcccatctctccg

SEQ ID NO: 64562 - DNA, 783 bp, Zea mays
  misc_feature: Ceres CLONE 1534432
  misc_feature: Encodes the peptide sequence at SEQ ID NO. 64563
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
  misc_feature (708)..(708): n is a, c, t, g, unknown, or other
ggtggttctgctgtgtctccttcttcttgnggagagnntgataaaannanaaaaactggagctccccgcggtggcgggcgctcttccctagtggatcccccgggctagaggttttcctctcacccctagaaaaaatcgccgcaactgcccgtctgctcctgcttttcatccagtcgcaaaacaaagagaagagatctccgcgtccgcaaccgcatcgcttccctcccggcagaagaagaagattcggttgggttgtttgtctcttgcaaaccgcaatggctgctgctgccactgctactccggccgagaggccggaggccggcgaccggaaggcggtggcaccgccggtcgtagccgtggatttggagctggatctggaccacaagcccgtgctggcggaggacgatagctccttggaccgaagtgtgagggcgaatatcccacccactttcacattacaaaaccccaacaccgaccagatggaagaagcgccgcctcgcccatgttgttaaatcaacatcaaacacctcacaatccctctcaccgatgatgtacgacatgacgtacagacagggacataaaacctaaccacttgggattcatccgagaacgcgccgagaaccaaccggcgaaagagaagcaacaacacaaagcaaaaaaacaataacagaccactaaccccaacacagaagcccctaccccacacanactgtgtcgtttctctagcatctccttggagcgcccccgcaggcgacgattccaggctcatcaccacctaccctt

SEQ ID NO: 64563 - protein, 78 aa, Zea mays
  misc_feature: Ceres CLONE 1534432
MAAAATATPAERPEAGDRKAVAPPVVAVDLELDLDHKPVLAEDDSSLDRSVRANIPPTFTLQNPNTDQMEEAPPRPCC

SEQ ID NO: 64564 - DNA, 651 bp, Zea mays
  misc_feature: Ceres CLONE 1534433
  misc_feature: Encodes the peptide sequence at SEQ ID NO. 64565
acccgcggtggcggccgctctagaactagtggatcccccgggctgcaggaattcgtctcacccctagaaaaagacccgagtagcatggggcacgtggaatcccgtgtgaatcagcaaggaccaccttgcaaggctaaatactcctgggtgaccgatagcgaagtagtaccgtgagggaaaggtgaaaagaacccccagtgggtagtgaaataacacagcaagacccgaccttgcctcctcctacagcagcagcagcataaccagaggggagtgcagcaagccgtttcgagagacagctttaggctactgctagcagtatggcttccgctgcgcgcttcctggccgtggccgtggtcgtggcgtgcgcactcctggccagcaacaactgccacgcggcacgccacttggccgacacggccgcggctcctgctgctgctgccatcgtccctggactccccgccgtgccgaccttgccaacggtgcagccagtgccacaggtggcgttgccacccatgccggccgtgcccgcggtcaccgtaccgcagatgacgctgccgcccatgccagcggcctcccaaggtggccgtgccgctgccgccaatgcccgccatcccgtccgtgctgcccaagctgaccctgccaccgatgccc

SEQ ID NO: 64565 - protein, 111 aa, Zea mays
  misc_feature: Ceres CLONE 1534433
MASAARFLAVAVVVACALLASNNCHAARHLADTAAAPAAAAIVPGLPAVPTLPTVQPVPQVALPPMPAVPAVTVPQMTLPPMPAASQGGRAAAANARHPVRAAQADPATDA

SEQ ID NO: 64566 - DNA, 817 bp, Zea mays
  misc_feature: Ceres CLONE 1534434
  misc_feature (13)..(13): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (817)..(817): n is a, c, t, g, unknown, or other
tttttttttttgntgttttttactttatatttctaccctctttnnnnntttaaactgcgactccccgcggtggcggccgctctataactagtggatcccccgggctgcatgaattcctctcacccctagaaaaaaccagcaagaccaaccaacccacttctgactgaccactgtgccgcgccgtgctcaccgaacggtcgaccacacaaaacgacgatggccgcgtctgctctgcaccagaccaccagcttcctcgggcaggccctggtcacacccgccgccagcaacaatgccggctgaagcatcaccatgccccccaccgtcaagaacgttccccacagcaaacggtactgcccctgaccgccccaacataccttgtgcccgattctccaaactcaacgccccccttatatgaacggtcaagtcacccccatcaactaatggggtggaaacaaccatcagggctctcacctgacaaatacctgtaaaaaccttttattttattaattggctaccgtaacaggttaatcaccccacccggttggtaaaactcctggcgataaattacaatatcgatgtgacatccacacaacataccctccccaaaatacagcaacctctatactcttctttatagtcctgttgttagactaactatgtccgagcccacctatatcctgccacctcacagacctctcctcccacccaaacacacagccaaacccccagcacaaacattataaaattccatacgctataaccaattcattaagtaaatcatataaatacgaaacaatataaaatacaatatataacn

SEQ ID NO: 64567 - DNA, 663 bp, Zea mays
  misc_feature: Ceres CLONE 1534438
  misc_feature: Encodes the peptide sequence at SEQ ID NO. 64568
  misc_feature (663)..(663): n is a, c, t, g, unknown, or other
aagctggagctccccgcggtggcggccgctctagaactagtggatcccccgggctgcaggaattcgtctcacccctagaaaaaacaagaactggcgcagaggagctgcttcagcctgccgtcgtacgtgtgcacgcgcgagggccccgaccacgctccgccaggccgcccgcctctccctccgcggcccgtccactaccctcgccgcccgggtcatcgatgagacgggggtgtacaagaacctgctgcaggagacggcccaccgggcggggctgaagctgccggcgtacaccacggtgcgatcgggcccgggccactcgccggtgttctcctccaccgtcgagctcgccggcttgagcttcgcgggcgaccccgccaggaccaagaagcaggcggagaagaacgccgccatggccgcctggtcgtcgctcaaacagatgccggaggctcgcaaggagcccggcgccggcgacgagcaggagcacgtggctgtcgccagagcgcacgcggcgctgaagccgcgagacggcggcgacggaaaggcggcgccgcctctgcagaagcacagcagcaacggctcttcttcctccgctcttccgaacccgtcgctgtacagacaccaatggcggcctcggaccagtacccctgcccagcccctgccgcn

SEQ ID NO: 64568 - protein, 84 aa, Zea mays
  misc_feature: Ceres CLONE 1534438
MAAWSSLKQMPEARKEPGAGDEQEHVAVARAHAALKPRDGGDGKAAPPLQKHSSNGSSSSALPNPSLYRHQWRPRTSTPAQPLP

SEQ ID NO: 64569 - DNA, 711 bp, Zea mays
  misc_feature: Ceres CLONE 1534444
  misc_feature: Translation starting site: 164
  misc_feature: SWISSPROT Homolog: EC 3.2.1.23 Beta-galactosidase
atagctggagctccccgcggtggcggccgctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgtgtacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcc

SEQ ID NO: 64570 - DNA, 732 bp, Zea mays
  misc_feature: Ceres CLONE 1534446
  misc_feature: Encodes the peptide sequence at SEQ ID NO. 64571
aaagctggagctccccgcggtggcggccgctctagaactagtggatcccccgggctgcaggaattcgtctcacccctagaaaaagaatttgaagctgatgtgcagttttatgtttgttttgctgatgcaattaattcttaagcaaatccatggcaacttgtttatcgctgatgcttgagggatggaaatgacactcagaataaatctttgatttgctttcttgtgatcgttgatcacattaaaaaaaagacaaaaaaatactcaaaaaaactgaagtatcaccacgatactccaagactcccatacatgcgagccgctcggggtacccaattcgccctatagtgaggcgtattacgcacgctctctggccgtcgtttaacaccttcttgactgggaaaaccctggcgttacccaacttaatcgccttgcaccacatccccctttcaccagctggcgtaatatctaagaggcccgcaccgatcacccttccaaacatttgcccaacctgaatggcaaatggaaattgtaagcgttcatattttgttaaaattcgcgttaaatttttgttaaatcagctcatttttttaaccaataggcccaaatcggcaacagcccttataaatcaaaagactagaccaagatagggttgagtgttgcttcatgtttgcaacaagagtccactattaagaaacgtggacttctacgtcatagggcgaaaaaccgtctatcagg

SEQ ID NO: 64571 - protein, 46 aa, Zea mays
  misc_feature: Ceres CLONE 1534446
KAGAPRGGGRSRTSGSPGLQEFVSPLEKEFEADVQFYVCFADAINS

SEQ ID NO: 64572 - DNA, 693 bp, Zea mays
  misc_feature: Ceres CLONE 1534449
  misc_feature: Encodes the peptide sequence at SEQ ID NO. 64573
agtggatcccccgggctgcaggaattcgtctcacccctagaaaatattggctgtaacaagaaaaaaaaatgtttcgtcactattcttttacaggctatgttggatactgtacctactttactaaatagcaaaaagcaaacatatgaacaagggcggtgctacaaaaaaaaaaaaaaaaacgagacgctcgaggtacccaattcgccctatagtgagtcgtattacgcgcgctcactggccgtcgttttacaacgtcctgactgggaaaaccctggcgttacccaacttaatcgccttgcagcacatccccctttcgccagctggcgtaatagcgaagaggcccgcaccgattgcccttcccaacagttgcccagcctgaatggcgaatggaaattgtaagcgttaatattttgttaaaattcgcgttagatttttgttaaatcagctcatttttttaaccaataggccgaaatcggcaaaatcccttataaatcaaaacaatataccgagatagggttgagtgttgttccaattgggaacaagagtccactattaaagaacgtggactccaacgtcaaagggcgaaaaaccgtctatcagggcgatggccccctacgggaaccatcaccctaatcaagttttttgggggcgaggtgccgtaaagcactaatcgaaccttaagggagcccccga

SEQ ID NO: 64573 - protein, 100 aa, Zea mays
  misc_feature: Ceres CLONE 1534449
  misc_feature: SWISSPROT Homolog: EC 3.2.1.23 Beta-galactosidase
MLDTVPTLLNSKKQTYEQGRCYKKKKKNETLEVPNSPYSESYYARSLAVVLQRPDWENPGVTQLNRLAAHPPFASWRNSEEARTDCPSQQLPSLNGEWKL

SEQ ID NO: 64574 - DNA, 765 bp, Zea mays
  misc_feature: Ceres CLONE 1534450
atagctggagctccccgcggtggcggccgctctagaactagtggatcccccgggctgcaggaattcgtctcacccctagaaaaaaggggccgcgccctccagtttgccatcgctccagactcccccgccaccccgcagcatgagccagtgtcgcagcaacagcaatagtggctgacaaccacatccccagtagttgctcacgactactgaccatacgtatctgtttcgttttcttgggcatcatactgagtcacaaaggctaagcctgggcttctgcctcccgtggccagtttgggtgtcagtgtcacccaaagttcgttacacccgaaaccttgtgctttgtattaaaccgagtgtgatccgagaatataccaatttaatgtaaattcattcttgttcttactgcgccatcattattaaccgttgtatgcactgtaatgtacagtctttcataatactatttattttttctgaaaaaaaacaaaaaaacgagacgctcaaggtacccaattcgccctatagtgaggcgtattacgcgcgctcactggccgtcgttttacaacgtcgtgacttgggaaaacccttggctttacccaacttaaaccccctttgcacaacattccccttttcggccagcctgggggtaataagagaaaaagcgccccaaccggattggccctttcccaaaacatttgccccagaccttggaatgggccgaaattggaaaatttggtaaagccgttttaacattttgtggttaaaaag

SEQ ID NO: 64575 - DNA, 767 bp, Zea mays
  misc_feature: Ceres CLONE 1534451
  misc_feature: Encodes the peptide sequence at SEQ ID NO. 64576
ccaagctggagctccccgcggtggcggccgctctagaactagtggatcccccgggctgcaggaattcgtctcacccctagaaaaaaggcgcgcggtttccaggcggttcctcctccagactctagagaaagaaggcgcatcgtgagcgagagagagagaggcaatggcgtcggcgacgttcctggaggtgctcctcgccatcttcctcccgccggtcggcgtcttccttcgctacggctgcggcgtggagttctggatcgacctcttgctgaccgtgctggggtacattccggggatcatctacgccgtgtacgtgctggtggcttaagttgtgcgaagaggaggacatgaagactctcgatctgtccagaagtacgtagtgatgtgaggacttctcccagtcccagtgtgcacgtctgtctcgattacgcgaattaggagtgactatcggctgatgttgttaataaaacgtgtgtgggggctgccaaaaaaaaaataaaaaccgagaccctccagggtacccaatttcgccctatattgggtcgtttttacgcgccgctctttggccggtcgttttacaaccttcttgcctgggaatacccctgcgcgttaccaaccttacttcggccttggcgctcacttcccccttttccccagcgtgggggctatttcggcaaaagagccctgtctctgtatgctcctttcccaaatttatgttgcctccccttgcaaggggccaataggcatactggttaagcgccttatat

SEQ ID NO: 64576 - protein, 54 aa, Zea mays
  misc_feature: Ceres CLONE 1534451
  misc_feature (4)..(54): Pfam Name: UPF0057 Pfam Description: Uncharacterized protein family UPF0057
MASATFLEVLLAIFLPPVGVFLRYGCGVEFWIDLLLTVLGYIPGIIYAVYVLVA

SEQ ID NO: 64577 - DNA, 881 bp, Zea mays
  misc_feature: Ceres CLONE 1534453
  misc_feature: Encodes the peptide sequence at SEQ ID NO. 64578
  misc_feature (11)..(11): n is a, c, t, g, unknown, or other
  misc_feature (33)..(33): n is a, c, t, g, unknown, or other
  misc_feature (36)..(36): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
aattattattnttacttttcgttttgttgttgnctntnannnnttcatagctggagctccccgcggtggcggccgctctagaactagtggatcccccgggctgcaggaattcgtctcacccctagaaaaagtcaagacgggggcgccaaagtcatctccagcggcataaataaatagggaaaacaattattgaatgcattattaaaaggtagtaataagtttgttaagtattaactagctagttgccctctttgctctatatatatatatatatatactaggtgcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcaacaaatccccctttcgccagctggggtaataaccaaagaggcccgcaccgatcgcccttcccaacagtgtgcgctatccttgtatggcgaaatgtaaattgttaagcgctcaatatttctctataaaaattcgcgttaatatttttggttaaaatccagcccaattttttttaaccccaattaggcccgtataatccgggcgaaaattccccttattacatccaaataagaaataccacccgcagcattacggtgtagaagtggtgttttccccgatttttgcaagaaaagacgtcccagcttttctaaaacaaaacgttgtgacttctccaacctgtccaaagggtggaaaaaacacaccgttcttatttaggtgggcctaaggggccccacctactcttgaataactctcttcctcgccctctgaatcataggttttttctgggtggctccacaag

SEQ ID NO: 64578 - protein, 55 aa, Zea mays
  misc_feature: Ceres CLONE 1534453
  misc_feature (4)..(4): Xaa is any aa, unknown, or other
  misc_feature (11)..(11): Xaa is any aa, unknown, or other
  misc_feature (12)..(12): Xaa is any aa, unknown, or other
  misc_feature (13)..(13): Xaa is any aa, unknown, or other
  misc_feature (14)..(14): Xaa is any aa, unknown, or other
IIIXTFRFVVXXXXFIAGAPRGGGRSRTSGSPGLQEFVSPLEKVKTGAPKSSPAA

SEQ ID NO: 64579 - DNA, 928 bp, Zea mays
  misc_feature: Ceres CLONE 1534461
  misc_feature (11)..(11): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
gtgggtgtggnccgtgggggggcgagcgctcccggattttnnnnaaaatgtgaactccccgcggtggcggccgctctagaactagtggatcccccgggctgcaggaattcgtctcacccctagaaaaacctcgcggggctacgtgatcggcaagctcgtgcgggtgacgcacaaggtgcacgtgacgtgccccgtcgtcgtggacgccaagaagaccaagcccgtcaggttctccaagaaggcctgcgccgtgtacagggcctgaacttcaaatgcgttttcggaaagctgcgatccgacggcgcattaccaacgcccgtacgatgccctgcctgtatttagctatcgcgtttggtggtgaataacagtaagttgcacactccgtttggtgttcttttggtccttttgcgttctggcgaatgaaggggggggggacggcatttgctccttctttttttgggcccccccccccgggggggcgttacttgtcttttttacccggggttgcttatccccaacagtgcgcgcggtgcatgggtgttgctatgcggcccgctcctgtgcgtgcatcgcgttcgcctcatctgtctctcgttaggactgctgcaaatggggcatgcgcaatttgcgcccttccgtatctgcgctcgctccgtttctatactgtctccctctcagccggtcatgtactatgccgtcactcccgcagcctgtctacggtcactgcgcggagattagtgccgtgcctggctcgctcgcggtcgatccgatgtgcacggctgagccggcagtgatgtgctctgcgtctcccgtccctgccgtacttgtgctatttctgtgcctgaatcgttccgcttggtgaggaggatcgccgccgcgccgcgtcctgtcgcggactatcgcgttgcagccacggtgcggccggcgg

SEQ ID NO: 64580 - DNA, 642 bp, Zea mays
  misc_feature: Ceres CLONE 1534472
  misc_feature: Encodes the peptide sequence at SEQ ID NO. 64581
aaagctggagctccccgcggtggcggccgctctagaactagtggatcccccgggctgcaggaattcgtctcacccctagaaaaagtctccctctccagatccagatcgcgtagaagcagacgtccctgcatggcggttttcagatcgcgattcgtttctgagcttcgaggaatcgacggtcaagcttcggcgatcaagtgatctagctcttcgagttccacgaagttgaagaccctgagcatctgtttggtgaagatggctcgccttagacacactgcacgtaagtcagtgattcctttcctgccgtctcgacttgcggagcgtcctctgcaccgcaccgtgtccggacagtcgagtcacctggagaggctgcaccaccgcctgcgtgaggagcaggaatgccgacgccagcacggagagcagcagggctcttcctcctcaccccagcaggaggtggagaccgtgaggccccgttcctctgttgcccagctggaggcgccccttgtaccaccgtgggacgccccggctgttggaggagctactggaggagatcccgacgacgacgactcagaccacagtacggagtcctctgagccgcaggaggcggaaggatgggtcgcccgacccatcacccgtgacgcc

SEQ ID NO: 64581 - protein, 129 aa, Zea mays
  misc_feature: Ceres CLONE 1534472
MARLRHTARKSVIPFLPSRLAERPLHRTVSGQSSHLERLHHRLREEQECRRQHGEQQGSSSSPQQEVETVRPRSSVAQLEAPLVPPWDAPAVGGATGGDPDDDDSDHSTESSEPQEAEGWVARPITRDA

SEQ ID NO: 64582 - DNA, 870 bp, Zea mays
  misc_feature: Ceres CLONE 1534474
  misc_feature: Encodes the peptide sequence at SEQ ID NO. 64583
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
gtgtgttcctggggggnnnnnaaatctatatacattntnngggnnnnnnntaaaagtggaactccaccacggtggcggccgctctagaactagtggatcccccgggctgcaggaattcgtctcacccctagaaaaactccaatccaacgaactgaccacaactacctaagctaaaagctaaccaccgtacccccggccatggcgctcgcgcccacctccgctgccgagctcaagaccccgttcctcggggccaggcgcgcgctcgccaatcccgcgcctcgccccgcgctcgtcatcgccaccacttcctcccacaaaaaatcgttaaatcccggccatctaacaccgacgtcctaaaaccgacaatcccgcccctgcgatcttatttttcgaacccccagcgaacgttcacgtttccaacctttttttcccccccccctcggggggggggggggggggctctcctctctttatccccccactcccctcacccccccccccgggtcattaaatgacagtaaatcgcaccatccctatacacacccgaccattaccccaatcctccacactccacaccagattaagaatatgtggaaggcacttcttcgtcgtatgctccccccatacttcatctatgccataataacccctccattcttctgcattgtactaaactgctccaaactactgccatttcttttcgcttagtccgttacatatttttgtcccattaagcgcattaccaccactgccatctctactactacatcccgctccccaacacaccccactcacacgccctcacccctcaacatctttgtaccttcacatattaacatcactcattcacccttctcacccctccctcat

SEQ ID NO: 64583 - protein, 52 aa, Zea mays
  misc_feature: Ceres CLONE 1534474
MALAPTSAAELKTPFLGARRALANPAPRPALVIATTSSHKKSLNPGHLTPTS

SEQ ID NO: 64584 - DNA, 732 bp, Zea mays
  misc_feature: Ceres CLONE 1534481
  misc_feature: SWISSPROT Homolog: EC 3.2.1.23 Beta-galactosidase
gctcttaactagtggatcccccgggctgcaggaattcgtctcacccctagaaaaagcagtgggtccggatgaataaaacggtggtatgcgtgtgaagaagaagatgatgacgacgaaaaaagtgtgttggatcgagatgggccaacacagcgtagactagcttttgtatattatctcgtgttggaaatctggtgttgttaccctaaaatgttggtttctatcggtttgttgaaaacagtttgcgcgtgcttgctaaaaaaaaaaaaaaaaaagaaaaaaaaaaaaaaaaacgagacgctcgaggtacccaattcgccctatagtgagtcgtattacgcgcgctcactggccgtcgttttacaacgtcgtgactgggaaaacccccccgttacccaacttaatcgccttgcagcacatccccctttcgccagctggcgtaatagcgaagaggcccgcaccgatcgcccttccccaacagttgcgcagcctgaatggcgaatggaaattgtaagcgttaatattttgggttaaaatccgcgttaatttttggtaaatcagctcatttttttaaaccaataggcccaaattcggcaaaattccctttataatccaaaaaaatgaccccaaattgggtttgagtgttttttcccgttttgggaaaaagaatccacctatttaaagaagcggggaattcaaacgtcaaaaggggcaaaaaacccgtcttttctgggc

SEQ ID NO: 64585 - DNA, 665 bp, Zea mays
  misc_feature: Ceres CLONE 1534489
  misc_feature: Translation starting site: 345
  misc_feature: SWISSPROT Homolog: EC 3.2.1.23 Beta-galactosidase
  misc_feature (479)..(479): n is a, c, t, g, unknown, or other
aagctggagctccccgcggtggcggccgctctagaactagtggatcccccgggctgcaggaattcgtctcacccctagaaaaaataccaatgcaaacagagatctatacgtacgagtctgtataacgacgagtgatgtttgtatggatctacgtatgtaacaaggacctctcgtagcgcacaggcgcgcgttgggagattaattaggtacacaagctattaccacattctatatcactctcattgcggttaaaaaaaaaaaaaaaaacgagacgctcgaggtacccaattcgccctatagtgagtcgaattacgcgcgctcactggccgtcgttttacaacgtcatgactgggaaaaccctggcgttacccaacttagtcgccttgaagcacatccccctttcgcaagctggcgtaatagcggacaggcccgcaccgatcgcccttcccaacagttgagcagcctggaatgcgaatggnaattgtaagcgtttatattttgttaaaattcgcagttaacatattgcttaatcaactcatttttttaacccataaggccgaaaaccggcaaaaccccttataaattcaaagaataaaccgaaaaaagggttaaacggttgtcccaagttggaaacaaggatcccctatttaaaaaaccccggaccc

SEQ ID NO: 64586 - DNA, 713 bp, Zea mays
  misc_feature: Ceres CLONE 1534491
  misc_feature: SWISSPROT Homolog: EC 3.2.1.23 Beta-galactosidase
  misc_feature (320)..(320): n is a, c, t, g, unknown, or other
cataactggagctccccgcggtggcggccgctctagaactagtggatcccccgggctgcaggaattcgtctcacccctagaaaaaaaacggggaaacttaccaggtcccggccctttcgccgacaataatttctttcgccttgttcgttcaggcgctaccgccaccgccaccgctgtttactatagcaccagacctacggattgaattgttgtatggatttgtttggccaaatctttgttctgttgtaaagtaaggggagggattcctgcccctgcgcctgcttaaaatacttatatgaacatatcagtctttcttgttnaaaaaaaaaaaaaaaaaaaaaaaaaaaaaaaatataaaaaaaaaaaaaaacgagacgctcgaggtacccaattcgccctatagtgagtcgcattacgcgcgctcactggccgtcgttttacaacgtcttgactggaaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagg

SEQ ID NO: 64587 - DNA, 757 bp, Zea mays
  misc_feature: Ceres CLONE 1534495
  misc_feature: Encodes the peptide sequence at SEQ ID NO. 64588
  misc_feature (240)..(240): n is a, c, t, g, unknown, or other
  misc_feature (241)..(241): n is a, c, t, g, unknown, or other
  misc_feature (348)..(348): n is a, c, t, g, unknown, or other
  misc_feature (604)..(604): n is a, c, t, g, unknown, or other
  misc_feature (668)..(668): n is a, c, t, g, unknown, or other
  misc_feature (669)..(669): n is a, c, t, g, unknown, or other
  misc_feature (676)..(676): n is a, c, t, g, unknown, or other
ccaaactggagctccccgcggtggcggccgctctagaactagtggatcccccgggctgcaggaattcgtctcacccctagaaaaaactaaatcagtgttcgccatcgatgttatgcataggccacgctggatttctatgcttgttgacgtgaacgtgtttcgctcccttcatgtttaagcctaagcagcttgatgtgcttgtgccaaagactttttaagaactacgcaacaaaccaacgnncttacaatacgcttttgtatacaatgatcatctgcttgttgcaccgtacatgtatagtctatggagctgcagactgttagagttatgtaatgttgtactgatcaccngtttcgtaaactggcatgttacacctgtcctttttattagaaccagttgggggaaacctgggttctcccgcccaaaaaggaataaaaattatatcacgaatttggagaaccccttccaaaaaaaatggttttggggggtccccccccccccccacaaaaaaaattatataataaaaacacgcggagttcctctcgggagagaaaaccaaacaaaaaactgtccagcttattttaaagaagagtattgcttcatttntttatataaaagaagacccggttcacaaaggcaaaagagaaggaggggggcgattatactcttnnttttgtncttctcttctgtcgcgctgtgcaaaaaaaaaaaaatagggggcgactctacaataaaaacaaatattttgtaacgcgctag

SEQ ID NO: 64588 - protein, 58 aa, Zea mays
  misc_feature: Ceres CLONE 1534495
QTGAPRGGGRSRTSGSPGLQEFVSPLEKTKSVFAIDVMHRPRWISMLVDVNVFRSLHV

SEQ ID NO: 64589 - DNA, 736 bp, Zea mays
  misc_feature: Ceres CLONE 1534498
  misc_feature: SWISSPROT Homolog: EC 3.2.1.23 Beta-galactosidase
caagctggagctccccgcggtggcggccgctctagaactagtggatcccccgggctgcaggaattcgtctcacccctagaaaaatttcaatgttactagtagttctgaaagcaggtcatgctgtgtatcaaattccaatgcctgacatttgcgctgagtgtgggttgtcttttggctaaatgaagttttgcaccctgaatcttcattgaatgtgttgtgtgtttgtttgattttgttctgccattgccttagtctaaagcttgatcacaccgaggatggtttatgtaatgtaatggctgaatgaaatcccacagttcgcgcactgaattgttggagatgatattgcatatgaaatacatcgatcttgtaaggtcaaaagaggaaaaagaaaaaaaaaaaataaattaaaaataaccccccccttggaaaaaaaaaaaaataaacgagccgctcgaggtacccaattcgccctaaagagagtcgtattacccgcgctcactggccgtcgttttacaacgtcgtgactggaaaaaccctggcgttacccaattaaatcgccttgcagaacatccccctttccccagctggcaaaatagaaaaaagcccccaccaataccccttcccaaaagttgcccaccccgaaaggcgaatggaaattttaagctttaatattttgtaaaaatcccggttaaatatttgtaaaaccccctccttttttttacccaaaaggccgaag

SEQ ID NO: 64590 - DNA, 731 bp, Zea mays
  misc_feature: Ceres CLONE 1534500
  misc_feature: Encodes the peptide sequence at SEQ ID NO. 64591
ataagctggagctccccgcggtggcggccgctctagaactagtggatcccccgggctgcaggaattcgtctcacccctagaaaaaaaaaccctagccgccgccagaccattcgtttctcgcgagccatcgcttctgcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgttactgtatgatggcaaggaccttttgctgccgaaggttatgttttgaagttcatgctaccttttaaagtacggattaccttgtgcctatgttcattacctttgcctttggcagctaaatttggatttctggattgcgtctgtttttagactagttgcgttgcagggtaacctttttgagatgtggcttaatgttgacaaaaaaaaaaaaaaaaacgagacgctcgaggtacccaattcgccctatattgagtcgtattacgcgcgctcactggcccgacgtattaccacgtccttgactgggaaaaccctgggcgttactcaactttaatcgcccttgcaacaacatcccccttttcgccagctgggggtaatacccgaagaggccccccaccgaatcgccctttccacaacaggtttg

SEQ ID NO: 64591 - protein, 57 aa, Zea mays
  misc_feature: Ceres CLONE 1534500
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSRKGNKKSGVTV

SEQ ID NO: 64592 - DNA, 1524 bp, Zea mays
  misc_feature: Ceres CLONE 1534508
  misc_feature: Encodes the peptide sequence at SEQ ID NO. 64593
aagcaatttcaattgcaagttgcaacgcgacgaatacggagccatggacgacggcgccgcaaccacaatcgtccaaggcggcgacgcgcacgtcctgctcctgccgttccctgggatgcagggccacgcgaacccgatgctccagcttggccggcggctggccttccacggcctgcgccccaccttggtggtctcccgccacgtcctctccaccacctccacctccaggtcgtgccccatccccgtggccgccatctcggacggcttcgacgacggcgggatctcctcatgcccggacaccgcggagtacgtgcgccggatggaggccgcggggtcggagacgctggcggggctcctggacgccgaggcccgcgcggggcggcccgtccgcgtgctggtgtacgactcgcacctgccatgggcgcgccgcgtggcgcgggccgccggcgtggccgccgccgcgttcatgacgcagatgtgcgcggtgggcctcgtctacggcgaggcgtgggccgggcgggtggccctgccactggcggacggggccgcgctgcgcgggaggctcgccgtggagctgggccccgacgacgtgccgccgttcgtggcggcgcccgagtggtacccggcgttcaccgagtccgcgctgagccagttcgacgggctggagcacgccgacgacgtgctcgtcaactcgttccgtgacctggagccaatggaagcggattacctggagtcgacgtggcgcgcgaagaccgtcggcccgacactgccgtcgttctacctcgacgacggccgcttgccatgcgacaagacatacggcgtggacctcttctcgagcatcgactccgaggcggcgccgtgcatgacgtggcttgacaagcaggagccctgctccgtcgtcctcgcgtcgtacgggaccgtcgccaacctcaacaaggagcagctggacgagctcggcaacggactgtgcgattccggcaagcctttcgtttgggtgctgaggtccaacgaggcagagaagctgtctcgacagctcggtggcaggtgcaaggagaggggcctcattgtccccttctgtcctcagctcgaggtgctggcacacaaggccacaggttgcttcctgacgcactgcgggtggaactcgacgattgaatccatcgctagtggtgttccaatggtggcgatgccgcagtgggcggaccagccgacgacggccaagtatgtggagagcgcgtgggggattggggtgcgcatgcggaagggttccttggtgaggaaggaggtggagaggtgcataagggaggtgatgggcggggagaggaagcatgtgtacgggaggaatgccgctcgttggatgcacaaggccaaggaggccatgcaggaaggaggaagctctgacaagaacattgcagaattcgcagccaagtatttaccaaagtagatttccgattatgttctcctcggataatgagttttttgggcaataaagtttcttgtctttagggccaaaaaaaaaaaaaaaaa

SEQ ID NO: 64593 - protein, 465 aa, Zea mays
  misc_feature: Ceres CLONE 1534508
  misc_feature (15)..(466): Pfam Name: UDPGT Pfam Description: UDP-glucoronosyl and UDP-glucosyl transferase
  misc_feature: SWISSPROT Homolog: EC 2.4.1.121 Indole-3-acetate beta-glucosyltransferase
MDDGAATTIVQGGDAHVLLLPFPGMQGHANPMLQLGRRLAFHGLRPTLVVSRHVLSTTSTSRSCPIPVAAISDGFDDGGISSCPDTAEYVRRMEAAGSETLAGLLDAEARAGRPVRVLVYDSHLPWARRVARAAGVAAAAFMTQMCAVGLVYGEAWAGRVALPLADGAALRGRLAVELGPDDVPPFVAAPEWYPAFTESALSQFDGLEHADDVLVNSFRDLEPMEADYLESTWRAKTVGPTLPSFYLDDGRLPCDKTYGVDLFSSIDSEAAPCMTWLDKQEPCSVVLASYGTVANLNKEQLDELGNGLCDSGKPFVWVLRSNEAEKLSRQLGGRCKERGLIVPFCPQLEVLAHKATGCFLTHCGWNSTIESIASGVPMVAMPQWADQPTTAKYVESAWGIGVRMRKGSLVRKEVERCIREVMGGERKHVYGRNAARWMHKAKEAMQEGGSSDKNIAEFAAKYLPK

SEQ ID NO: 64594 - DNA, 824 bp, Zea mays
  misc_feature: Ceres CLONE 1534509
  misc_feature (215)..(215): n is a, c, t, g, unknown, or other
ccatgctggagctccccgcggtggcggccgctctagaactagtggatcccccgggctgcaggaattcgtctcacccctagaaaaagtaatccgtgagctcgtgcatgtacttggcgtattgcatgcagtgaataatttagcttgggtttgtttgttgggggcagtgttggggacggatttggattggggtttatgcttggcatcgcgtcgtatcnaaactcagctgctgtttcgctgagtaatgtacatttccctggtaatggtacttgtggactctgatgcttttaaaaaaaaaaaaaaaaatatattggattggcgcaaattatgcggtcagtatatcattccatatttataggacagaaaatataaccaacaaccgagggggggggggggggcccatttccccctaatataagagccccaataacgggggcttcacagagaccttcttttttaccaaccggccgggactgggggaaaaacccccgggcggtttcccccaaacttaaatccgccttttgccggcccaatccctcccctttttcccctcgggcttggcgccaaatatacctaaaaaaggcccccgccccccgaatctccccccttccccaaacaagttggtgtctatcctctataatgggcctaaatggaacatccttgaacggccgttaaacctattgtgcccaacaacttctcgcttaaaatccttgtccgtaagatacgccccctcctgtttcttacacctacaatgtggccacaagagcccccatcaaatccccgttaaaaacattcaaacgaaaaagcgctccggtaaccaagcccac

SEQ ID NO: 64595 - DNA, 794 bp, Zea mays
  misc_feature: Ceres CLONE 1534511
tagctggagctcaccgcggtggcggccgctctagaactagtggatcccccgggctgcaggaattcgtctcacccctagaaaaaagccatcccctcccgcggcaagtctctctgaattgtgggtctccggcgatggcggctctagctccatccaagattctgggcaccaagctcaacttcgccggctcctcccgataggccacggcagagcccaccgggggggcccaaaagatcgcctccctcttccgcaagaagcctgccaagaatccaagccctctgcgttctccccccacttaacaggaaatcaccgaccaccccccctattttttccaggtccctgacatgaagatacaccctgtttttttttttccccccccccccccgggggggggggggggggttattatcattaccccacactacccccccccggtaaattttttgtaccaccaactatctattttctttcttgtgagtaaagagagggggtagatataattcgactaatgtctacacactgcgacaaaccacccctatattccattgtctaataattcatcccttacatccatcatccccttccccaccctgcccgtctctcattctcgaccaaacgctcagcacattacccatatatcagataccaaacatctgcgattctctagaaaaaaaaagttgaacaaataaaattaatatatagtatattaaattagaaaaccacattttagcactacgtcttttctaggagctcctttccccccctcctccacactcccacctacaaccgactcctca

SEQ ID NO: 64596 - DNA, 751 bp, Zea mays
  misc_feature: Ceres CLONE 1534514
ggccgctctagaactagtggatcccccgggctgcaggaattcgtctcacccctagaaaaaaatacagcaggagtcctggctgtgagcaccctcatgtttcctcgcatgtgccgtttcgcacgagtgagtgaggttgcacgacgacaatcgatggcttccctgagggccggcgaagcccaacggatttcctgctcagggtgaaggagccggctcccaagctcatcgagacggcggacttaatccgtcagccgcgcaagagcagcagcgttaacaaggctagagcacaagccccgggaaaccagaaagaaggtgaaccaggaacaaacctgccgaggcggacaagaattgacttacacatcaagtggagtgtaatggagctcccatgcatgcatgagcggatccttcccctgttatgaatccagccctacctttcttgtgtcttccatgttacgccgacgggccttcccttcatgtgtgatgagtgccagatgaatactacaaataagacgttgtgactgtgccatcgtcccctccaacaataatattaaagaccacactctcccccgtacccaattcgcccttaaagcgagctcgtttgtacgcgcgtttaacaggccgctcgtattgacaaaaaaccctggcgggtacaaaacccttggtcgttcctcaaacttaaatcgccctttttaccaccatcccccctttttctccagttggggggtccttatccggaattaggcctcttcccacg

SEQ ID NO: 64597 - DNA, 672 bp, Zea mays
  misc_feature: Ceres CLONE 1534520
  misc_feature: Encodes the peptide sequence at SEQ ID NO. 64598
aagctggagctccccgcggtggcggccgctctagaactagtggatcccccgggctgcaggaattcgtctcacccctagaaaaaagggctgctccggcgctgcgggtgctcccgctcgcgctcgcagcggccatcttctcggggctcaccgccatcctcttctacctctccggcgtctcctcctcacatagcggctctcggctctcggaggcggacctggcggcgctcgccgcgctgcggggtggcttcagcaagtgcgtggatgcaaatgggctaggactgaaagccgtgaccggggaggactactgtcgtgttgtgatacaatacccaagtgacacagtttctaagtggagagatcctttctcccccaccgctgagaggggggggtgtgagttcaatctgtgtgaagctcccccctcatgggagcacgtccggaacagtacaacagtactcgcaaaggagtacattgatgctttgccaaatggctgggaggaatatgcatggagaacaatcaacaaaggaacccttctgaaaaagtgccagaacaaaagcctctggatgggaaaggtcccaccaatccctaccggagacaatcaccttaccgtccctcgccactttggaccaatggcctgatgttgggcaaattagggggtactttcttccaaaaccaaaa

SEQ ID NO: 64598 - protein, 209 aa, Zea mays
  misc_feature: Ceres CLONE 1534520
AGAPRGGGRSRTSGSPGLQEFVSPLEKRAAPALRVLPLALAAAIFSGLTAILFYLSGVSSSHSGSRLSEADLAALAALRGGFSKCVDANGLGLKAVTGEDYCRVVIQYPSDTVSKWRDPFSPTAERGGCEFNLCEAPPSWEHVRNSTTVLAKEYIDALPNGWEEYAWRTINKGTLLKKCQNKSLWMGKVPPIPTGDNHLTVPRHFGPMA

SEQ ID NO: 64599 - DNA, 839 bp, Zea mays
  misc_feature: Ceres CLONE 1534522
  misc_feature: Encodes the peptide sequence at SEQ ID NO. 64600
  misc_feature (1)..(1): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (38)..(38): n is a, c, t, g, unknown, or other
  misc_feature (46)..(46): n is a, c, t, g, unknown, or other
ntttttnnnnnnnnnnccttccctcacaccacaaaggnggggggantttcacatctgggactcacctcggtggcggccgctctatactagtggatcccccgggctgcaggaattcgtctcacccctagaaaaatccgctgcccgctccacctccctccatgccgtcggcttccctccgcctcgccgtcgtcggcgcgggcgcggcgggcctggttgccgcccgcgagctacgccgcgagggccatgcgcccgtcgtcttcgagcgcgccgccgccgttgggggcacttggctctacacgcctcccgccacgtcctccgacccgctcggcgccgcggtgacgcattccagcctctacacatcgctccgcaccaacctgccacgacaagaccatggtgcttcctccacttcccctttcgactgctggagaccgcggggccccgaagaccccccgcccgggtttcccgtggcacgaaagagggagcttcccgcctaccctgtaaagcatttccacccatctctggttcctaccatgattccaggttcgcgtcggctttacaagaacgtatagtgcctcatatgtcaaaccaggggatataccgcgaaggctaggggggccctgcccaccccctcaaggaaacttttctggttaataaatgtctaatctcgcccaacctaaagaaattatccttatgatggactctgttgttgtgtacttgataattatatcaactataccactaatgctctgaaacgatcacaacaattacatctctaactgtgtatataatttcttcttcgcacctaggagataccgtaataatgcgtttttacacaacaa

SEQ ID NO: 64600 - protein, 136 aa, Zea mays
  misc_feature: Ceres CLONE 1534522
MPSASLRLAVVGAGAAGLVAARELRREGHAPVVFERAAAVGGTWLYTPPATSSDPLGAAVTHSSLYTSLRTNLPRQDHGASSTSPFDCWRPRGPEDPPPGFPVARKRELPAYPVKHFHPSLVPTMIPGSRRLYKNV

SEQ ID NO: 64601 - DNA, 775 bp, Zea mays
  misc_feature: Ceres CLONE 1534523
  misc_feature: Encodes the peptide sequence at SEQ ID NO. 64602
  misc_feature (1)..(1): n is a, c, t, g, unknown, or other
  misc_feature (2)..(2): n is a, c, t, g, unknown, or other
  misc_feature (13)..(13): n is a, c, t, g, unknown, or other
  misc_feature (14)..(14): n is a, c, t, g, unknown, or other
  misc_feature (732)..(732): n is a, c, t, g, unknown, or other
  misc_feature (775)..(775): n is a, c, t, g, unknown, or other
nnggggtttctcnnccccccccgcccaggtgtgggtattcctatttttcaaactggaactccaccgcggtggcggccgctctagaactagtggatcccccgggctgcaggaattcgtctcacccctagaaaaatccaccagcagctgaggtcgtcggccatggcggagcgggagcagcaagagcaggtggctagcgacgacgcggcggagtggaagcaggtggcggagctgagggccgtcacccaggcccaggacccttcctgcaaggatgaggacgactacacgctccggcgcttcctccgcgcgcgggaccacaacatcggcaaggcgtcggcgatgctgctcaagtacctcaagtggaagcccgcggccaagccccacggcgccatcgcagcggcggaggtggcgcgtgaggcggcgcaggggaagctctacctgcagggccacgaccgggagggccgccccctcatctacggcttcggcgcgcgccaccacccggcgcgcagggacctcgacgagttcaagcgctacgtcgtccacgtccttcgaagacaccgtcggcgcgcctgccctcctcccccttccgggtagatggtccgccaggtaaaagttccgccgcccgtcgccctaccctcggccgggctgggggcttacggccaaactgcgtaattccgaaggcttaccctgggctcagcgcctcgaacattcttgccaagaagcttacctatcacngtgaaagcggcccctcggccccggcgattctctccctacggtn

SEQ ID NO: 64602 - protein, 143 aa, Zea mays
  misc_feature: Ceres CLONE 1534523
MAEREQQEQVASDDAAEWKQVAELRAVTQAQDPSCKDEDDYTLRRFLRARDHNIGKASAMLLKYLKWKPAAKPHGAIAAAEVAREAAQGKLYLQGHDREGRPLIYGFGARHHPARRDLDEFKRYVVHVLRRHRRRACPPPPSG

SEQ ID NO: 64603 - DNA, 906 bp, Zea mays
  misc_feature: Ceres CLONE 1534528
  misc_feature (20)..(20): n is a, c, t, g, unknown, or other
  misc_feature (21)..(21): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tttttttttttttccctttnnttcttnnnnnnnnnnngggtaannnnnnntaagatggtgctccccgcggtggcggccgctctagaatagtggatcccccgggctgcaggaattcgtctcacccctataaaaatcacccgcgtccgccaccgccgccgcctttcgtaccgcggcccctaaacccctttcctcgttcccctccgtctctcagttagggacggtgatgctagctaataagcttggcggtttgctccaaaatgcttccaattctaagagttgctatatgtctgtcctccccacaatcacatgcctgtcttcatccttccttttttgttgccggctttcttatgggaacccataattcacagtcttttacttgagttttgccccacatcggaccacggcattttttttttttccccccccctctgggggggggggggggggggggtgtctcttttgtttttctccccttcatctactttacttccgtcctttcgcgaaaggacgagttttcctttgcgggccgcctctgggcagatgggtactgtatcactaacctcctttctcattgtggccctcttatttttgcctcttagtctcttcagtgtatggtgttatcacttatccctacgcactatctctttttgtgagttccgaaggctcaattaggataagtagtattttcagtgcgaggtccgttccctactctctctcccccccctctctctctcgtttgcccttcctccatattgttattgtcgtgtgttgtgtgtatggggataagtgataggagaagaatgtccgcggctaatctttgtggcttgtttcacgccaagatggctcacttgccattcgtctgaactattacacatattcttcattctatcctctctgtatcgcccg

SEQ ID NO: 64604 - DNA, 770 bp, Zea mays
  misc_feature: Ceres CLONE 1534529
  misc_feature: Encodes the peptide sequence at SEQ ID NO. 64605
  misc_feature (14)..(14): n is a, c, t, g, unknown, or other
  misc_feature (20)..(20): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
gtttttttttgtgngggggngatgatagaanncantaaaccccaatgtgtaaagctggactccccgcggtggcggccgctctagaactagtggatcccccgggctgcaggaattcgtctcacccctagaaaaaaaggaccaacgtgctcgatctccatctcgaccgtcgctcaccgggaagctacgctacgacgaagcatggcgtccgtcaccgcccgcgccccggtcgcagccctgcgcccgtcgtcgtcgtcggccttccttggccactctagccgcctcggccgcactgctaccgcgtcgccgactaggcgcagcctcaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaacaaagccgggctgatcaacgcgccgcaatggtacgacgcctgccagtccgagtacttcgcgtcgttcgtacaaagctgttctgtgatcacactctcatcctgtttccccctcgtggaaaaatccgcgcccgtggggcaggtccatccaaagaacccccccggtaaggaggtcacaacccaggaatcaccccagtccttccaaaaaggcttaacaaggccctggcgccgccccgccaccatatagtg

SEQ ID NO: 64605 - protein, 189 aa, Zea mays
  misc_feature: Ceres CLONE 1534529
  misc_feature (54)..(171): Pfam Name: Chloroa_b-bind Pfam Description: Chlorophyll A-B binding protein
MASVTARAPVAALRPSSSSAFLGHSSRLGRTATASPTRRSLKAEAKGEWLPGLPSPAYLDGSLPGDNGFDPLGLAEDPENLRWYVQAELVNGRWAMLGVAGMLIPEVLNKAGLINAPQWYDACQSEYFASFVQSCSVITLSSCFPLVEKSAPVGQVHPKNPPGKEVTTQESPQSFQKGLTRPWRRPATI

SEQ ID NO: 64606 - DNA, 759 bp, Zea mays
  misc_feature: Ceres CLONE 1534536
  misc_feature: Translation starting site: 288
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
tttgttttctcccccgccccccccccgcgctccccnntttacatntttttgtcaagctggagctccccgcggtggcggccgctctagaactagtggatcccccgggctgcaggaattcgtctcacccctagaaaaagttctgaattgtgatcgagacgagacccttcgaccttcgcaacgcctccccagcaacctctgctccgccgcctccggcgaccgccggaacccgtggtggaggaggacgtggagagggaagatctcgccagatccaaggaggtggggacaagatggtgagctcctcgtcgtcggtggttaacgtgtacccgctcgccaactacacgttcggcaccaaggagcccaagatggagaaggacacctccgtcgccgaccgcctcgctcgcatgaaggtcaactacatgaaagaaggaatgcgtacaagtgttgaagcaatcctattggtgcaagagcacaaccaccctcacatacttgctcctgcaaatcggaaatacattctgcaaacttcctggtggacggttgaagcctggagaaaatgaaatcgaatgtttgaaaagaaagttgtgccaacaaacttgctgggaaactcggccttccttttcccccctaactggcaagggttggaaaagcggggttcgcttgtggtggatgggaggccccaaaatttttgagcacctgtggattggtttcccctttaaccgggccccttcccccatttattcattcaaaagccccccaaggcga

SEQ ID NO: 64607 - DNA, 705 bp, Zea mays
  misc_feature: Ceres CLONE 1534537
  misc_feature: Encodes the peptide sequence at SEQ ID NO. 64608
atagctggagctccccgcggtggcggccgctctagaactagtggatcccccgggctgcaggaattcgtctcacccctataaaaagacgctcgacgcctctcctcctctcctcccccatccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcggccgcgggttggtggagtacatcatttccggccccccgctggcgatggtgtgggaggggaaggacgtcgtgttgactggccgcaggatcattggggccaccaggaccttgggaggcagccccccggtaccatttcgtgggagactactccttgggaaattccgagggtaatgtcctcccttggaaacgcgactctcctgcgaaaacgggtaaaataggataatcttcctctctgggtttcccttgaaaggtggtgggccccgtgcggcaataaggccgcccctttccgcccacctggaagtgtaaccaaagcgcttggaaccaatg

SEQ ID NO: 64608 - protein, 113 aa, Zea mays
  misc_feature: Ceres CLONE 1534537
  misc_feature (2)..(106): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFEKKGFYLKGMKFMNVERSFAQQHYADLSDKPFGRGLVEYIISGPPLAMVWEGKDVVLTGRRIIGATRTLGGSPPVPFRGRLLLGKFRG

SEQ ID NO: 64609 - DNA, 660 bp, Zea mays
  misc_feature: Ceres CLONE 1534538
  misc_feature: Encodes the peptide sequence at SEQ ID NO. 64610
ggagctccccgcggtggcggccgctctagaactagtggatcccccgggctgcaggaattcgtctcacccctagaaaaagatggcgtcctcctccctcccggcgcccgcggccggccgcgccgagctcctcaaggccttcgacgacgcccgcacgggcgtgcgaggcctcgtggagtcgggcgtctcgtccgtcccggagctcttccgccacgcggacccctacgcctccatcccgctcgccccgcccggcgtttccatccccgtcgtagacctctccctcccgccccacctcgccgccgcggccgccgcggccgccgcccgcacctggggcttcttccacctcgtcaaccaccaccacgccctccccgcggccgccgccgcggccgccgccgccgactactaccccgagcgcgccttcgcggcggtgcgcgccttcaacgaactccccgcacgcgagcgcgcgccgcactacagccgcgccgtggacggcggggtcaactactcttcccacgtcgacctgtacaactcccccgcggccagctggcgcgacaccatccagatcctgctgggccccaaccgccacccggaccttcgcgaccggatcccggccgcctggccgcgccgaggtgctccgagggggaggtccgctccccccgccct

SEQ ID NO: 64610 - protein, 193 aa, Zea mays
  misc_feature: Ceres CLONE 1534538
  misc_feature: SWISSPROT Homolog: EC 1.14.11.20 Desacetoxyvindoline 4-hydroxylase
MASSSLPAPAAGRAELLKAFDDARTGVRGLVESGVSSVPELFRHADPYASIPLAPPGVSIPVVDLSLPPHLAAAAAAAAARTWGFFHLVNHHHALPAAAAAAAAADYYPERAFAAVRAFNELPARERAPHYSRAVDGGVNYSSHVDLYNSPAASWRDTIQILLGPNRHPDLRDRIPAAWPRRGAPRGRSAPPA

SEQ ID NO: 64611 - DNA, 710 bp, Zea mays
  misc_feature: Ceres CLONE 1534543
  misc_feature: Encodes the peptide sequence at SEQ ID NO. 64612
caaagctggagctccccgcggtggcggccgctctagaactagtggatcccccgggctgcaggaattcgtctcacccctagaaaaaaactcgctctcactttactcctatccactgcggcctggacgcgtgcgagagacttgacaaagcagcagcagggatggcgcctctgaagctgtacgggatgccgctgtccccccgccgccctcctcctcggcttgacctcgccttgcgctgcctgggtcgcggatgcgtcggagccccgagtcgaataaaagaggccgcatcctgtcttgcatttgctgctgcgccatgtgctataacagcctgtgtaataaacactgttgctttaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtg

SEQ ID NO: 64612 - protein, 91 aa, Zea mays
  misc_feature: Ceres CLONE 1534543
  misc_feature: SWISSPROT Homolog: EC 3.2.1.23 Beta-galactosidase
MCYNSLCNKHCCFKKKKKNETLEVPNSPYSESYYARSLAVVLQRRDWENPGVTQLNRLAAHPPFASWRNSEEARTDRPSQQLRSLNGEWKL

SEQ ID NO: 64613 - DNA, 736 bp, Zea mays
  misc_feature: Ceres CLONE 1534544
  misc_feature: SWISSPROT Homolog: EC 3.2.1.23 Beta-galactosidase
atagctggagctccccgcggtggcggccgctctagaactagtggatcccccgggctgcaggaattcgtctcacccctagaaaaaaaaaacaacaggtaatacagattgaacgtgtaaactctgtccttaacatgtttctcggatacctttacctggttatcgatgtaatattatcaatttaatgagtgaaaacgctgtgccttactttatgctgagctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaaagaacgtggactccaacgtcaaagggcgaaaaaaccgtctatcagggcgatggcccactacgtgaaccatcaccctaatcaaagttttttggggtcgaaggtgccttaaagcactaaaatcga

SEQ ID NO: 64614 - DNA, 883 bp, Zea mays
  misc_feature: Ceres CLONE 1534552
  misc_feature: SWISSPROT Homolog: EC 2.4.1.207 Xyloglucan:xyloglucosyl transferase
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
aaaaaaaatattatagcattttaaaggggannnnnnnctctaanagctaaaactggaactccccgcggtggcggccgctctagaactagtggatcccccgggctgcaggaattcgtctcacccctagaaaaacatgcactacaactactgcgacgacggctggcgcttcccgcagggcttccccgccgagtgctcccgcaactgattcattggtttgtttgttatccccgatccgttcgcgcggtcgccgtccgtcccacacagtgccctgccctgcccccccgacgatttcttgcttcctgttcctcatctaattaatcatcaatggtgtttgttcgtcaccgctgttcttgatggatggatgcacaggacatggcatgacatatgttgttgtctttccattccatgtacattttgccgcacatttatacactactaagttgccccttgaatgttttttttctaaacagattgtatgaaaaattacatataagtaggaacacaaacaatacaaatatccagtctcctctctagggataccccaatttccccccttattaggtggaactccgtatttaacgccgcatcctccactcggtcccgttcagattattaaaataccctctatataccatgtggaaaaaaacccatcggccagatcaccccaaatcttcaaacccactcttgtcgacgcaccttccccccctcttttcctccacgactgggttattaatatagaccaaaaaaaggccccctctaaccataatcgcaccctttttccaacaatatttttaccatcaacctcttgaaattggctgtaattgtgaaattcctctatgaccctctctattttacttcgctctaactctcctccacttaaaat

SEQ ID NO: 64615 - DNA, 743 bp, Zea mays
  misc_feature: Ceres CLONE 1534553
  misc_feature (435)..(435): n is a, c, t, g, unknown, or other
cacccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttgggaatgcagcccaaatcgggcggtaaactccgtccaaggctaaatacaggcgagtttaccagaacggcaaggagtttctcattntaaaaaaaaagaaagaagatgaaaggagcccgttatgaacgctgtcagaaggaaaaaataaaaaaaaaccgagacgctcgaggtacccaattccccctataggggagtcgtattacgccccgctcactgggccgtcgttttacaacgtcctggactggaaaaacccttgggcgttacccaacttatatcgccttggcagcacttccccccttttcgccaggtgggggtaatagcgaaaaaggcccccccccggatcccccctttcccaaaatttggcccaacccggaatggggcaaatgaaaaattgt

SEQ ID NO: 64616 - DNA, 777 bp, Zea mays
  misc_feature: Ceres CLONE 1534558
  misc_feature: Encodes the peptide sequence at SEQ ID NO. 64617
  misc_feature (777)..(777): n is a, c, t, g, unknown, or other
aaaagctggagctccccgcggtggcggccgctctagaactagtggatcccccgggctgcaggaattcgtctcacccctagaaaaagtgttctcgactcgaccgccgccgtcccagttcgcttcgcgtcacccagagctcgtcggcctccgtccccgcgagaagcgagagcatggacacccaggtgaagcttgctgttgtggtgaaggtgatgggcaggaccggctccaggggtcaggtgacccaggtcagagtgaagttcttggatgaccagaaccgtctcatcatgaggaacgtcaaggggcctgttcgtgagggtgacatcctcacccttgctcgagtctgagagggaggccaggaggctgctctgaaccccttggggggcggtgggagggattctgttaattttgttcaatgtcccccccaacttggcgtggggaccttcacaacctcctgcgttgaagatttcctcctcttgggattgcactttttatttcgaaggccaaatatataaatatagaccgctcggatggtacccaattgcgccctattttggattctgatgtgtggcgcgccgctctgtgtcgtctatgttcgcaccctcgttgtctcgcgaatatcctcctggtctttctccagcaggtttcgctttgggggaggatgttcatctttcctcctcggccggggtctttctccccaaaagctctccacccggtttccgctctctgcgactgtctggtccctctctataggtctaagtcgcaatcgtggcgctagcn

SEQ ID NO: 64617 - protein, 57 aa, Zea mays
  misc_feature: Ceres CLONE 1534558
  misc_feature (1)..(58): Pfam Name: Ribosomal_S28e Pfam Description: Ribosomal protein S28e
MDTQVKLAVVVKVMGRTGSRGQVTQVRVKFLDDQNRLIMRNVKGPVREGDILTLARV

SEQ ID NO: 64618 - DNA, 681 bp, Zea mays
  misc_feature: Ceres CLONE 1534560
  misc_feature: Encodes the peptide sequence at SEQ ID NO. 64619
  misc_feature (390)..(390): n is a, c, t, g, unknown, or other
aaagctggagctccccgcggtggcggccgctctagaactagtggatcccccgggctgcaggaattcgtctcacccctagaaaaattccatccagatcatatgtcatccgaagagacgatgaaattggagctccaagggtgagggatgagttcaagatgtccgagaatgactgtgggtctgcacgagttcaaattgcacaactgactctgaaatcaagcatctgtcagctgttctcacaaaagataacttctagaagggcttcggagatggccaaaaaaaaaaaaacgagacgctcgagtacccattcgcctatagtgagtcgatacgcgcgctcactggcgtcgttttacacgtcgtgactggaaaaccctgccgttaccaacttaatcnccttgaacccatcccccttttcccaacttgcctaaaaaccgaaaaggcccccacccaattgcccttcccaaaaatttccccaccctgaatgggaaagggaaattttaaccgttaaattttttgtaaaaaatcccggtaaaaatttttggtaaaacccccctttatttttttaccccataggggcgcaaaaactgggaaaaatcctctttttaaaaacaaaaaaaaaaaccccccaaaagagggggggaggggggttttcccccccttggaaacacaagagcccctcttttt

SEQ ID NO: 64619 - protein, 67 aa, Zea mays
  misc_feature: Ceres CLONE 1534560
MSENDCGSARVQIAQLTLKSSICQLFSQKITSRRASEMAKKKKTRRSSTHSPIVSRYARSLASFYTS

SEQ ID NO: 64620 - DNA, 907 bp, Zea mays
  misc_feature: Ceres CLONE 1534562
  misc_feature: Encodes the peptide sequence at SEQ ID NO. 64621
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (37)..(37): n is a, c, t, g, unknown, or other
ggggggcgaggtattctttttaaccnnnngaacaccncctcaaagctggagctccccgcggtggcggccgctctagaactagtggatcccccgggctgcaggaattcgtctcacccctagaaaaatatcatagttccaaaattgttgttcccggttgtcttcgttcctgttctgttttgcttccgtcttccatgttcctgtgtcgtaccatgaatgatggttcaatttagtgggtttaggcataacaagctgcttaattatgcagcggtaaaagtggcattttctgcatctgaatgtgatactctgcactgtctccatcctttgtggaattgcagagatcctgtctccaatgcccctccaagttgtgaactgaagaaaaaaaaaatatagcgagacgcctctaggtacccctattctcccctatagttgagtcgtattacccgcgttttcactgttcccccccccctcacaactaacatgccccgcaaaaacccctgtgcgttaacacatctataatcgcacttgaaagaacttccccccttttccccctcactgggggtaataacctaaatagggccctccacccgatacctccctttccccatctgattggccccctccctttaaatggggcaaatatggaataatttgtaaaccctgtaaatcatttttgtttaaaaactttccccgctaacaattttgtttggcctaagacaagactccattgctgtttacgccacacgagaggctgacaatatcggcacaaatattcctctattgtttatcctaaaatataattgtatcctgaaatcaggcgtgtcgagctcgtctgtttccccacctttgtacaaaccaagagaccctccctatttataaaacactccctgtcgatctcctcgcgccttgt

SEQ ID NO: 64621 - protein, 39 aa, Zea mays
  misc_feature: Ceres CLONE 1534562
  misc_feature (9)..(9): Xaa is any aa, unknown, or other
  misc_feature (10)..(10): Xaa is any aa, unknown, or other
  misc_feature (13)..(13): Xaa is any aa, unknown, or other
GGRGILFNXXNTXSKLELPAVAAALELVDPPGCRNSSHP

SEQ ID NO: 64622 - DNA, 690 bp, Zea mays
  misc_feature: Ceres CLONE 1534568
  misc_feature: Encodes the peptide sequence at SEQ ID NO. 64623
tcccccgggctgcaggaattcgtctcacccctagaaaaatttatggcacatccacagatacaactctttgaatgggcagcctgatattttgcggtcattatattctgcactccaaccatctaatactttggaagatcgaagatatcatgatgcccgtctttctgatcagcagatggcgttacttcagtaccaaagagagaatatccattatctgagtgaggaggttctccgcttgcaagaatgcttaagcaaataccagagaactgctggaaccactcctcaggttgatcttgcccatcttttagcaactcgtgatccagaactccgagcactcactgctgagatgaaatccaagtgcactcccaacttcaacatggcccgtggtttgatcgatgaaaaggattcagagctccagcgtatccgtctgagcaacaaccagtatgttgatgaaaacgataggctcaaagctatttctcggtgaatggagtgctcgagcccgcaaagagcgggtggtcaaactccgcattgaggaaaaaaaaaaaaaaaaacgagacgctcgaggtaccccaattccccccaagagaagggcgtatttacgggcgccattcacgagtcgaccttttaacaccgctgtgacgggggaaaaaccctggggggtaccccaatctgaattccccttggtcagaactt

SEQ ID NO: 64623 - protein, 102 aa, Zea mays
  misc_feature: Ceres CLONE 1534568
MALLQYQRENIHYLSEEVLRLQECLSKYQRTAGTTPQVDLAHLLATRDPELRALTAEMKSKCTPNFNMARGLIDEKDSELQRIRLSNNQYVDENDRLKAISR

SEQ ID NO: 64624 - DNA, 963 bp, Zea mays
  misc_feature: Ceres CLONE 1534569
  misc_feature (40)..(40): n is a, c, t, g, unknown, or other
tttttacacgctgattttgattttgagcttaggagcaaantttttcaataactggagctccaccgggggtggctggccgactctttaactagatggatccccctgggctgcaggaattcgtgctcacccctatgaaaaattttaggaaaggtcacaggcgtttttattctcattctatattatatttcagtgctggactaatgattgagatctccatatgtaatctacgtcataaacatttttcattcgcagttgaccatgtgtggtcaattgtggatatttgtttcattggatgattaacatgatttgaaccatatgcaattgagtgggcacttgtgtacgagaaaatcgcaaaaattgccagaatgaatgtgattcaacttatttcatataaccctatatcactgtgcgcgctactaatcggtcggtttcacctgatgcgggaattttatcgcgttaatggcttcgtgggcctgtggaaaatgattgaagccaatatgcgataccacccctgtggttcaatcatagagaacaatggcggataccttaagggaaactagagttagcttcccgagagttttaatgttttgcgtcatattcgtagcgacttgcccaaattgggagcaatttggacgatgactatactgctttgcaggaaggtaactgcgtcgaagattcacgatcgaatattcttgactttttgtttcgaaacgggatatcgatcatgaaatataagcgagagcagcacaaaggtacacccaagttgccccctctatatggggaacgagatagtaattgtgcccgcttcccctgatgccggtgttatttttataatggttcttgaaatagatggatagaccccgttgaacgattcccaactacttaatattccgcctattctatcgaacattcccggcccttgtctccctagctacgtacagttacataccctaatgaaacctc

SEQ ID NO: 64625 - DNA, 744 bp, Zea mays
  misc_feature: Ceres CLONE 1534571
  misc_feature: SWISSPROT Homolog: EC 3.2.1.23 Beta-galactosidase
atagctggagctccccgcggtggcggccgctctagaactagtggatcccccgggctgcaggaattcgtctcacccctagaaaaagctcttcttcccaccgcgttcaggctccgcccgacgcccgacaccaacgaagccctccacaaaaaacggcacgcaactgtctccatctccatcggtgccaccgtccgtcctccgcgtgtctgacgacccgagcttggtgtttgacaaaatgtccatgtcgtctatcatggtcgtgtcatgcccagcgttcggagatcgtgctcacctactgcagctaatcgtataaagcgactttagctttcgtctgggaacaatttgttttttagttctcaatgtcaaatggtaggatgttggcgggctagaggatgtgaaaaggattcttctagatactattctggtaaattggacttggtttagcagtaaatatcagcaacaccaatacgacgctcaattataggtaaaacaagtgttttccctacaatagtttaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaa

SEQ ID NO: 64626 - DNA, 693 bp, Zea mays
  misc_feature: Ceres CLONE 1534577
  misc_feature: Encodes the peptide sequence at SEQ ID NO. 64627
  misc_feature (19)..(19): n is a, c, t, g, unknown, or other
  misc_feature (20)..(20): n is a, c, t, g, unknown, or other
  misc_feature (41)..(41): n is a, c, t, g, unknown, or other
  misc_feature (206)..(206): n is a, c, t, g, unknown, or other
  misc_feature (236)..(236): n is a, c, t, g, unknown, or other
  misc_feature (357)..(357): n is a, c, t, g, unknown, or other
  misc_feature (640)..(640): n is a, c, t, g, unknown, or other
  misc_feature (641)..(641): n is a, c, t, g, unknown, or other
  misc_feature (661)..(661): n is a, c, t, g, unknown, or other
aagctggagctccccgcgnngtggcggccgctctagaactnagtggatcccccgggctgcaggaattcgtctcacccctagaaaaagactgggactgagaagaaacctccaaacacctacctctctacgaactacctgccgccggaaaaccctagagcgctcgaccatggatccgcagcagccggagcctgtcagttacctctgcnggagattgcgggagctgagaactaccctgnaagcccggaagatgtcctcccagtgcccgtgaatgtggcctacccgcatccctcttacaaaaaagcgggacccccgccggaattggcccataatgaaaagcgcccgcccttttaaaaaaanttgggtaaaaacacaggggaaaaacccctggaaaaggggtgtgttcttaatccccccccccttttccccgtggggaaaaacactcttttggggggggggaaaaaaaaaaaaaagtgccccaacctataaactttttgtgtttcccggggggccccccctcttaaacccccggggggggatatttttttttaccccataagggggggggggagaaatatttttaaaaaaaaaaaaaccaccctcctctaaaaaaaaaaaaaaaaaaaaaacaaaggtggggggnnccgctgagtggggggccccnacattcctcccccttatagagagggggggggt

SEQ ID NO: 64627 - protein, 33 aa, Zea mays
  misc_feature: Ceres CLONE 1534577
  misc_feature (14)..(14): Xaa is any aa, unknown, or other
  misc_feature (24)..(24): Xaa is any aa, unknown, or other
MDPQQPEPVSYLCXRLRELRTTLXARKMSSQCP

SEQ ID NO: 64628 - DNA, 855 bp, Zea mays
  misc_feature: Ceres CLONE 1534579
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (84)..(84): n is a, c, t, g, unknown, or other
ggggcgtgtgtttttgttaggtttgtgcccccgnnnggnnnnnnnttaaaactggagctccaccgcggtggcggccgctactgnactagtggatcccccgggctgcaggaattcgtctcacccctagaaaaaaggctaggtgaaggagaggctgggcggcgcggcgggtaagatgtttgacgattaagacctgggcttctttgctgatttcctgggaatattcgtctttgtcttggttattgcataccacttcgtggatggaagacgcgaagttccaaggaaactgatgtcctctagtgcagggatcctatgatctgctagccgaaattgggctatactgtccgctaatgctttggagatctcctggcccttgaagtggctattatggcaagctggacttgcaactcctgggaattttggtaatggaccttgttttaatctggctggattactagaatccgtggcccctgttcctgtgtctgatgttgagcttcgggaccctttgctttatctctctttctcccccttgttgggggttcttcatttgtcccggtgcttatcttggcctttcccgttttcttacgtgctgtatgctggcggtaactctcccgtgcttttagtcccagttctgtctccgccgtattgttgtcacttaccctcatttttccctacctcggtgttctttgctcgtttcatattagctcgtcttctactgtgccctcttctctcctctgttttcgtccttcttggttacagtctctacttggaggtttttgcctgtctctctcttcttcttggctgcagaagcctctactttcgcctagttcttcatacgaatataccattgcagaagat

SEQ ID NO: 64629 - DNA, 909 bp, Zea mays
  misc_feature: Ceres CLONE 1534580
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
tttttttaaaaattacctccccccccnnnnnnntggnnnnnnnntaaaactggagctccccgcggtggcggccgctctagaactagtggatcccccgggctgcaggaattcgtctcacccctagaaaaaacgaagaaaaaaaaaaaaaaaaattcaacaaaagacagaaacaaatccactattggttttacgtcaagcaatacgtagagtaactcccaatataggagtaaaaacaagacgtactaaaaaaggatcgacgcggaaagttccgattgaaataggatctaaacaaggaagagcacttgccattcgttggttattagaagcatcccaaaagcggccgggtcgaaaatatggctttcaaattaagatcccaattagctagaagctgcccaaagggagtggtgagtcccctacgcaaaaaggggagcgacccaaacaaatgccttgagggcaaacaacaacccttgggacaattatccacataacccaatgacacaaaattccaagggataggtgaaacccactggtatcccaaacagtctcgcttctcgaaaaagaaaactccatatttagaggagacaatccggcacacgagattcttttattctctcaaaacgtaaaaccacgacactaaatataaatagccctctagccctcacggacaaaaatcacttatagatcacccgccaaagcgtggtagctctcgctaatattacacgccgcactaaaaacaagaggccccgtgccgcttacctacaccccttcctctataactcctgagcacaacagtcgtcacaatgtcatttacgcaatatacatcctatcagcacaaatcatagataatacagtatgaccgctctctcgctgacagtaggtctccatatccataactaaacattatgaaaa

SEQ ID NO: 64630 - DNA, 698 bp, Zea mays
  misc_feature: Ceres CLONE 1534582
  misc_feature: Translation starting site: 241
  misc_feature: SWISSPROT Homolog: EC 3.2.1.23 Beta-galactosidase
tcccccgggctgcaggaattcgtctcacccctagaaaaaagatgtttcaacctcccatctgctagctatgatacagatggtcccctgataataatgatgacatattctgtgatggaaaaaaaaaagtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaaaaaaaaaaaaaaaaacgagacgctcgaggtacccaattcgccctatagtgagtcgtattacgcgcgctcactggccgacgtttttacaacctcgtgactgggaaaaccctggcgttacccaacttaatcgccttgcagcacatcccccctttcgccagctggcgtaataccgaagaggcccgcaccgatcgcccttcccaacatttgccgcaccctgaaatggccaaagggaaattgtaagccgttactattttggctaaatttcgcctttaaatttttgttaacacc

SEQ ID NO: 64631 - DNA, 736 bp, Zea mays
  misc_feature: Ceres CLONE 1534588
  misc_feature: Encodes the peptide sequence at SEQ ID NO. 64632
atagctggagctccccgcggtggcggccgctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgtgtgccgaaaaaaaaaaaaaaaaacgagacgctcgaggtacccaattcgccctatagggagtcgtattacgcgcgctcactggccgtcgttttacaacgtcgtgactgggaaaaccctggcgttacccaacttaatcgccttgcagcacatcccccctttcgccagctggcgtaatagcgaaaaaggccgccaccgatcgccctttccaacagt

SEQ ID NO: 64632 - protein, 63 aa, Zea mays; identical to SEQ ID NO: 28299
  misc_feature: Ceres CLONE 1534588

SEQ ID NO: 64633 - DNA, 744 bp, Zea mays
  misc_feature: Ceres CLONE 1534599
  misc_feature: Encodes the peptide sequence at SEQ ID NO. 64634
  misc_feature (36)..(36): n is a, c, t, g, unknown, or other
  misc_feature (37)..(37): n is a, c, t, g, unknown, or other
tttttaaataaataatcgaaaaaacaaagaaaaaannatatttaaaaaattaaaactgggactccacgcggtggcggccgctctagaatagtggatcccccgggctgcaggaattcgtctcacccctagaaaaaagtagtcctctcctcccatccatctcatgcttcggtccacgcacccacccagccccaccagcggcagctccgcggcgccggcgtccagctccgacgccgcggcgatggtcgggggcggcgcggcggcgggcagcggcggcgcaccgagcggcgccaagctgctgcagatcctcaacgtgcgggtcgtgggcagcggcgaccgcgtggtggtgctgtcccacgggttcggcacggaccagtcggcgtggagccgcgtgctcccctacctcacccgcgaccaccgcgtggtgctctacgacctcgtctgcgccggcagcgtcaacccggagcacttcgacttccgccgctacaacacgctagactcgtacgtcgacgacctcctcgccatcctcgacgcgctccgcatcgcgcgctgcgccttcatcggccactcccgtctccgcccatgaatagggaatccatcgcctccatcccgccggccccgaagtttttccgccaaagcttggaaaactatcggggggcagtaaccccaaggtttccttggaacagaacccagaaaattaaccacgggggggggtgtccgaagctcttgcccgaaagaattcacacg

SEQ ID NO: 64634 - protein, 114 aa, Zea mays
  misc_feature: Ceres CLONE 1534599
MVGGGAAAGSGGAPSGAKLLQILNVRVVGSGDRVVVLSHGFGTDQSAWSRVLPYLTRDHRVVLYDLVCAGSVNPEHFDFRRYNTLDSYVDDLLAILDALRIARCAFIGHSRLRP

SEQ ID NO: 64635 - DNA, 494 bp, Zea mays
  misc_feature: Ceres CLONE 1534600
  misc_feature (172)..(172): n is a, c, t, g, unknown, or other
tggagctcaccgcggtggcggccgctctagaatagtggatcccccgggctgcaggaattcgtctcacccctagaaaaaaaaggacgcacgaaccccaggaggcaccgtctccaaagtccaaaccctaaccctagcgcccccaactcgtcgccgggagatggcatggacgcgnagcgcggcaagcggagctgaatcgcgcagttcttcttctcaggggggtggggttctttcgttccccgccaaaaaacttccacccgcatttggggggtctcagaggcccacctttccccaccccggggcccctttttttggcccttttttccccaaaaaatttcttttttggcccccctttttccccgggggggcccccccctcccccaagggggccccccccggggggggggcccccccccccaaaaaaacacccccgggctttttttttccaagggggggggaatattttttttttttcccccgggggggttttttttttt

SEQ ID NO: 64636 - DNA, 662 bp, Zea mays
  misc_feature: Ceres CLONE 1534604
  misc_feature: Encodes the peptide sequence at SEQ ID NO. 64637
  misc_feature (39)..(39): n is a, c, t, g, unknown, or other
  misc_feature (52)..(52): n is a, c, t, g, unknown, or other
  misc_feature (255)..(255): n is a, c, t, g, unknown, or other
  misc_feature (435)..(435): n is a, c, t, g, unknown, or other
  misc_feature (436)..(436): n is a, c, t, g, unknown, or other
  misc_feature (438)..(438): n is a, c, t, g, unknown, or other
  misc_feature (459)..(459): n is a, c, t, g, unknown, or other
  misc_feature (460)..(460): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (602)..(602): n is a, c, t, g, unknown, or other
  misc_feature (621)..(621): n is a, c, t, g, unknown, or other
  misc_feature (622)..(622): n is a, c, t, g, unknown, or other
tagctggagctccccgcggtggcggccgctctagaactnagtggatcccccngggctgcaggaattcgtctcacccctagaaaaaaccctagccgcactgcgctcatttctgcatccccctcccgccgcgccgcctcaccgccgccggagaagatgggtcgcgtgatccgcgcgcagcgtaagggtgcggggtccgtgttcaagtcccacacccaccaccgcaagggccccgcccgcttccgctccctcgacttncgcgagcgcaacgggtcctcagggcgtcgtcacgacgtcatcacgaccccggccgtggcgcgccctcgccaaggtcactttccgccccccttccggtccaggccccccagggggttttttggtgccaacccaagggccttttacccgggcccatttcctttttttggggggtccccccgnncnccccccttttttttgggtaanntttgtttttnnnnnnnnccccccccccccaaaaaccctccaggggggggcggccctttttcacaaaacaaaaacccaccttgtgggggccgcgcgggtgttttcccccgcgggctccctgggtgaacaccccttttgtgggnaccccccccccctcccgannaaccccccctcccgtgggttattttcgccccccccccgcc

SEQ ID NO: 64637 - protein, 143 aa, Zea mays
  misc_feature: Ceres CLONE 1534604
  misc_feature (34)..(34): Xaa is any aa, unknown, or other
  misc_feature (95)..(95): Xaa is any aa, unknown, or other
  misc_feature (102)..(102): Xaa is any aa, unknown, or other
  misc_feature (103)..(103): Xaa is any aa, unknown, or other
  misc_feature (106)..(106): Xaa is any aa, unknown, or other
  misc_feature (107)..(107): Xaa is any aa, unknown, or other
  misc_feature (108)..(108): Xaa is any aa, unknown, or other
MGRVIRAQRKGAGSVFKSHTHHRKGPARFRSLDXRERNGSSGRRHDVITTPAVARPRQGHFPPPFRSRPPRGFFGANPRAFYPGPFPFFGGSPRXPPFFLGXXCFXXXPPPPKNPPGGGGPFSQNKNPPCGGRAGVFPRGLPG

SEQ ID NO: 64638 - DNA, 752 bp, Zea mays
  misc_feature: Ceres CLONE 1534606
  misc_feature: Translation starting site: 185
aaagctggagctccccgcggtggcggccgctctagaactagtggatcccccgggctgcaggaattcgtctcacccctagaaaaagcgccgccacttccctcccgacccactatcccaaaaccgtagcgccctcgcctgctcgccgccgccgtcgttgcgagctccccatcttcctccgtcaaccatggcgacccagatcagcaagaagaagaagttcgtcagcgacggcgtgttctacgccgagctcaataagatgctgacgcgggagctcgcggaggacggctactccggcgtggaggtgcgcgtcacaccgatgcgcacggagatcatcatccgcgccacgcgcacgcagaacgtgctcggcgagaagggccgcaggatcagggagctcacgtctgtcgtccagaagaggttcaacttccccgagaacggcgtcgagctctacgccgagaaggtcgtcaaccgcggcctctgcgccatcgcgcaggctgagtcccctccgctacaagctcctcggaggccttgccgtccggagggcctgctatggtgttcttcgctttgttatggagagtggcgccaagggttgtgaggtctttgtgagtggaaagctcagggctccaagagccaagtccatgaaatttcaaggagggctacatgatccccttcgggccagccagggaatggaatccatccgactcagcttgtgagacccgtcctccttaaaaaaggggggtttttggggtatcagggag

SEQ ID NO: 64639 - DNA, 832 bp, Zea mays
  misc_feature: Ceres CLONE 1534607
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (832)..(832): n is a, c, t, g, unknown, or other
aaaagtgttgaaaattcctactcactatgggtnnnnnnncccaacaaaaaaaaaagtggcactccccgcggtggcggccgctctaaactagtggatcccccgggctgcaggaattcgtctcacccctagaaaaaactaccttgagctacttcaacagtccgtgctgatgtgaggacagtgaaagaagctagaggtgataccttgtcagacataggacaccggcgccgcgcatggcatcctcaatttctccttcccgggctcgcggctcccggccgccgcgctaaccacaccggagtccctcgtggtggccactggcccacgcgacgccggcccggagcacgtcggcgtcgcaaggcatccgcttgccatcacatcggctctaccacctgactgactttgggggacaaccacgacgctgattcctgtcctggcacgcggaatatgactcggccccctaactgaaagagacatgaatccccccgcgccggactaaagaattggaaagcatcgtgaagtcctcggcctgtcgaaacgggtcgaacccccggccggggattcaactcttctcccagaaaaaacctcggccccttgacggcatacccctcaacgccaataaaacctttaggaggtgttggcatttcgatggtttacgaggactcatagaaaaagaacctcggaacccttttcgttccacaagtttcattggggtggtagatataccttaatgcagccgggcacctttgtattatagaaaacaacaaaacccaagattattatcgtttattataatagaaactatcacgtgaaagagtatatagagtcgtgcataccn

SEQ ID NO: 64640 - DNA, 605 bp, Zea mays
  misc_feature: Ceres CLONE 1534610
  misc_feature: Encodes the peptide sequence at SEQ ID NO. 64641
  misc_feature (479)..(479): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (516)..(516): n is a, c, t, g, unknown, or other
  misc_feature (518)..(518): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (563)..(563): n is a, c, t, g, unknown, or other
aagctggagctccccgcggtggcggccgctctagaactagtggatcccccgggctgcaagaattcgtctcacccctagaaaaaacccatcgcccatcggcagcagaaagccactggccggacggagcttccgaaagggaaccgggcagcggcaatggagggacagccgctccatctcctcatcgcccagttccaccacccttgcctacgcggtctcatccccaactaccctacccactacctgcccacctcccgcctccgactccgcgtacagcgtcgcaagccgaagcagctcgccgcagtgccttcgaggcgtccatcgggcagccagaccgacgcgcctggcctggtgcctaacacggtggcggcgctggtgctccaactgaccgtgtgctcggtcctttttctcttcccaaccgtgcccgaagcctcgcgctcccgccccctccggggggcgctgaagtggttgaagccgcgcangatgaagatgaccccgagtgggaagccggcnnnnccntnccgcaaaaaaaagnnnaaaaaaaaaaaaaaaaaaaaaaataaaanaaaatttcttttggtgccccccccccccccccccgggggggc

SEQ ID NO: 64641 - protein, 150 aa, Zea mays
  misc_feature: Ceres CLONE 1534610
  misc_feature (109)..(109): Xaa is any aa, unknown, or other
  misc_feature (120)..(120): Xaa is any aa, unknown, or other
  misc_feature (122)..(122): Xaa is any aa, unknown, or other
  misc_feature (127)..(127): Xaa is any aa, unknown, or other
  misc_feature (137)..(137): Xaa is any aa, unknown, or other
MEGQPLHLLIAQFHHPCLRGLIPNYPTHYLPTSRLRLRVQRRKPKQLAAVPSRRPSGSQTDAPGLVPNTVAALVLQLTVCSVLFLFPTVPEASRSRPLRGALKWLKPRXMKMTPSGKPAXPXRKKKXKKKKKKKNKXKFLLVPPPPPPGG

SEQ ID NO: 64642 - DNA, 627 bp, Zea mays
  misc_feature: Ceres CLONE 1534611
  misc_feature: Encodes the peptide sequence at SEQ ID NO. 64643
ataactggagctccccgcggtggcggccgctctagaactagtggatcccccgggctgcaggaattcgtctcacccctagaaaaaaccctcctcaactcctaccctccgccgtaaaccccgctgttctttgccggagcaccccctccccgtctccagccccagtctcggtccccccggacttcgatatcttcggagaccgcctgcatgctcaaatcgtagacactctgggtaggcgcaaggtggagatccgtccgggcacggatcaatttcttcgttcgctggtactcaggctctaatatttttacaaaatcgatggaaagttctaaatctcctcagtcatcaaaaaacagtcggattgtggtgccttctgatagtaatcgcccccgatttgacaatgacggtttttcttcagaaactgcatcaaatcaaatggtcgtgttcaactctgaagcagcagatgaactgggagaaaaccgtctgcagaagtcagtgataacaaaggggatatcaccatctattggagcattccctgtcccatgtggtaaatgttttaaatgaaggcttattccacccaaagagaaataccaagaatttcgtgaacgtattatacaggaacccttttgtatg

SEQ ID NO: 64643 - protein, 81 aa, Zea mays
  misc_feature: Ceres CLONE 1534611
MESSKSPQSSKNSRIVVPSDSNRPRFDNDGFSSETASNQMVVFNSEAADELGENRLQKSVITKGISPSIGAFPVPCGKCFK

SEQ ID NO: 64644 - DNA, 649 bp, Zea mays
  misc_feature: Ceres CLONE 1534614
  misc_feature: Encodes the peptide sequence at SEQ ID NO. 64645
ggagctccccgcggtggcggccgctctagaactagtggatcccccgggctgcaggaattcgtctcacccctagaaaaaaagagatatcacacggacctcttcaggcttcaaggcagatccgcagcagatggaagcgaatagcaggctgccggaggtgaccatcgtcccggcggcacggccgttggctggcgacggcacactcgacgcggcaaaggccgcggcaggcaaggagcccgtaagcccgggcactccgtcctcggtggccgcctgccgctccatctgtgaggagaggcgcgcggtggaccgcgtctccctgcctgggtggaagctcgacgccctctgccaggaatcctgcccgtccccggccatgacggcacgcttcccctactacttctgaagcgttcccgttgcagtcctgcgtgatccagttcttgagcggagacctctggtgcatgctcttgactactgatggcgttcattgcgtgttttcctagctcttggtctccctttcgtgcacgttcatgtctatacgctcgtgtgtcccgagtctaccaagatctgcgagctttacgcgcgctcactgaacaacgattcgctccaggtaccctgttcaccctatagtgagtcccattacactcgctctgtggcc

SEQ ID NO: 64645 - protein, 89 aa, Zea mays
  misc_feature: Ceres CLONE 1534614
MEANSRLPEVTIVPAARPLAGDGTLDAAKAAAGKEPVSPGTPSSVAACRSICEERRAVDRVSLPGWKLDALCQESCPSPAMTARFPYYF

SEQ ID NO: 64646 - DNA, 701 bp, Zea mays
  misc_feature: Ceres CLONE 1534615
  misc_feature (50)..(50): n is a, c, t, g, unknown, or other
  misc_feature (60)..(60): n is a, c, t, g, unknown, or other
  misc_feature (66)..(66): n is a, c, t, g, unknown, or other
  misc_feature (67)..(67): n is a, c, t, g, unknown, or other
  misc_feature (210)..(210): n is a, c, t, g, unknown, or other
tggagctccaccgcggtggcggcccgctctagaactagtgggatcccccngggctgcagngaattnncgtctcacccctagaaaaaatttcgtaatgctcgggtaaacacgtgtgaccataacttttctgggtatctgtgttaactgcgattctcaccgtatcgctgctaggaaatatggtactatgtatgtcattgtgctgatagcagnattctcgcgagacaaccaaaaaagaaatgctgagatcgctcttagggcacccagattctccgctatatctgaatcaacatgactacccgcttcactcggtcgatcctctttacaaccatcatcgacatgggaaaacccgaggcgttacccatcctagtctggcttacatcactatcacccgtttcgccagctggaataataaacaaaaaagcccccaccgatcccccttcccaacaattgagcagcctgaatcgcgaacgcaaattgtcagcgttaatattttggtaaagattcgccctaaatttttagccaaatcaaatcattttgctaaccaacacccctacaccagctggatcccttacaaataagcccaatacacccacacatccctgagtgttctcccactttgtaacaaaagtccactataaacgaacatatactccaacatttcacggcaaataaccgtctatccgggccattgcccactacag

SEQ ID NO: 64647 - DNA, 777 bp, Zea mays
  misc_feature: Ceres CLONE 1534623
ctgcaggaattcgtctcacccctagaaaaaatcagctagccactagtactatacgcgctccgtccaaatccttggcctcgtcatccgcaagtcccactactacagtgcccgccgccgctgcgtccaccaccacctcctttcccaactcctccgcgtacccccgccctctccggcggcccgcgtaaccacccgcgcagatggcgacggcggccacggcgtccgcgacggcggcgacccgcttcacgctcctagcgggcgcccgcctccgtagccgcatcacccgcgtcccgaccgccgtgcgttttccccccccccgggggggggggggggggggtcattctctaacacctcccacctccccccccccgtggacaaatcgtcatccctcacctttcctgcattggcggtgctgctctcctcttccttactgcgccggtcctcggagggcgcgcgtccgtgtttgaggtacgtacaccctgtgtgagatatctggcgaatgccgttctcctgctatcctccctatcttctgcggtcacccccggggacagagacatcgccccacgacgtcacggatgtacttggtgtgtgagaccccgccgatgcacatgcagacaagctctcgggcctttattcacagtcgccgcccctccgtcgctctcactcccctcatcggaccgcttcggcgcgtgttgctggctgccctgccccgtcatagcgcaggctcggcgcgaccccccgtctataagcaaatagggattctaatcgtccatgtcgcgc

SEQ ID NO: 64648 - DNA, 654 bp, Zea mays
  misc_feature: Ceres CLONE 1534624
aaagctggagctccccgcggtggcggccgctctagaactagtggatcccccgggctgcaggaattcgtctcacccctagaaaaagatgaagtggttgttgaagaggagtttactccagtgcctgttcatcaagtggatggagccatctaactgatcatcgtgttagaagtatctagaacctcttctctgcaacaaaggcaagccccggtgcatttgccccttccttgtgttttaaatgctttatcaccttaaatgatgcattaggtgataggagttgtgtgatgaacaactgatgcattaccattccttggaatttaaatactataccttgatccctgatttataaaaagaactgataatgcttaaccctgcttagaaactgaaaaatcatttgttttcaaaaagaatgattgcggaacattagttatgggctttttgattcaaaaatcaaagcaaactaaggtgatgactccacttcggccggagtgggatcatcattggaaaagagtacccctgtcgggtgccaaaaatggggaaatggttaataaatctagaccagacgctgagcagacagagtcgcccgtctgtgtcgattaaggaccgtaccgttgactggcctgttgtggttgagactttgcaactagccacataccc

SEQ ID NO: 64649 - DNA, 749 bp, Zea mays
  misc_feature: Ceres CLONE 1534625
  misc_feature: Translation starting site: 239
aaagctggagctccccgcggtggcggccgctctagaactagtggatcccccgggctgcaggaattcgtctcacccctagaaaaaaagaaacagagagagcggttctacgtccgagtcgtcgcatcaggtcccctcgattcgccggcggcggcgccaccaaccaagctcatacatctgaattgactagtccaactcagggatttctttggggaccaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacgagctgttcagggcttgaagaaagagtacagctacaacaagatcctcaaggatctcaaaaaagagttctgctgcaatggtactgtagtccaggatccagagctaggccaggtcatttcactggcaggtgatcagcgtaaaaatgtcgctacctttctagtccagggccggaatcgtgaaaaaagataccatcaagaattccggattttaaaactgcaaatttggaagtgcttggggtgtgcctatccatatgatccccatatggataccagggtatttgaagccttccgaaagcttgtttcgccttccgaaaacactcagtaaatcgtctattccaccggacaaaaggggtccaataaatttcctattgaa

SEQ ID NO: 64650 - DNA, 649 bp, Zea mays
  misc_feature: Ceres CLONE 1534628
  misc_feature: Encodes the peptide sequence at SEQ ID NO. 64651
  misc_feature (649)..(649): n is a, c, t, g, unknown, or other
aagctggagctccccgcggtggcggccgctctagaactagtggatcccccgggctgcaggaattcgtctcacccctagaaaaagccagaggcaacgggctccccgccgtgagctcttcggccacgcgggcgtcttgcctccctcgtccttcctcaccgcaggaggatggccgcgatagcctcagcttcgcccaggaccctgatccctccgcggccgcgccaccacggcgccgcgccctccccatccacctccgacgtctcctcgctccgactcctccgcgcgcacccgcgccacgtccgacgcagccgcggagtgtccatctcgatgcccgtggcgcggagccggtcgttcgtcttctccccgcgcgcggtggctgactccaagagctcccagacctgcctggaccccgacgccagcacgagtgttcttggaatcattctgggaggtggtgctgggactagattgtaccccttgacaaagaagcgtgccaagcctgcagtgccattgggtgccaactatagactgattgatattcctgtcagcaattgtctcaacagcaacatatccaagatctatgtgctaacgcaatttaactctgcttccctcaaccgtcacctctcaagagcctacgggagcaacattggagggn

SEQ ID NO: 64651 - protein, 161 aa, Zea mays
  misc_feature: Ceres CLONE 1534628
  misc_feature: SWISSPROT Homolog: EC 2.7.7.27 Glucose-1-phosphate adenylyltransferase
MAAIASASPRTLIPPRPRHHGAAPSPSTSDVSSLRLLRAHPRHVRRSRGVSISMPVARSRSFVFSPRAVADSKSSQTCLDPDASTSVLGIILGGGAGTRLYPLTKKRAKPAVPLGANYRLIDIPVSNCLNSNISKIYVLTQFNSASLNRHLSRAYGSNIGG

SEQ ID NO: 64652 - DNA, 796 bp, Zea mays
  misc_feature: Ceres CLONE 1534629
  misc_feature: Encodes the peptide sequence at SEQ ID NO. 64653
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (418)..(418): n is a, c, t, g, unknown, or other
  misc_feature (513)..(513): n is a, c, t, g, unknown, or other
  misc_feature (571)..(571): n is a, c, t, g, unknown, or other
  misc_feature (577)..(577): n is a, c, t, g, unknown, or other
  misc_feature (602)..(602): n is a, c, t, g, unknown, or other
  misc_feature (781)..(781): n is a, c, t, g, unknown, or other
nnnnnnnnnnnnnnaaaaccctctttttnttnnnnnnnnnnnnttattnnnnnccaattactggtactcaccgcggtggcggccgctctataatagtggatcccccgggctgcaggattcctctcacccctagaaaaagtcggtgtcggtgtggtgtgggggcggtgctgcgcgtgtgcgctcctctgttcggcaggactccttcaagctttaagggcggagcagcatggcggggcgctactacggcaaccccttcgagaaggaggacgtgaaccctttctcggaacaagcgcgcggcaaggctggggggcagtccaacttcggcggtggtgcgtttttttcatgccctaagacaagaaacatgcctccctgcattcttttttcgcgccttttcggcggtttcctccctgaaaccaantttttttttcccccccccccggggggggggggggagggggggaatccttccaaaatgaccctgaattaggatcggccaaaaggatgcttgcaaanccaaagggaaaaacgggatattggaacgggggaggggggggaagggggaacttacaanccggtnataagaaggaaaggttggcaggctnaaaagccggagaaatttggccctttggtgtgaagaaaaaatttgtggcttccgtgttgtacgggccgcccctcccgcttcccggagttttgcttacgtggtagaagccgcggagccctcccttccgtcggaacgcgccgcctctccttccctctccacagtattttttaaagggagggngagtatagccataca

SEQ ID NO: 64653 - protein, 86 aa, Zea mays
  misc_feature: Ceres CLONE 1534629
  misc_feature (64)..(64): Xaa is any aa, unknown, or other
MAGRYYGNPFEKEDVNPFSEQARGKAGGQSNFGGGAFFSCPKTRNMPPCILFSRLFGGFLPETXFFFPPPPGGGGEGGNPSKMTLN

SEQ ID NO: 64654 - DNA, 635 bp, Zea mays
  misc_feature: Ceres CLONE 1534630
  misc_feature: Translation starting site: 67
gcggtggcggccgctctagactagtggatcccccgggctgcaggaattcgtctcacccctagaaaaatggcttcgtcggtggccgccgcggcgagcacattcctgggcacccgcctggcggacccggtgccgcagaacgggcgcatcgtggcccggttcgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcgggaaagccgtggagtacctgcagttcgaactggactcgctggaccagaacctggccaagaacgaggccggcggcatcatccccacccggttcgagtcctccgacgtcaagtccaccccgctccagccctacagcgaggtgttcggcctccagcggtttccgcgagtgcgagctcatccacggccgatgggccatgctcgccaccctcggcgcccttcacgtcgagtggctcacccggcgtcccttggcaagacgctggcaaggtggagctggtggatgggtcctcctacctggccaaccgctgccgttccccatcttga

SEQ ID NO: 64655 - DNA, 672 bp, Zea mays
  misc_feature: Ceres CLONE 1534634
  misc_feature: Encodes the peptide sequence at SEQ ID NO. 64656
cgcggtggcggccgctctagaactagtggatcccccgggctgcaggaattcgtctcacccctagaaaaaaccgagcagcaacaagccaacaactaaaggcaggcgcggcacaccgcgacaccgtaccggcctagacacttggagaaaggagaagcagcgcagcggcatgggcaccagtcccgtcatccctgcgacgatgctcgtcgtcgctctccttgtcgctagtagtactgtctgcttcggcgccaccgccaccgacaccgacaccgacggcgccattcgtctccccagcagctctggtgctgttggtcgaccgtgggagtgctgtgactatgtcacccaggagccgtttatcaagccgccccggtggcgctgcaacgacgtggtggacaagtgccccccccaactgccaaaaatgcgaaggagtcgccgggcggggaacgggtttcctcggccgggatgggattttcagccggttccaagccccgggcttgccaacccaggccccggggaaagggtggcaatttcccccgatgggaaaaagggaaaatatttcccccctaaagggctaatgggcggcaaccgggggggaaaatttggccccacaacaattttggaaaaagggtgcaaaatttttggggaaatagagaaccctcccctcctctttttaga

SEQ ID NO: 64656 - protein, 168 aa, Zea mays
  misc_feature: Ceres CLONE 1534634
MGTSPVIPATMLVVALLVASSTVCFGATATDTDTDGAIRLPSSSGAVGRPWECCDYVTQEPFIKPPRWRCNDVVDKCPPQLPKMRRSRRAGNGFPRPGWDFQPVPSPGLANPGPGERVAISPDGKKGKYFPPKGLMGGNRGGKFGPTTILEKGCKIFGEIENPPLLFL

SEQ ID NO: 64657 - DNA, 668 bp, Zea mays
  misc_feature: Ceres CLONE 1534636
  misc_feature: Translation starting site: 183
  misc_feature: SWISSPROT Homolog: EC 1.11.1.15 Peroxiredoxin
aagctggagctccccgcggtggcggccgctctagaactagtggatcccccgggctgcaagaattcgtctcacccctagaaaaaagccagcgccaaccccggaaaggcggaaacccatcgcaactaatccccaaccccaaacctccaatccacccatcccctcctcatccactccgggcggccatggcctgctccttcgccgccgcgaccgtcgtctcttccgcccccaccccggccgccaggcccctcgccgctgccccgcagtccgtctctgtttcccgctccgcggtcgccaccgccgccaggccgctcccgctcgtcgcctccagatccgcgcgggccatcagactcgtcgcccgcgccggcggcgtcgatgacttgccgctgttcgggaaacaagcgccagaacttcgaaccgaaggcgttgttcgacaagaagtcatcaaacgtgaagctctctgattacatcgggaagaaatacgtcctttctgtcctcaaccccttgggatttcacttttgtctggccgaacaaaataactggcctccagggacgaaaataaaggaattcaagaaagttaaaccctgagggtccttgggggtcccaatagaaaaggggggcccccccccccttggagtgggggccaaaaaaaaaaagaaacctgggtggct

SEQ ID NO: 64658 - DNA, 727 bp, Zea mays
  misc_feature: Ceres CLONE 1534637
  misc_feature: Encodes the peptide sequence at SEQ ID NO. 64659
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (45)..(45): n is a, c, t, g, unknown, or other
  misc_feature (53)..(53): n is a, c, t, g, unknown, or other
  misc_feature (727)..(727): n is a, c, t, g, unknown, or other
nnnnnnnnnnnnaaaanttttgaaaaagaaagcaaaaccaacagncccccccncaatactggaactccaccgcggtggcggtcgctctagcactagcggatcccccgggctgcaggaattcgtctcacccctagaaaaatctcctctccacctcatccgtatctccctccttctcggcggccgtggcggcgccggaagactatgcgcggcctccaccgctgcccgcaccagctcctcctggtctctccaccgccgcggtccgcccccgcgttccgccagtcggccaccgcctcatcgcggggcctcaggagctccctcgccgtcttctccgcccccggggctcgggtagcggcggcggcgcgcgaacagaagtggggccacgtggagggtgatgaagacggtggagaggagggcctcggggaggcgctccacaggacgcgggagctcgtggagtgcgccatgttcgcggccgtcgctgggctcgcctacttcctcagcaattccctcgccattgagaattatttcagttgcttttttcccattgccgatagtcatttcctccttaagatggggactaaaaagcccagcaggataaaccgtgggtgggctacctgttttttactagctattccccatttattcctggcccctggtaaaaagcatccaactttattcctgccttaattgccttggaaagtaagcttggggcctccactccatgggggcn

SEQ ID NO: 64659 - protein, 160 aa, Zea mays
  misc_feature: Ceres CLONE 1534637
MRGLHRCPHQLLLVSPPPRSAPAFRQSATASSRGLRSSLAVFSAPGARVAAAAREQKWGHVEGDEDGGEEGLGEALHRTRELVECAMFAAVAGLAYFLSNSLAIENYFSCFFPIADSHFLLKMGTKKPSRINRGWATCFLLAIPHLFLAPGKKHPTLFLP

SEQ ID NO: 64660 - DNA, 647 bp, Zea mays
  misc_feature: Ceres CLONE 1534644
  misc_feature: Encodes the peptide sequence at SEQ ID NO. 64661
  misc_feature (1)..(1): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (403)..(403): n is a, c, t, g, unknown, or other
  misc_feature (407)..(407): n is a, c, t, g, unknown, or other
  misc_feature (415)..(415): n is a, c, t, g, unknown, or other
  misc_feature (416)..(416): n is a, c, t, g, unknown, or other
  misc_feature (419)..(419): n is a, c, t, g, unknown, or other
naaacgctggagctccccgcggtggcggccgctctagaactagtggatcccccgggctgcaggaattcgtctcacccctagaaaaaaacacagctcagctcagcccagcctccctttcccttgaagcctctccaccaacccaaagtcacagagacagagaggaccaaggcaggcagccgtcagcgagccagctagccagccatgggcaaggactgcggcaaccacggggacgatgacttccggcagtcatgccggcgcctgctggccatcctgctgaccatggcgctgctggcgggagtcggggggctgatcgtgtacctggtgctccgccccacgcacccgcgcttctacctgcttgatttttccccccccccagtggaaagaaaggagggtttnnnncccncttntttccccnnctnctcaaaaaaacaaagagatccccccacccccggggggcgggtgcggggtttactacaacccccctcaacggtctaccccacgtacaatttacccgcagggtgagcgcctgggcgcccaggctggccccccgggggtacccaaggcccaccggcaaacgtccaacgtcccggggcctccctttaccttggtccggcccccctcatcttcccccttcaagagcccttttg

SEQ ID NO: 64661 - protein, 106 aa, Zea mays
  misc_feature: Ceres CLONE 1534644
  misc_feature (65)..(65): Xaa is any aa, unknown, or other
  misc_feature (66)..(66): Xaa is any aa, unknown, or other
  misc_feature (68)..(68): Xaa is any aa, unknown, or other
  misc_feature (69)..(69): Xaa is any aa, unknown, or other
  misc_feature (72)..(72): Xaa is any aa, unknown, or other
  misc_feature (73)..(73): Xaa is any aa, unknown, or other
MGKDCGNHGDDDFRQSCRRLLAILLTMALLAGVGGLIVYLVLRPTHPRFYLLDFSPPPVERKEGXXPXXFPXXSKKQRDPPTPGGRVRGLLQPPSTVYPTYNLPAG

SEQ ID NO: 64662 - DNA, 639 bp, Zea mays
  misc_feature: Ceres CLONE 1534647
  misc_feature: Encodes the peptide sequence at SEQ ID NO. 64663
  misc_feature (395)..(395): n is a, c, t, g, unknown, or other
atagctggagctccccgcggtggcggccgctctagactagtggatcccccgggctgcaggaattcgtctcacccctagaaaaatgcaaagacagccaggaggtttgcctagaagcagccaccctttaaagagtgcgtaatagctcactgatcgagcgcccttgcgctgaagatgaacggggctaagcgatctgccgaagctgtgggatgtcaaaatgcatcggtaggggagcgttccgccttagagggaagcaaacgcgaaagcgggggtcgacgaagcggaagcgagaatgtcggcttgagtaacgaaaacattggtgagaatccaatgccccgaaaacccaaggtttcctccgcaaggttcccccaccgagggggagggaggacctaggatcnggccgaaaggcgtattccatggacaacaagtcaatattcctgtactaccccttgttggtacggagggacggaggaggctaggttagccgaaagatggttataggtttaaggacccaaggggacccctgctttttcaggggaagaaggggtagagaaaatgcctcgagccgaggtccgagtaccaagccctgccacgctgaaatatgaagccccggggactaacctttggcttctccacaaggct

SEQ ID NO: 64663 - protein, 72 aa, Zea mays
  misc_feature: Ceres CLONE 1534647
MNGAKRSAEAVGCQNASVGERSALEGSKRESGGRRSGSENVGLSNENIGENPMPRKPKVSSARFPHRGGGRT

SEQ ID NO: 64664 - DNA, 643 bp, Zea mays
  misc_feature: Ceres CLONE 1534650
  misc_feature: Encodes the peptide sequence at SEQ ID NO. 64665
  misc_feature (373)..(373): n is a, c, t, g, unknown, or other
  misc_feature (380)..(380): n is a, c, t, g, unknown, or other
  misc_feature (408)..(408): n is a, c, t, g, unknown, or other
  misc_feature (410)..(410): n is a, c, t, g, unknown, or other
  misc_feature (643)..(643): n is a, c, t, g, unknown, or other
ataactggagctccccgcggtggcggccgctctagaactagtggatcccccgggctgcaggaattcgtctcacccctagaaaaaattcccatcccattccccactctactcattcagcagatcccgtcactcgctctccacaagcagagcaccgcagcagaacgaggaaggatgctggccatcttccagaagcaggtggcgcacgcgccgcaagagctcaacagcccccgcgccggcgcgtcgcccagcaagccccggaaccccgacgagatcctgcgcgacttccacgccgcgcacccggccgccgccttctccgcctccttcggcggcggcgccgcgctcgcctgcgtcgagccctcctcctccgcatcgncaccggnaccgccacctaccagcggatgttctgcngnctgaacacatctactgcgtcttcctggggcgcctcgacaacctcagcggcctcatccgccagtacggccctgtgcggccgctccacaacaaagcgatgcttgtcatcgaggccttccgaacgctggggaaccgggggccctaccaggccaaacagttgtaaggaacccgccgggccttcccctcgttgttttaaaaacccctcggggccttttttcccccctcgggccccaan

SEQ ID NO: 64665 - protein, 79 aa, Zea mays
  misc_feature: Ceres CLONE 1534650
  misc_feature (68)..(68): Xaa is any aa, unknown, or other
  misc_feature (70)..(70): Xaa is any aa, unknown, or other
MLAIFQKQVAHAPQELNSPRAGASPSKPRNPDEILRDFHAAHPAAAFSASFGGGAALACVEPSSSASXPXPPPTSGCSA

SEQ ID NO: 64666 - DNA, 736 bp, Zea mays
  misc_feature: Ceres CLONE 1534654
  misc_feature: Encodes the peptide sequence at SEQ ID NO. 64667
  misc_feature (700)..(700): n is a, c, t, g, unknown, or other
aaagctggagctccccgcggtggcggccgctctagaactagtggatcccccgggctgcaggaattcgtctcacccctagaaaaaaatcacaatggatggatttgatcctcgcatcacattcagcctcaaggatatatgggtgtagcagcagatctacttgtagcggtggtgaggaccaaaacaatgcccgacgtttccttcaaactggtgagactttatgtggacaacatctcgggagtgcttgttgctcccatctgcaggctgctctccgctaccctcgagaagttaagcttcagctcctcacgtctctcgaatcccttgatttctatcgctgcagggctctgcagtcgctcccccaaggactgcatcgccttccttctctccatgtaataaatatccatgggcctcaaaacatcatatccctgcctaaggagggcctccccgattcactacgacaactatatatagctgagtgttgtaccgagatttatgaggcatgccagcaattgaagggaacaaggccagatatagaagtagatgcctacaaagctgatgtgcaaaattgaatacctgcttctgcatgtctttcgcacagtcaactctgcttcagcatgcctttcactctacaggtaaatactgtgaaaacctctttctatacatgagatagttgaccttcatcgattctccagcccagatgatngttttgtggatgatgtgttggtcgtggttggcacaa

SEQ ID NO: 64667 - protein, 84 aa, Zea mays
  misc_feature: Ceres CLONE 1534654
MGVAADLLVAVVRTKTMPDVSFKLVRLYVDNISGVLVAPICRLLSATLEKLSFSSSRLSNPLISIAAGLCSRSPKDCIAFLLSM

SEQ ID NO: 64668 - DNA, 653 bp, Zea mays
  misc_feature: Ceres CLONE 1534655
  misc_feature: Encodes the peptide sequence at SEQ ID NO. 64669
  misc_feature (653)..(653): n is a, c, t, g, unknown, or other
tggagctccccgcggtggcggccgctctagaactagtggatcccccgggctgcaggaattcgtctcacccctagaaaaaaaaagtagagctccctgctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggctatctgttgctgctgctagttctgcttggagggcatgggcgtccatcatcgtggagatgtggccatgcgggacacccaccgccgaataaaatgctgtacttatatgcacgcacgttagaaatgcattagtgtctgtttgatgtgatcttttgtgtgtgtgtgcgcgcatcttcatttgcactggaaaatgctttattatttgtgaaggtctgtaaatctgttgtatgtatcttgggcaaaaaaaaaaaaaaaaacgagacgctcgaggtacccaattcgccctatagtgagtcgtattacgcgcgctcactggccgtcgttttn

SEQ ID NO: 64669 - protein, 54 aa, Zea mays; identical to SEQ ID NO: 48310
  misc_feature: Ceres CLONE 1534655

SEQ ID NO: 64670 - DNA, 639 bp, Zea mays
  misc_feature: Ceres CLONE 1534657
  misc_feature (488)..(488): n is a, c, t, g, unknown, or other
  misc_feature (516)..(516): n is a, c, t, g, unknown, or other
cgcggtggcggccgctctattctagtggatcccccgggctgcaggaattcgtctcacccctagaaaaaagagctggcttcaaaggccatccagaagttgaacaataaagatctaaagggaaagaagataagagtttcttcctcacaggctaaaaacaggctatttatcgggaacataccctataactggacagagaatgaatttaaaaaagcagcagaggaagttggccctggagttttaaaagttaatctcgtgaaggcaccacattcagatacgaacaagggttatggatttattgaatactacaaccaggcttgcgcagagtatgctaagaagatgatgtctaccccagaattcaaactagataaaaatgcccctaatgtcagttgggcagatactaagaatggtggtgaatctgcctctactgcacaggttaaatcactatatgtaaaaaacctgcccaaggctgttactcaagaacaactganaaaactattttgagcacccttggagaangtacaaaggttgttattccctcctgcaaaagctggtcatgaaaaatcgataatggtttttgttccctttcaaaaaaacgatcccatggctattgaaaggctcctggaaaaaacctgaaaaaat

SEQ ID NO: 64671 - DNA, 712 bp, Zea mays
  misc_feature: Ceres CLONE 1534659
  misc_feature: Encodes the peptide sequence at SEQ ID NO. 64672
  misc_feature (552)..(552): n is a, c, t, g, unknown, or other
  misc_feature (604)..(604): n is a, c, t, g, unknown, or other
ctccccgcggtggcggccgctctagaactagtggatcccccgggctgcaggaattcgtctcacccctagaaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccangacaaggtcctcatggagagctggtactacctcaaggacgcggtgctggacngcggcatcccgttcaacaggcgtacgggatgacggccgtcgagtacacggcacggacgccccttcaacgcgtgttcacgaggcatgaagaccactcggtgacatcaca

SEQ ID NO: 64672 - protein, 160 aa, Zea mays
  misc_feature: Ceres CLONE 1534659
  misc_feature (31)..(87): Pfam Name: Dimerisation Pfam Description: Dimerisation domain
  misc_feature: SWISSPROT Homolog: EC 2.1.1.68 Caffeate O-methyltransferase
  misc_feature (133)..(133): Xaa is any aa, unknown, or other
  misc_feature (151)..(151): Xaa is any aa, unknown, or other
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNXDKVLMESWYYLKDAVLDXGIPFNRRTG

SEQ ID NO: 64673 - DNA, 594 bp, Zea mays
  misc_feature: Ceres CLONE 1534661
  misc_feature: Encodes the peptide sequence at SEQ ID NO. 64674
  misc_feature (373)..(373): n is a, c, t, g, unknown, or other
ggatcccccgggctgcaggaattcgtctcacccctagaaaaaatcccagccgaagagcaccaagcttcgctagcagcatatacgcatccatcccactggaaacagaccaaccctaccctaccctgcagcgcgcgcagagggggaaaggagctccagcaaaaagtttgtccagctcctcctcctactacagcgctacaaggatctgatcatcgagcagcatggcgcggcggccgcagcccatgcccaacctggtgcccacgctcctcctgctcgtcgtcgtggccgccgccgcggcggtcgtgagagccgacgacgacgagaagtgcagcaacccgtgcgggaacccctgcggcgagccgtgcgtgtacgccancccgccgccgccgccgacgcccgtgtactcgcccccgcccccgccgccgacgcccgagtactacccgccggcgaccccgaccccgaccacgccctactgcccgccgccgccgtcgggcggcggcggctacgagccgtcgcccgggtacacgccgtcgacgccctacacgcccggctacaaccccacgccctccgggtccggctggtacgcgccgccctaca

SEQ ID NO: 64674 - protein, 125 aa, Zea mays
  misc_feature: Ceres CLONE 1534661
  misc_feature (52)..(52): Xaa is any aa, unknown, or other
MARRPQPMPNLVPTLLLLVVVAAAAAVVRADDDEKCSNPCGNPCGEPCVYAXPPPPPTPVYSPPPPPPTPEYYPPATPTPTTPYCPPPPSGGGGYEPSPGYTPSTPYTPGYNPTPSGSGWYAPPY

SEQ ID NO: 64675 - DNA, 673 bp, Zea mays
  misc_feature: Ceres CLONE 1534666
  misc_feature: Encodes the peptide sequence at SEQ ID NO. 64676
  misc_feature (1)..(1): n is a, c, t, g, unknown, or other
  misc_feature (80)..(80): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (408)..(408): n is a, c, t, g, unknown, or other
  misc_feature (409)..(409): n is a, c, t, g, unknown, or other
  misc_feature (411)..(411): n is a, c, t, g, unknown, or other
  misc_feature (412)..(412): n is a, c, t, g, unknown, or other
  misc_feature (418)..(418): n is a, c, t, g, unknown, or other
  misc_feature (419)..(419): n is a, c, t, g, unknown, or other
  misc_feature (448)..(448): n is a, c, t, g, unknown, or other
  misc_feature (449)..(449): n is a, c, t, g, unknown, or other
nacccctggagctcaccgcggtggcggccgctctagaatagtggatcccccgggctgcaggaattcgtctcacccctagnaaaaacagccatcacacgcatactgcatacacaacgcagagcatcagaagcagctgcgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggctgcccatggtacgggagccgaccgcgtcctgtacctgtgtcccgctgtccgggctcgcccccaagctacttgactttttccccccccccgaaagggaaaagaagggaaannnnnnnncttttcnncnntccccnnaaacccttcaaccaaaaaaccccatcctnnaaggtgaggccccggggcccctggggccttggctcgggcccactccggtttccttgttcccccggaaccgcctccccccgccaacgaacatacataatcccgacaaaggcggtgttggtttccaaggccgggcctcccccaaatctttcaaccaaaggggcgggcctgaaaactacctccctgcaacccctaagccctggtccccccgctcccaaaaccttccg

SEQ ID NO: 64676 - protein, 174 aa, Zea mays
  misc_feature: Ceres CLONE 1534666
  misc_feature (82)..(82): Xaa is any aa, unknown, or other
  misc_feature (83)..(83): Xaa is any aa, unknown, or other
  misc_feature (84)..(84): Xaa is any aa, unknown, or other
  misc_feature (87)..(87): Xaa is any aa, unknown, or other
  misc_feature (88)..(88): Xaa is any aa, unknown, or other
  misc_feature (90)..(90): Xaa is any aa, unknown, or other
  misc_feature (100)..(100): Xaa is any aa, unknown, or other
MAAATMAITSRALVGKPAAGTRDVFGEGRITMRKTAAKPKPAASGCPWYGSRPRPVPVSRCPGSPPSYLTFSPPPKGKRREXXXLFXXPXKPFNQKTPSXKVRPRGPWGLGSGPLRFPCSPGTASPRQRTYIIPTKAVLVSKAGPPPNLSTKGAGLKTTSLQPLSPGPPAPKTF

SEQ ID NO: 64677 - DNA, 751 bp, Zea mays
  misc_feature: Ceres CLONE 1534667
  misc_feature: Encodes the peptide sequence at SEQ ID NO. 64678
  misc_feature (751)..(751): n is a, c, t, g, unknown, or other
gggtctcccctagtggatcccccgggctgcaggtatccctctcacccctagaaaaagtgccacactcgccatcgcggcgtccctcgagagtcgaccacctcgacggccgaccaatatagcaacctatacagggcattctcatctcatggcgacgacggagacgatggagatgggcatgggcgtcgtcttcgacggcgtcagtagcaacggatcaggcggctgcggcgggctggtggtgacggatcttacccactcaaggagctggtgaggcatctggaggtgcacctcggtggctccccggacctgtgcaagcacctggcctcgcatatcttctccccccccgggggggggggggggctcgtcacctcctcctctcagtccacccccctctagctggaccgccccggaagggctcgtcgggcggaaccggcctcgcgcgcggggcagctgggcgttctccgtctattgctgcccccgtaccgcggccggtcaatgaacgatctgaataacattcaacgccgaaggaaccgcgtcgcactccgcggggggttccccccgccgctgggtatatactccccacgctgtcccgtttggctatgactcccactctatgagggtgcggcggttggcggtaccatggtggtcgctgtgttcgccccgggggtggcgaagcctagtccgcgccctctcctgctcacgcgtgggttcttccccttctccgttcctcggtgcacggggcgtctgactctcn

SEQ ID NO: 64678 - protein, 40 aa, Zea mays
  misc_feature: Ceres CLONE 1534667
MATTETMEMGMGVVFDGVSSNGSGGCGGLVVTDLTHSRSW

SEQ ID NO: 64679 - DNA, 697 bp, Zea mays
  misc_feature: Ceres CLONE 1534671
  misc_feature: Encodes the peptide sequence at SEQ ID NO. 64680
  misc_feature (1)..(1): n is a, c, t, g, unknown, or other
  misc_feature (45)..(45): n is a, c, t, g, unknown, or other
  misc_feature (53)..(53): n is a, c, t, g, unknown, or other
ntttttgttggcatatctattctcactctccccctgtgtataaanacacccanaaaaaactggaactccacgcggtggcggccgctctataactagtggatcccccgggctgcaggaattcgtctcacccctagaaaaatcgctccctctcagcttcctcattggccatccttcgtcttccatggagaggctccttgccggcctactactcggcttcctattattgatcgcgtcagtaggaagccatgcaactcgtgctccagatcagtactggaagtctgctcttcccgacactcccatgccgagctccctctcccaactcctcaacaccccagctggcaagggcggcgtcggtggaggcagcagcggcaagaagcccggcggcaccacggtgggagttgggaaagggggagtgggcgttaacgttaaccctaccaaacccggcggcgccggtacaaccgttggcgttggcaaaggtggcgtcggcgtcggcgtcaatcccgggtacggcaagccgggtggcaccacggtgggcgttggcaaaggccagggttggcgtcaacgtgaaaccgggcaaagaagcccgtccaccgtccccgtccggcccttttccagtaccgagtacggccgccatcgggagacgccaagttgccccgaacgacccccaagcgtgggcgcctctttcttttcggagaaa

SEQ ID NO: 64680 - protein, 172 aa, Zea mays
  misc_feature: Ceres CLONE 1534671
MERLLAGLLLGFLLLIASVGSHATRAPDQYWKSALPDTPMPSSLSQLLNTPAGKGGVGGGSSGKKPGGTTVGVGKGGVGVNVNPTKPGGAGTTVGVGKGGVGVGVNPGYGKPGGTTVGVGKGQGWRQRETGQRSPSTVPVRPFSSTEYGRHRETPSCPERPPSVGASFFSEK

SEQ ID NO: 64681 - DNA, 649 bp, Zea mays
  misc_feature: Ceres CLONE 1534676
  misc_feature: Encodes the peptide sequence at SEQ ID NO. 64682
  misc_feature (519)..(519): n is a, c, t, g, unknown, or other
ggagctccccgcggtggcggccgctctagaactagtggatcccccgggctgcaggaattcgtctcacccctagaaaaattcacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgctgtgatgcttttattaagattctgatgagtggtgacgttaagagaaaattggcagtactgtgttgtaccccaagattccttgcagcattgctatgctaagtaacgaaccctttatcttattatatatgtagtgttgcagtgtancacaaaattgtaaaacaacaaaaataaaaaaaaacaaaaaaacgagacgctcgaggtacccaattcgccctatagtgagtcgtattacgcgcgctcactggccgtcgttttacaacgtcgtgactgggaa

SEQ ID NO: 64682 - protein, 51 aa, Zea mays; identical to SEQ ID NO: 2355
  misc_feature: Ceres CLONE 1534676
  misc_feature (9)..(51): Pfam Name: Ribosomal_L39 Pfam Description: Ribosomal L39 protein

SEQ ID NO: 64683 - DNA, 695 bp, Zea mays
  misc_feature: Ceres CLONE 1534678
  misc_feature: Encodes the peptide sequence at SEQ ID NO. 64684
  misc_feature (695)..(695): n is a, c, t, g, unknown, or other
caccgcggtggcggccgctctatactactggatcccccgggctgcaggaattcttctcacccctagaaaaatcacagattcccagccaactaaagagaaggagagcgtgtgttcgtttccagaacgcacgcacagacgccatggaggtgacacctaaccacaccctgaccgtgaccgggtgggcggccatgatcgagtccgccggcgaggtggagcccttcgtcttcaggagaagggagaacggcccggacgacgtgacgatcaaagtgcagtactgcggcatgtgccacacggacctgcgcttcatcaactacgaatgggggatcaccacgtacccgctggtcccggggctcgagatcacgggcaggggcgggggggccgtggcgctaattctcgggctttcctgtcgtcgaacgtatgcggaaggggatggactcgccgacttctgcctggattggcaccacctgccgccgcctccttagtatatactcccgcatctattgagacgctcaactatattcggcatatctcctgggaaaggataaccgttccattaaggttggggtaccctctcatccacggtgtgtaggacgcaatacacctgtttacgttggtggtctttatctcccgtactgtaaattgctacttgaataaaaactatcacgagcagttaatattattgatgtatgggtgcn

SEQ ID NO: 64684 - protein, 113 aa, Zea mays
  misc_feature: Ceres CLONE 1534678
  misc_feature: SWISSPROT Homolog: EC 1.1.1.255 Mannitol dehydrogenase
MEVTPNHTLTVTGWAAMIESAGEVEPFVFRRRENGPDDVTIKVQYCGMCHTDLRFINYEWGITTYPLVPGLEITGRGGGAVALILGLSCRRTYAEGDGLADFCLDWHHLPPPP

SEQ ID NO: 64685 - DNA, 606 bp, Zea mays
  misc_feature: Ceres CLONE 1534686
  misc_feature: Encodes the peptide sequence at SEQ ID NO. 64686
agtggatcccccgggctgcaggaattcgtctcacccctagaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgcctgggccatggcttgccgtccccgggatccttggtgcccggaaagctctgggccctggggcaactggtttgaaatgcgccaagaatggggcgggctcgtcccccgggcggggtagggcaaccttacctgggggggccccccgggtgaccctggtggggaaccccttcccggacccatttcttggggggtattataattttccgggggccttttccttccttttt

SEQ ID NO: 64686 - protein, 116 aa, Zea mays
  misc_feature: Ceres CLONE 1534686
MVMASSSGLRSCSAVGVPSLLAPSSRSGRLAPFCANATTSGRVTMSAEWMPGQPRPAHLDGSSPGDFGFDPLGLATVPENFERFKESEVYHCRLGHGLPSPGSLVPGKLWALGQLV

SEQ ID NO: 64687 - DNA, 783 bp, Zea mays
  misc_feature: Ceres CLONE 1534689
  misc_feature: Encodes the peptide sequence at SEQ ID NO. 64688
  misc_feature (12)..(12): n is a, c, t, g, unknown, or other
  misc_feature (13)..(13): n is a, c, t, g, unknown, or other
  misc_feature (48)..(48): n is a, c, t, g, unknown, or other
  misc_feature (49)..(49): n is a, c, t, g, unknown, or other
cattttttttannctattcctaacaaccagagatttaaaaggttcttnnttttaaacctggaagctcacgcggtggcggccgctcttttctagtggatcccccgggctgcaggaatttgtctcacccctagaaaaaaacgcacacacacacccacacactctacagcaacagctaagcctctcccacaagacagcaacatggctgaggaggaggccaagaaggtggaggtggaggtcaccaaggagcccgaggcggcggcgaaggaggacgtagccgatgaccaggccgtcatccccgcgaccgacccgccgccgccgccgccgccggccgacgactccaaggccctggccatcgccgagaaagttgcagatgaacctgctcccgagaagcctgcccctgcgaagcaagggggctccaatgacagggatcttcgctcttgcaagggtggaaaccgagaaaaaggaactcttttgatcaaaagcttgggaaagagaatgagaagaaactaagcctgaaaacaacggctgcttaagaaagtatcccgcttattcttttccatgggaaaaaccacaaaaaaaacgcaaaaccctataaagtctgaaacttgaaacaaaaatttggaggaaaactaccttgtgaaaaaaaaaaaaaacgcctgaaaaattggcccccagaaaaaaatgtactcaaactccggggtttgccaaattgaaatacacccaaagaggaaacgctccaaaaaaaataaacgcgacaccctaatgggcgggtgatagtgtaaa

SEQ ID NO: 64688 - protein, 103 aa, Zea mays
  misc_feature: Ceres CLONE 1534689
  misc_feature (23)..(83): Pfam Name: Remorin_N Pfam Description: Remorin, N-terminal region
MAEEEAKKVEVEVTKEPEAAAKEDVADDQAVIPATDPPPPPPPADDSKALAIAEKVADEPAPEKPAPAKQGGSNDRDLRSCKGGNREKGTLLIKSLGKRMRRN

SEQ ID NO: 64689 - DNA, 675 bp, Zea mays
  misc_feature: Ceres CLONE 1534690
  misc_feature (379)..(379): n is a, c, t, g, unknown, or other
  misc_feature (384)..(384): n is a, c, t, g, unknown, or other
  misc_feature (385)..(385): n is a, c, t, g, unknown, or other
  misc_feature (389)..(389): n is a, c, t, g, unknown, or other
aaagtggagctcacgcggtggcggccgctctagaatagtggatctctgggctgcaggaattcgtctcacccctagaagaagctctccgttaacacgcaaacgcaagctcccaagcagctaccaaccagccgggagagggagcgcacgcactgcgacaatggccacggccggcggagggccggcatctgagctgctggcgcgtggccgaccccttcgtgaaccgctagcatggccctgccctcagggggtggagtacaaaacgtggaggaggactcccccacagagggacctgctcctcgccttcaacctttttcaaagttggttccggccccctccacggtttttttccccccccccaggggggagtgggggggaattnttccnncacntcctctccctggtttgggaaagaagaaacaaccccggggcaccgaaggggcgggcccccctcttttttctcttaaccccactagtacctaggtacagtggtcaccctattagggtgaaacccctcctccctgacacaaggaagtattatcccctccgtttccccaggtgccactgtcccctagtgaccgagaaaggcgttctatgtttagcaacatcctcccacaaggttttttcgctaggcagccccccctgttttttggtcttgcgccggccggtgctcttctt

SEQ ID NO: 64690 - DNA, 751 bp, Zea mays
  misc_feature: Ceres CLONE 1534705
  misc_feature: Encodes the peptide sequence at SEQ ID NO. 64691
  misc_feature (596)..(596): n is a, c, t, g, unknown, or other
  misc_feature (604)..(604): n is a, c, t, g, unknown, or other
ggagctccccgcggtggcggccgctctagaactagtggatcccccgggctgcaggaattcgtctcacccctagaaaaaaggcagaatcctttgccaaatcaacgccagcaacagcaaagcaactacagagagtaggagatgcttactctccacaccattcagtcatgcccctcgctgcgcagatcctctctgttccggcgtgctctgctaggcaggaagagatctttcatttctgccagcagttctgaggatgccgaatccggcactcccccgccgcttggtggcgacaaacaccagcaggaggttcttgcacagatcgccatgcttcagacgcagaaggtgcgcatcacagacttcttggacgagcgctctgcttacctgaccaagttcgccaaggacgccgactcggagttcgacctgattgggcagaacgccatgaaagaacttgatgccgttggtgaccagatactggagaggctcgacagcaaagatgcaagccttcgaggagacggctgaagtacaacggcaagagatagaaatgaacgataaggtgttagaggacttcgaagactggattgagaaggagaaaaacgaangaatgttnctcaaaaagccttggcaaggtcaaacctcggaaacagatggaaataaaggtgaaaggccaagttggaagcacagaaggtcaaagaaattgcaaaaaagagtgcaagatcaaaaactcctatgaacattttactgggggctgatgggg

SEQ ID NO: 64691 - protein, 125 aa, Zea mays
  misc_feature: Ceres CLONE 1534705
MLTLHTIQSCPSLRRSSLFRRALLGRKRSFISASSSEDAESGTPPPLGGDKHQQEVLAQIAMLQTQKVRITDFLDERSAYLTKFAKDADSEFDLIGQNAMKELDAVGDQILERLDSKDASLRGDG

SEQ ID NO: 64692 - DNA, 829 bp, Zea mays
  misc_feature: Ceres CLONE 1534709
  misc_feature (1)..(1): n is a, c, t, g, unknown, or other
  misc_feature (2)..(2): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (28)..(28): n is a, c, t, g, unknown, or other
  misc_feature (34)..(34): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
nnttttttggggggggnnnnnnnntttnttactnctttccatcaannntntcaaaagtggagctccccgcggtggcggccgctctagactagtggatcccccgggctgcaggaattcgtctcacccctagaaaaattaatgtcatgctattacatatcaaagcaagatctgaacattatccaatcctgattgaacatattatttgcaagattattctctgaagcacatgtatagaggatttagaagaattcctttcggacctggttttgaatcttatttactttgtggaactgaaattttgggccaaacctctgacaagaattgaaaagcttaagtcttcaactatattcatgtttagaactgtttcttatatttcggaggtattgatatttttcgttttgtcgtgaggtcccatgacgatgtgtgatttgagcaacaccaaccacacccattcccccttacccttctcttccctccctccctccctcctcctaccctccgtctccaaaacttttcaacataagaacaaatttcccaccaaaataacatcacctcccctaatcccccccaagaggcccccccttccctcccccctctatatgaatctataaatatatttctctctttcctctactcccccactacctctccaacaacctctggcacagtggacaaaaaaactccctgttaatatatacacacacccttacatcccccacctaccggaaaaaaatggaccacactttttattacggatggtgtccctctaatatactctcctagaattttaacacccaaattccaataatattccctcctcaaactcccg

SEQ ID NO: 64693 - DNA, 789 bp, Zea mays
  misc_feature: Ceres CLONE 1534710
  misc_feature: Encodes the peptide sequence at SEQ ID NO. 64694
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (789)..(789): n is a, c, t, g, unknown, or other
aaaaaacataattcctgcctcttctattaccttnnnnnaccctnnnnnnntaatactggagctcaccgcggtggcggccgctctataactagtggatcccccgggctgcaggaattcgtctcacccctagaaaaaatcgtttgatcggacacggtgcctgagcctccgcgatccctgagcatactacatgagtagctaatgcaaagggaggtggcaaagatgctgccgacgaccgcgtccaaggggcgcggggcctcccgctccgccccgccgctcttcggtccctacctccgccgcatcgtcaagtggcaacaaatggatattgaatacacattttggcgaatggttcatctctgtacttcaccaaaagtagtctatcagcacaccaaatatcacaagcaaacaaagaaccagtgggcccgtgatgatcctgcatttgtgtgttattctgactcgtttcctcccgcccaccaacatcaggctttacctgtgcaccaaatgggagaagagtgctctcaaaatgccccttgcaaacaaggcacggcgccctgctcccgtgcctcatcctagggaagactagcttccaagatctggccccactcctttcccgtgagcccggcatccaacccccccttcagttcgagctataagaaaacctaagggagatccataggccgggaaaattcaagggcttttgacagggggttcttactgtcgccattttcgaaagggttcccttttcaataaacttcgtgatacccttaaccctggaggaccccgggtggaatn

SEQ ID NO: 64694 - protein, 123 aa, Zea mays
  misc_feature: Ceres CLONE 1534710
  misc_feature (24)..(109): Pfam Name: UNC-50 Pfam Description: UNC-50 family
MQREVAKMLPTTASKGRGASRSAPPLFGPYLRRIVKWQQMDIEYTFWRMVHLCTSPKVVYQHTKYHKQTKNQWARDDPAFVCYSDSFPPAHQHQALPVHQMGEECSQNAPCKQGTAPCSRASS

SEQ ID NO: 64695 - DNA, 722 bp, Zea mays
  misc_feature: Ceres CLONE 1534713
  misc_feature: Encodes the peptide sequence at SEQ ID NO. 64696
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
ttgtgtggttgtttcccccctcctnnntttgntnnntttgcccnnngntcatagctggactccccgcggtggcggccgctctattcctagaggatcccccgggctgcaggaattcccctcacccctagaaaaagtggttcccacccaccaaaccgaactccacaacctcccccgtcctcttcttggcttctccttgccgacgcgagcattagcaaaccttggggaagggaagccgaagcagcagcatgaactgcgcgtctgccatcccgcagctactccaaacagcaacgtcctagccgacgagagcctccctccgccacctaacctacccaccaactcccgcccgtcgcctccgcttggcttttcgtcgagcagttggttggcacctaacccccagggccgcgggccattaaggcgggagagtgaggcagagccagtgaaccaaagccggtagatgaagaagctgtgccaaagcggcaagaaggggcggcgggtgcacccggcgccggcggacgcggccgtggccgtggcgctgccggccgccgcgctggccctggcgtccccgctgacggccgaggagcaagaggtgctggcctacctcccgtcctgcagcggcaccagcgttcgtggagcgagccgccgcgccagccgccgcggggccccacccgcccggaaaatggggctgcgccctggcttctggctggcaacaagaaactttctgg

SEQ ID NO: 64696 - protein, 89 aa, Zea mays
  misc_feature: Ceres CLONE 1534713
MKKLCQSGKKGRRVHPAPADAAVAVALPAAALALASPLTAEEQEVLAYLPSCSGTSVRGASRRASRRGAPPARKMGLRPGFWLATRNFL

SEQ ID NO: 64697 - DNA, 798 bp, Zea mays
  misc_feature: Ceres CLONE 1534714
  misc_feature: Encodes the peptide sequence at SEQ ID NO. 64698
  misc_feature (13)..(13): n is a, c, t, g, unknown, or other
  misc_feature (20)..(20): n is a, c, t, g, unknown, or other
  misc_feature (37)..(37): n is a, c, t, g, unknown, or other
  misc_feature (39)..(39): n is a, c, t, g, unknown, or other
aaatatttaattnaattttngacagcaaaagccaaantnctcaaaataaacaaaatggggctccccgcggtggcggccgctctttttctagtggatcccccgggctgcaggaatttccctcacccctagaaaaaagcgtgcatcgcggctcccgctcccacactcgcctccctcatcagtggcagctagtagcggcagcacccgcagctcgcaggagagagagagagagagagagagagagagagagcagccatgaaccacggaggcggagccgacaacggtgtgagccccggcaacgtcccggtgtgctactacggcgcggcggggcgcgtgccggcggcgctggagcggcgggtgcgcgccgcggagctgttcatgcggtgcgcggcgtgcgggctcgcggtgctcgccgcggcgctgctgggcgccgaccgccaaacccgcacccttcttctccggggagaaaggggccccggtccaccgaactgcaaaccgctccgtattccctggaggaaaacaaaccggggatggcaaacggtgctaaaagccctgcttgcaagggaagtgaaaggtggcctgggcggaaaattccatcaccaggggtggtgggctgatattaaatcaaaccagggccccatgggcaagggggccccaatcattatccccggacaaaatacaggtcacaggggtggaaactttctccggaaattctccgacgggatgggccccgtcggcgaaaaaaggagacagcccagaataaatcagaaatccggggacaatttcaccggcgccactcgg

SEQ ID NO: 64698 - protein, 182 aa, Zea mays
  misc_feature: Ceres CLONE 1534714
MNHGGGADNGVSPGNVPVCYYGAAGRVPAALERRVRAAELFMRCAACGLAVLAAALLGADRQTRTLLLRGERGPGPPNCKPLRIPWRKTNRGWQTVLKALLAREVKGGLGGKFHHQGWWADIKSNQGPMGKGAPIIIPGQNTGHRGGNFLRKFSDGMGPVGEKRRQPRINQKSGDNFTGATR

SEQ ID NO: 64699 - DNA, 880 bp, Zea mays
  misc_feature: Ceres CLONE 1534718
  misc_feature: Encodes the peptide sequence at SEQ ID NO. 64700
  misc_feature (21)..(21): n is a, c, t, g, unknown, or other
ggggtgggttaatattattgnagaaaacctatccctttttttgaaagggaaccccaccccaggaacctccaccgcggtggcggccgctctataactaatggatcccccgggctgcaggaattcgtctcacccctagaaaaacgggtcaccagtcaccacatccctccctcactgccatttgtttggttgttcctctcgctcgccagtcgccaccaggcagcaggtatcccaatctcgcgagagccagtagcggcggcggcgcttccggcttcccttccattggcctccgggatggcgctccccactcacaatgtcacggctctgtattttccccgccgtttctccctaccagccgcccctaacgactggaagtttccttccccgttcctccttacttgaacgtccggccgcccaatcttacacacaagggcgggaaaaaccaaaaaacccaattttggtctcccctccaaagagaaaagaaaaaataggttcctaggttattaagctattccccacggtggcatcctttacaaaaaaaatattaaaaaaattttttccaagcagactctctctactacgcaaattgtggcgacttcaacaacaaaaaaaataaattattgagaaaaatataatttactagaagcccattatacctctataaaaaacggcttattgttcaccccccctcctcacaccaatatatacccctccccctatacgacacccaccacaccatcctcgaaaagagggatgttctttgttgtgtggtggcaaatattttaacgtagaatccctttaacaaaaaaaccgcggccccaccagggtgacaataatccccgcgagaaggaaataatattcattttttgttaatggaaagaag

SEQ ID NO: 64700 - protein, 35 aa, Zea mays
  misc_feature: Ceres CLONE 1534718
MALPTHNVTALYFPRRFSLPAAPNDWKFPSPFLLT

SEQ ID NO: 64701 - DNA, 613 bp, Zea mays
  misc_feature: Ceres CLONE 1534719
  misc_feature: Encodes the peptide sequence at SEQ ID NO. 64702
tggagctccccgcggtggcggccgctctagaactagtggatcccccgggctgcaggaattcgtctcacccctagaaaaatccactccgccgctcaccggcaggtccattccgttcggccggctgttccccaccacggcgagcgcgagctgcgctgccggtgtcccacgcggtgactgggactcggcgaggcagcggtcccggcgtccacatcgcgcgcggcgaggcaagcgccaagcgaggcgtcggccagcccgctggtccagctgttgctggattgctgctcgagcttgcgaggccagcccgcagtccgccacccgctcgttcagccggttcctctcaccgcgctgccaccgatggcgacgaacctgggcgtcttgtgccgtgctccccgaccctcgcccgcgtcaacggccgccgccccctcgcagtccctctctccctcctccgcctccgtacacattccccattcgacccagcgcggccgcctcgccgcagctccaccactgccacggtgtgtagctagtccaaccattgctaatgtgaaaagacaaactgaagctgaagttgcaatgggggtaccacatgactgaattctgccaacaatccttgagt

SEQ ID NO: 64702 - protein, 78 aa, Zea mays
  misc_feature: Ceres CLONE 1534719
MATNLGVLCRAPRPSPASTAAAPSQSLSPSSASVHIPHSTQRGRLAAAPPLPRCVASPTIANVKRQTEAEVAMGVPHD

SEQ ID NO: 64703 - DNA, 584 bp, Zea mays
  misc_feature: Ceres CLONE 1534720
  misc_feature: Encodes the peptide sequence at SEQ ID NO. 64704
tggagctccccgcggtggcggccgctctagaactagtggatcccccgggctgcaggaattcgtctcacccctagaaaaattcaatgactcagccgaggcccagaccggagcaggcccttcagctgagaagggcttttctgcaacagagatggctgtgggaggatccttcatggctctgaccatagcggtcatcctagttgttctgttcaagagggcatgatagctcaagagtcatgagtaccttctgggacccatcgtgcttttaatctgtcgaaaattactcgtctgtcgtatggtcaataattccgaaatgcatgtatagcttgtccgtttcttttgaaacagtacataaaggatttatctaaaggatgctcctatccactgggaagtttctcatccatgtgtaagatcatctccaggcgctttacctatttcttacctttattcccggggaaaaagggccctttttattattttttggaaagggtaaaacctataaaaacccaaaattttttttcaaaaaaaaaaaaacccggaacccccccgaggacccccattttccccccctaaaagggggccgcttt

SEQ ID NO: 64704 - protein, 72 aa, Zea mays
  misc_feature: Ceres CLONE 1534720
GAPRGGGRSRTSGSPGLQEFVSPLEKFNDSAEAQTGAGPSAEKGFSATEMAVGGSFMALTIAVILVVLFKRA

SEQ ID NO: 64705 - DNA, 639 bp, Zea mays
  misc_feature: Ceres CLONE 1534723
  misc_feature: Encodes the peptide sequence at SEQ ID NO. 64706
atagctggagctccccgcggtggcggccgctctacaatagtggatcccccgggctgcaggaattcgtctcacccctagaaaaacatccgctccgctctccccctctggcctctgcacgtagccataagcccatacgcccataccacaccgcacggtgcacacggttgagtcgacggtactcgtcgtcctcgtccgtgcagagcttgcaccaacacgccaccttaagcttcgctttgcccgcactcgcacacagttgcgaccgcattgcatcgtgcgcggctgcagcacgaagacgaagctctggtacatggcgagcagcgcggaggagcgcttcctgaggcagctgagcgcgagcaacggcggcgacgaaggggtctgcggcggccagcagctgggccacaaggagtactgcgcggagaggaggggctcccggcggtggtccaggaagcgggccgccgccgcgaggggctactgcggcgggtacgacgactacgacgtgaagcagcaggcggaggccgcctctgccgccgcgaggaagcgggtgatagtggtggtggacgacacctcgggctccaagcacgccatgatgtgggcgctcacccacgtcgccagcaaggaggacttcctgacgctgctcca

SEQ ID NO: 64706 - protein, 110 aa, Zea mays
  misc_feature: Ceres CLONE 1534723
MASSAEERFLRQLSASNGGDEGVCGGQQLGHKEYCAERRGSRRWSRKRAAAARGYCGGYDDYDVKQQAEAASAAARKRVIVVVDDTSGSKHAMMWALTHVASKEDFLTLL

SEQ ID NO: 64707 - DNA, 828 bp, Zea mays
  misc_feature: Ceres CLONE 1534724
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (36)..(36): n is a, c, t, g, unknown, or other
nnnnnnnnnnnntttcgggttctcattaccccctcncatggtaaccaaaaaaaactgaagatcaccgcggtggcggccgctctattctagtggatcccccgggctgcaggaattcgtctcacccctagaaaaagtgctttcttagaggagggttggcttctcctccccctccggttcgggttcgggttcgtgaggttctccggggttcggtttcgtgggggagcggatcaatatggagacggtcagacgctgagtcccgttgactacatcggcggcctccacagtgatagtaatgacacatgcgtccacggttactatcccacctacctgcgaggtccatcgaatttgagatcagcactggatcggcgagcacgaggaggtcctgtccgatatcaggatacatgcactctatacacggaggggagtttattcctgcacccaccccttgggggggggggggggggcaactctaccctgctctggaaaggtaacaacccaccacgcttagtaaggtccctgaaacctcgcccccgtgtccgattctaagcctggcctgtggattaggctaaatcccacagataataccaccgaaaactggcatatttaataaaatgagatggacgataggacaccccccccaagcgacccaaggctgaataatcgaaatacccatacggggcctcgccgtgatctctacggttgcgctcgactccctttcgcgcgccatctggagtgtgcgccactcatttgaaagatgaatgtggataccgataataattgtggtaccgtccgtcgcgcgcctccgaaggggctagcggtgacatgctg

SEQ ID NO: 64708 - DNA, 716 bp, Zea mays
  misc_feature: Ceres CLONE 1534726
  misc_feature: Encodes the peptide sequence at SEQ ID NO. 64709
  misc_feature (641)..(641): n is a, c, t, g, unknown, or other
ctccccgcggtggcggccgctctagaactagtggatcccccgggctgcaggaattcgtctcacccctagaaaaaaagaggtggccgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgcccgcgacacccgcaagcgcgtcgtcggcgtcctcctcggcacctcatcccgcgggtccgtcgatgtcaccaactcctacgccgtgccgtttgaggaggatgacaaggatcctaggatctggttccttgaccacaattaccacgagtcaatgttctccatgttcaagaggattaatgccaaggagcatgttgttggctggtacagcactgggccaaaactaagggagaacgacttggatgtccatgcattattcaacagttatgttccctatccagtcttggtgattattgatgtccaaaccaagggagctgggtataccgaccaaagcgtactacgctggggaaggaggttaaagagaatgccactccnaaaaagtcagaaggtttttgtccctgttcccttcgaaagtgcagctcatgaaattggaggaaattggaacttgaa

SEQ ID NO: 64709 - protein, 182 aa, Zea mays
  misc_feature: Ceres CLONE 1534726
  misc_feature (12)..(125): Pfam Name: Mov34 Pfam Description: Mov34/MPN/PAD-1 family
  misc_feature (158)..(158): Xaa is any aa, unknown, or other
MDVVKAAQLSGRTLERVVVHPLVLLSIVDHYNRVARDTRKRVVGVLLGTSSRGSVDVTNSYAVPFEEDDKDPRIWFLDHNYHESMFSMFKRINAKEHVVGWYSTGPKLRENDLDVHALFNSYVPYPVLVIIDVQTKGAGYTDQSVLRWGRRLKRMPLXKSQKVFVPVPFESAAHEIGGNWNL

SEQ ID NO: 64710 - DNA, 762 bp, Zea mays
  misc_feature: Ceres CLONE 1534727
  misc_feature: Encodes the peptide sequence at SEQ ID NO. 64711
  misc_feature (253)..(253): n is a, c, t, g, unknown, or other
  misc_feature (254)..(254): n is a, c, t, g, unknown, or other
  misc_feature (256)..(256): n is a, c, t, g, unknown, or other
  misc_feature (309)..(309): n is a, c, t, g, unknown, or other
  misc_feature (310)..(310): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (354)..(354): n is a, c, t, g, unknown, or other
gcgggaattcgtctcacccctagaaaaaaaacggtccaaaccccaagcccctcctcgcctcctcggccacgcatggggaacgcgcggcgccccgccgctgactcggcggcggcgtgggaccgggaggtcggatttgcgaagctacatggcgagtgcttcgagtactacatgcagacctactccatcgttctaggtcgccatagccgccgtcgcagcaagggccccgtttcccccccgagggagggcgacaacnncntccaatttttatttcggggccctcggagtatggttgaatgtttttttttttcnnccaaacccgggaaaaagaaaaagggggnnnnnnntcttttcctnccttttaccccccttgtaaaaaaagaaaataatctatgaggggggtggggggggtggcccttttctcccccccctccactttctcttcccccactaatcttcccatcatgctgctaaccatctatcaagtcttattctcttcctctcgctgacttgccctatgatgactccgtttcccttccccccgtttacgtgctttcatatagacgtatcatgtttccgtgtgtactcgtttttgtatcggtcctcatgttggagattaccgcttctgtccaccccttctgtctttttttctcacgtccctattgtcatcagtagttttctccacagccaatggcgaagcttggtcgcgtttaagtcctatcgcttgttacgccgtcgcctgagttcctcgtgagggcgtctgtg

SEQ ID NO: 64711 - protein, 106 aa, Zea mays
  misc_feature: Ceres CLONE 1534727
  misc_feature (61)..(61): Xaa is any aa, unknown, or other
  misc_feature (62)..(62): Xaa is any aa, unknown, or other
  misc_feature (80)..(80): Xaa is any aa, unknown, or other
  misc_feature (89)..(89): Xaa is any aa, unknown, or other
  misc_feature (90)..(90): Xaa is any aa, unknown, or other
  misc_feature (91)..(91): Xaa is any aa, unknown, or other
MGNARRPAADSAAAWDREVGFAKLHGECFEYYMQTYSIVLGRHSRRRSKGPVSPPREGDNXXQFLFRGPRSMVECFFFSXKPGKKKKGXXXLFLPFTPLVKKENNL

SEQ ID NO: 64712 - DNA, 865 bp, Zea mays
  misc_feature: Ceres CLONE 1534730
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (181)..(181): n is a, c, t, g, unknown, or other
  misc_feature (436)..(436): n is a, c, t, g, unknown, or other
  misc_feature (865)..(865): n is a, c, t, g, unknown, or other
ttttgctgtaannncnnnnnnnnnnnnggggccgcnnnnngcgctggagtactccccccggtggcggccgctctatactagtggatcccccgggctgcaggaattcctctcccccctagaaaaaatcgctttcgctcggcgtcctcacaaacgccggcgcaaactctcgcccgagcccganagatcttcaattcccccttccgcccacgggggggaccttcacgccagtctcggtctcttccgaaggcgtcgcgcgcggttgtttgaaaggagaggaggaagatgagggatcgctcctccctcccctcgggcaggccggcatcttttcccgaagggcggggggggaactttactgcttctattttggcatccacccggagggtaaatgcccttttttttttccccccaccccggggggggggggggggggtttttnttttctttctccctacacttcccccccccaacacaaaaacaccaacccaaactcccttggggggggggggcacctcttctttttccacccaccgccgctcggtcctcgccggtagcgcactctctgcgccgaggagagcctcccgaacttgccacgcgatgtgcccccggtctggccacgcccgatctgtgggcgcccggcggacgcgctccctagttaatacagaccagacactgatcacgggtacgtcctccgtacggacgccctgcctggtcacgccgacccaattacactgccccggagtagggcacacccatttctcaccccgccttacctacgcgggggttccccccgggcgctcccgcgcagcgggtgtcgtctatcctgcgcccagagcgccgccgattgaccagccgcgtgcccacactn

SEQ ID NO: 64713 - DNA, 691 bp, Zea mays
  misc_feature: Ceres CLONE 1534731
  misc_feature: Translation starting site: 296
  misc_feature: SWISSPROT Homolog: EC 2.7.11.24 Mitogen-activated protein kinase
  misc_feature (1)..(1): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
ngaaaaaaatgaggttatggaacacgaaaccctcnncaccccaangggggggccacaatataaatggagctcaccgcggtggcggccgctctattactagtggatcccccgggctgcaggaattcgtctcacccctagaaaaaccgccgcgcccccctcgcgtccgttcctcccttcctttccgtgtcggtctccggcgcgcccgacgtagcgcccgcatccgacggccgtgggggcatcgacggccgggcgacgcgacgcgatgtgaccatgacccgtcagtcagcagtacaaaatggcgatgatggtggatcctccgaatggaatcgggaaccaaggaaagcattactactctatgtggcagaccttatttgagatagacaccaaatatgtgccgatcaagcccattggtcgaggagcttatgggatagtttgttcctccattaatcgtgaaacaaatgagaaagtagcaataaagaagatacacaacgtttttcgacaaccgtgtggatgcactaaggaccttgcgggagctgaaactccttcgccatctccggaatgagaatgtcattgcttcgaaggatataatgatccctatacacccgcaaaagctttaaggatggtgaacttgggaatacgaaactcatggataactgatttgcccccgaataaaccaaataccctcaggggc

SEQ ID NO: 64714 - DNA, 734 bp, Zea mays
  misc_feature: Ceres CLONE 1534732
  misc_feature: Encodes the peptide sequence at SEQ ID NO. 64715
aagctggagctccccgcggtggcggccgctctagaactagtggatcccccgggctgcaggaattcgtctcacccctagaaaaaacagctagcagtaccacaagcatacgattcctatcctcactttattccacaatgatcactacgcctacagggaagccacctctggactgggtgacgaggaagaggatagctctcggggcagggagggggctgctgtacctgcacgagcagtgcgaccccaagatcatacacagggacgtcaaggctgccaacatcctgctagacgactgctgcgaggccattgtcggtgacttcgggctcgctaaactcctcgaccatcgggactcccatgtcaccactgcggtgcggggcactgtcggccacatcgcgcccgagtacctctccactggccagtcgtcggagaagaccgacgtcttcgggttcggcatcctgctgctggagctcgtcaccggtcagacggcgctggagtttgggaagacggcaaaccagaagggagccatgctggactgggtgaagaagacgcaccaggagaagaagctggacgtgctggtggaccaggggctgaggggcggctacgacaagatggagctagaggagatggtgcgggtagcgctgctgtgcacgcagtaccttcccggccaccggccgaagatgtcggaggtggtccggatgctggaagcaggggaagggctcgcagagcggtggggagcc

SEQ ID NO: 64715 - protein, 200 aa, Zea mays
  misc_feature: Ceres CLONE 1534732
  misc_feature (1)..(188): Pfam Name: Pkinase_Tyr Pfam Description: Protein tyrosine kinase
  misc_feature: SWISSPROT Homolog: EC 2.7.11.1 Non-specific serine/threonine protein kinase
MITTPTGKPPLDWVTRKRIALGAGRGLLYLHEQCDPKIIHRDVKAANILLDDCCEAIVGDFGLAKLLDHRDSHVTTAVRGTVGHIAPEYLSTGQSSEKTDVFGFGILLLELVTGQTALEFGKTANQKGAMLDWVKKTHQEKKLDVLVDQGLRGGYDKMELEEMVRVALLCTQYLPGHRPKMSEVVRMLEAGEGLAERWGA

SEQ ID NO: 64716 - DNA, 750 bp, Zea mays
  misc_feature: Ceres CLONE 1534733
  misc_feature: Encodes the peptide sequence at SEQ ID NO. 64717
tccccgcggtggcggccgctctagaactagtggatcccccgggctgcaggaattcgtctcacccctagaaaaaaagaaacccacagcagccgctagccgtacgatggcggacaccggtgacgtcgccgccgccgccgaggcctcggcgcgaccggcgggcagcagcagcacccagccgctggcggggcgcgtggcgatcgtgacgggcgcgtcgcggggcatcggccgcgccatcgccacgcacctgtcctccctcggcgcgagcctggtgctgggctacgcggcgcgcgccgacgaggcgggcgcgctggcggcgtcgctcccgcgcgcggtggccgtgcgggcggacgtctcggacgaggccggcgcgcggtcgctcttcaacgcggcggacgaggccttcggcggcgcgcacatcctggtggccagcgccggggtgctggacaacacgtaccccgccgtggccggcacccgccccgaggccttcgaccgcgtgctcgccgtgaaacctgcccggcgcgtttcctggtgcctcccgggaggggggcaaactgtctccctcctcggcggggggccggggccccatcttcgtccgtgaacttcgtcccgtgggggggaagcctccccccccggggttccggggcctcacacaggcggtcctaagggtggcggggtgggagggcccttgtgtgcgaatccatggccccaagagacttctgggaggccccccctggtcacggtgtacaatgt

SEQ ID NO: 64717 - protein, 164 aa, Zea mays
  misc_feature: Ceres CLONE 1534733
  misc_feature (29)..(156): Pfam Name: adh_short Pfam Description: short chain dehydrogenase
  misc_feature (29)..(134): SWISSPROT Homolog: EC 1.1.1.268 2-(R)-hydroxypropyl-CoM dehydrogenase
  misc_feature (25)..(57): SWISSPROT Homolog: EC 1.1.1.102 3-dehydrosphinganine reductase
MADTGDVAAAAEASARPAGSSSTQPLAGRVAIVTGASRGIGRAIATHLSSLGASLVLGYAARADEAGALAASLPRAVAVRADVSDEAGARSLFNAADEAFGGAHILVASAGVLDNTYPAVAGTRPEAFDRVLAVKPARRVSWCLPGGGQTVSLLGGGPGPHLRP

SEQ ID NO: 64718 - DNA, 720 bp, Zea mays
  misc_feature: Ceres CLONE 1534737
  misc_feature: Translation starting site: 178
  misc_feature (1)..(1): n is a, c, t, g, unknown, or other
  misc_feature (51)..(51): n is a, c, t, g, unknown, or other
ntttaccaagttttctgttgtatgtattcatacgacacaaacccccccttnatttatactgggactcaccgcggtggcggccgctctatcctagtggatcccccgggctgcaggaattcgtctcacccctagaaaaaaaatttccggaatccgccgccgccgccgccaggctgaccaatggacctctccgtcgtgccatccctctccctctccccgcgccgtgcccttccactcccggccagtagggctgcgcggcgtccggccttcgtctgccgctgcagttgctccctgtacgcgtccccggcggccacccggcggttgttcgcctccctcctcgccaccacaacagcggtgggggttggccgtgaccggaggctgaggggaaaccggcgcggtgtccaacgaccaggagggcgctcaaggcgtccaagattcctgagagcgaattcaccaccctgcccaatggccccccctactacgacatcaaggtaggaagtgtggctgaagctgttaaaggatcccgtgttgcggtacattatgtggccaagtggaaggacttccccttcatgaaaaagtaggccagggtcttggttgttggaggtgggaaacgccttatgggttttggacgaaggccaatttttgagaagaatgctattgtttttcaaaagggatctggaatcttttgggagggtcgaagggaaaatgaaaaatccctgaaag

SEQ ID NO: 64719 - DNA, 891 bp, Zea mays
  misc_feature: Ceres CLONE 1534739
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (123)..(123): n is a, c, t, g, unknown, or other
  misc_feature (124)..(124): n is a, c, t, g, unknown, or other
  misc_feature (165)..(165): n is a, c, t, g, unknown, or other
  misc_feature (768)..(768): n is a, c, t, g, unknown, or other
caaaaggaannnnnnnnnnnnnnnnnnnnnnnnnnttaannnnnnaaaacctagaactccccaacatggcagccgctcttttctaatggatccccgggctgcaggaattcctctcacccctannaaaacaccttaagtctagtgaaatgtgcattaagtttatangagttgcttggaaactattgaatgcatttgcctaccttgatatccctaccttttataaataccttctgatgaagtatcaaaatatgaatttaccaaaatggctttagcccctgcttaggaccttgttgaataaaaggttgtctttttgcatttaatgccctaccctcaagcggttatcccttgaaaaaaggacgggcttcctacctgccaaaaaaaaaattttttcaattgggcaaccataatggggaaacctttactgccaaaagttccccttattaatggcttcttttttccctccctaaaagggaaacaccagaaccaattccctttaacggaatgggaaagttattttaaccccccccccccactttgggggcctaaaggaaaaacaaggattgaatggttttccccctccacaaggctttaaattttaaacggaaattgggaaatagcccttaattgttcaaggcccttgttcatggaattcaaagggaaactaattcctttaaactgggggcccacactggacaccttggcaattattggtgaaaaaagggctaaaatcctttgacaaccccgggcttaattctcccttcacattgncaaaaaaaccaaatcacccccacctgcgaaatttggcaaaaaaatcggtcaaaaaagggggcaaccaaaaccacctcccttggcgccaaaggacacccccctcaaaaagagggaggtgtgtgg

SEQ ID NO: 64720 - DNA, 847 bp, Zea mays
  misc_feature: Ceres CLONE 1534741
  misc_feature (1)..(1): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (44)..(44): n is a, c, t, g, unknown, or other
  misc_feature (45)..(45): n is a, c, t, g, unknown, or other
nttttccttttttttccgccttttattttatnnngggggggggnngggaagtggaactccacgcggtggaggaaggttttttcctaatggatcccccgggctgcaagattcctctcacccctagaaaaaatcgcagccagcagcctcatccccttgcccacttctacagcccctctgctgcagaaagaaggaaagaagctagcgcttatagcttgtcagccatggccaccgccgccgcgtctaagcctcctcaagtcctccttcgcgggctcccggctctcggccgccacgcggaacataccggctttccctcgaggtggccaccggcccgcgcggcgccagcgcggggaccaatctgctcgtccatgtcctatgaccacacaccaaccagcccctacgaaccatgacgacctttctgggttcccccccccttcagggggggggggggggggacacccccaagaataacccattcaccccccccaatgggaacttgaacgatccaaacggtcgtcaaccaccctatcggagtgagacgcagaggggtccccccagacctcccccaaaagcttctatacatccgaaacatacaccaatataaactcccaagaggaccccgcgcacgcgtgcgaccctctctcctcgtgtgagaggaagcaatttttctattgcgccctcatagaggacagatcaatcactgtattaactctgaccacacgcccactatcgtcctcccgccgccctgagagcgagtgtccgcccatacaactgcgtccccctcgcggtgtccatacgcccacagactctcgtattcccggcgcaaaacaatcaccacagacaccagccg

SEQ ID NO: 64721 - DNA, 803 bp, Zea mays
  misc_feature: Ceres CLONE 1534742
  misc_feature (19)..(19): n is a, c, t, g, unknown, or other
ggggtggttgaagaaaaanttcccctttggtctgcaatttatagaaccaaaacaacagagatacacctgggagacgcttgatctataaatagtggctcccccgggttgcaggaattcgtctcacccctagaaaactccccaattctgcctccgtcattccaacctcccctctctcgctccccctatgacctggccgaccacggaaagccgagccgcaccgtatccgcgaagatcttgcgtggcctccttttcccaggtcgtcactgtgccactcgtgccctacactcccggtccgcccaaccagtaatccatccatccatccatccatgaccaccccgattgcgccgatgtgcggtggagtcttctcgtctttgtgttttatccagatgctttgcgctggtgtgagcgcaaaggcccacactactcaaaacaacaaacctcggaaccaacactgaccccaagcccctagcatatatcagctaatagcaaatgctactcccactagacgcatactttatcaatatatagctcccacccgattcacaaggaattaaattacaccacccttatcaactcttctgacattttttaggtgacgtaacgaccaaccacccgcaagtagaagacccgttcccccctttatcacaactccacagctctctatcccccccccccacgtgtactacttatcgtgtatagccccttgtcaccctaattcagatcatctaagggaacactattgctctttttccctctaccaccattacaacaatacctacccacggcttacagtattgagtgtg

SEQ ID NO: 64722 - DNA, 762 bp, Zea mays
  misc_feature: Ceres CLONE 1534745
  misc_feature: Encodes the peptide sequence at SEQ ID NO. 64723
  misc_feature (28)..(28): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (762)..(762): n is a, c, t, g, unknown, or other
tttttcctcttttttctctctttctccnccaaaaannnnnnnnnngtctctnnnnttcgtatggggctccccgcggtggcggccgctctattactagtggatcccccgggctgcaggaattcgtctcacccctagaaaaaatttcccatgtctctctgcgccgtagcgatggtccctccgctagttcacccaattgcttctccacctcctcggtcgtcacctcccccagagagcaggagccgcctcgtccctgccggtcccgaccccgacccccatcccgtccgcgtccaacgccatgaatcccgagtacgactacctcttcaagctgctcctcatcggggactccggtgttgggaagtcttgcctgctgatgaggcttgcggatgattcatacctggagagctataacaccagtattgtgatctgccccaaagtccggggggggggacaagaaggcaagaaaattaaagctaacaaatttgggaaactgcctggtcaaaaaactcttttatggaccatcgcctagcccccctaccaaccccggaaaacccaaagggcaattatcgaaggcgcaaaaaaaggggactgaatcccgcccgacgcttttacccgactcgccccccgcccgggggcctgaaattggaattgggattaggccctggcccggcggtaataatggcggcaacaagccttttacgggggggcgaaaaccaatatgttgaacctttgtgactcgaactaaccgctccacctaatttcttn

SEQ ID NO: 64723 - protein, 76 aa, Zea mays
  misc_feature: Ceres CLONE 1534745
MNPEYDYLFKLLLIGDSGVGKSCLLMRLADDSYLESYNTSIVICPKVRGGGQEGKKIKANKFGKLPGQKTLLWTIA

SEQ ID NO: 64724 - DNA, 713 bp, Zea mays
  misc_feature: Ceres CLONE 1534748
  misc_feature: Encodes the peptide sequence at SEQ ID NO. 64725
  misc_feature (524)..(524): n is a, c, t, g, unknown, or other
  misc_feature (713)..(713): n is a, c, t, g, unknown, or other
aagctggagctccccgcggtggcggccgctctagaactagtggatcccccgggctgcaggaattcgtctcacccctagaaaaaccccaatatatcccccatctcttcgactcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgcagccgcagccgccgcctcgaaggccggttccgacgacgtgggtgccgcctccgccaacagcaccgccgcctccggtgaggacctcaagaactgggatgcggacttcgtcaaggtcgaccagnccacgcttttcgacctcatcttggctgcaaactatctgaacaatcaaggtctgctcgacctgacctgtcagactgttgctgacatgatcaaggggcagacaccagagaagatcgcaggaccttcacatcagaatgacttcaccccctgagaagaaaagaaatcgccaggagaaccatggggcttcaagn

SEQ ID NO: 64725 - protein, 160 aa, Zea mays
  misc_feature: Ceres CLONE 1534748
  misc_feature (8)..(68): Pfam Name: Skp1_POZ Pfam Description: Skp1 family, tetramerisation domain
  misc_feature (99)..(161): Pfam Name: Skp1 Pfam Description: Skp1 family, dimerisation domain
  misc_feature (112)..(112): Xaa is any aa, unknown, or other
MAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQXTLFDLILAANYLNNQGLLDLTCQTVADMIKGQTPEKIAGPSHQNDFTP

SEQ ID NO: 64726 - DNA, 734 bp, Zea mays
  misc_feature: Ceres CLONE 1534750
  misc_feature (645)..(645): n is a, c, t, g, unknown, or other
  misc_feature (734)..(734): n is a, c, t, g, unknown, or other
aagctggagctccccgcggtggcggccgctctagaactagtggatcccccgggctgcaggaattcgtctcacccctagaaaaaacgtcaagtacatccggtgctcaaactgcgccaagtgctgccccaaggacaaggcgatcaagaggtttcaggtgaggaacatcgtggaacaggcggccatcagggacgtccaggaagcatgcgtctatgatggctacgtcctcccgaagctgtacgccaaggtgcaccactgcgtctcgtgcgcgatccacgctcacatcgtccgcgtccgatcccgtgagaagcgcagggaccgcaagccgccggagcgcttcaggcgcagggaggataggcctgctggtggacaaggaggcccccgccctggtcctggtgctgctgctacagctccatctccagcaccggttgctgctcgcccataggctttagcttttcgaccgtgttaagtcttctgcccactcagtttcggagttgtcccctgtgcgtgtgtgaagctgctatattagagttactttttgtctaaagtctgaacattttcgaagaatttgaatatctgaacatttgaatgtttgtgctgagtttttcaaagaaaaaaaaaaaaaaaaaaaaaaccctcttactgtcncacccccccagagagagacaagtggttttcaaaagccaatggggtactagcaagtctagcaaccagctagctcgggcggcagcagggan

SEQ ID NO: 64727 - DNA, 787 bp, Zea mays
  misc_feature: Ceres CLONE 1534757
  misc_feature: Encodes the peptide sequence at SEQ ID NO. 64728
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (377)..(377): n is a, c, t, g, unknown, or other
  misc_feature (386)..(386): n is a, c, t, g, unknown, or other
ggccgctctacaactagtggatcccccgggctgcaggaattcgtctcacccctagaaaaaaccgcaagaccaacaaacccacttctgactgaccactgtgccgcgccgtggtcaccggacggacacacagaatgacgatggccgcgtcggcgctgcaccaaaccaccagcttcctcgggcaggccctggtctcccgcgccgccggcgtcaatgccggcggccgcatcaccttgcgccgcaccgtcaagagcgttcctcacaacatatggtacgggccctcatccccccaattatcttgtcccgcttctccaagcagaacgccgccccaccttttttttcccccccccccggggaaaaagaaaggggannnnnntttnttttctttnccctaccccccaaacttttataaacaaaaatctttatcttacacggggggtccctcccccctcttgccccaatcctaccccccccccttgtttcttcgtagcctccctcgataaaccctccactaaacaaataatagtttatactccccccctaaacccccttacgctcttccaagcttgaatccaaacctcataacttctcttacatcgttcagattgtatatctctcccctgtgccatacccccgtctctattaccttttcctatcacctccccccctgccactaccttccactgcacccacaggcctggtgctatagtaggttcgccgcaacaataccccccgactttccacttggccccatttcccccaacgctataatcacctaatcgtcattctg

SEQ ID NO: 64728 - protein, 120 aa, Zea mays
  misc_feature: Ceres CLONE 1534757
  misc_feature (77)..(77): Xaa is any aa, unknown, or other
  misc_feature (78)..(78): Xaa is any aa, unknown, or other
  misc_feature (79)..(79): Xaa is any aa, unknown, or other
  misc_feature (80)..(80): Xaa is any aa, unknown, or other
  misc_feature (83)..(83): Xaa is any aa, unknown, or other
MAASALHQTTSFLGQALVSRAAGVNAGGRITLRRTVKSVPHNIWYGPSSPQLSCPASPSRTPPHLFFPPPPGKKKGXXXXFSXPYPPNFYKQKSLSYTGGPSPLLPQSYPPPLFLRSLPR

SEQ ID NO: 64729 - DNA, 613 bp, Zea mays
  misc_feature: Ceres CLONE 1534765
  misc_feature: SWISSPROT Homolog: EC 3.2.1.23 Beta-galactosidase
acccgcggtggcggccgctctagaactagtggatcccccgggctgcaggaattcgtctcacccctagaaaaatcttctgtttgctatctctctctctgcatgtttggcgtcagtctttgtgctcatgtacgtgtgtctacatgcatgttggttgatccgattgcgtctgctgtaaccatatattaattggtccacgatgatacgatttgatcctatatatatatatatatacacacaaaaaaaaataaacgagacgctccagggacccaattcaccctatagtgagtcgtattacgctcgctctctggccgtcgtttattatcccgcgacagcaaaaaccctggagttaccccacttattcgtcttgcaccacatccccctttggcctgctggtgtaatacccaagaggcccgcaccgatcaacccttcccaacaattgcgcaccctgaatggcgaatggaaattgtatgcgttaatattttgttaaaattcgcgttaaatttttgttaaaccagctcatttttttaaccaataggccgaaatcgccaaaatcccttattaatcaaaagaatataccgagataggggtgagtgttgttccaatttggaacaag

SEQ ID NO: 64730 - DNA, 835 bp, Zea mays
  misc_feature: Ceres CLONE 1534773
  misc_feature: Encodes the peptide sequence at SEQ ID NO. 64731
  misc_feature (1)..(1): n is a, c, t, g, unknown, or other
  misc_feature (7)..(7): n is a, c, t, g, unknown, or other
  misc_feature (12)..(12): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (52)..(52): n is a, c, t, g, unknown, or other
  misc_feature (835)..(835): n is a, c, t, g, unknown, or other
ntaaaanccccnggtccccccccccttttattattnnnnnnntttatatttnattaacatcggcactccccgcggtggcggccgcctctagactattgggatccccgggctgcaggaattcctctcacccctagaaaaacaacacgggcaacactctcacgcccggagtgggcgagtggcacaccgcacaccagccttcgtcttcctcgcggtttcctccactcccgtcgcccgttccacctgtgacctgccaggccccaagcctgaccgacttcgcttaaggctcctggtgacccccgtccactctcctcgcgatgtctgacgtcacctccgactcggcttatacaccgccagtcgcgcccgcccaccctccccaccctttgccgaaagcacacttctccaaataccagccgaaccttgtttttttccccccccctcactggggaggggggccgcggcggcccgtcatttaaccatcgtaacttccccccccgccctcggctcttacctactccacttacttccgttctcattgtcaccaatctccgcgcgctcccacactcctcccccttcccctctaccgacacctactctagcaaacctctatactctactacataatcactagacacccattctcgtgaagacagcacaatctctccctaccctcccgccaccacccccctcgaccgctccgcctaaccacacccacttcccaccatgcgtcgaccacccccaccccgctctaccaacactcctccacccccacctcgcttcattaaaccacaacccgcccacttccccccttctatatcttaacggcgtctctttattn

SEQ ID NO: 64731 - protein, 32 aa, Zea mays
  misc_feature: Ceres CLONE 1534773
MRRPPPPRSTNTPPPPPRFIKPQPAHFPPSIS

SEQ ID NO: 64732 - DNA, 557 bp, Zea mays
  misc_feature: Ceres CLONE 1534776
  misc_feature: Translation starting site: 149
  misc_feature: SWISSPROT Homolog: EC 4.1.2.13 Fructose-bisphosphate aldolase
ccccgcggtggcggccgctctagaactagtggatcccccgggctgcaggaattcgtctcacccctagaaaaattccccgtttgccttgtttaccattcctccccaaaacacatcctgcgatcctcgaagcctccgccgagcatcgatcatgtcggcctactgcggcaagtacgcggatgagctcatcaagatgctgcctacatcggcacccctggcaagggtatccttgctgctgatgagtcaactggcaccattggcaagcgcctttcagcatcaatgtcgagaacgtggaggagaacggcgggctctccgtgagctcctagtctgctgccctggtgccctccagtacatcagcggtgtgatcctcttcgaggagaccctctaccagaagaccaagatggcaagccttttgtcgatgccctcaaagaaggaggcgtccctccctgggatcaaggtccaaaaggccacccttggaagttggtgggcccccaacaaggaaacccccccccaggggccccaatgacccccggaaagcgctggccctaaataccaacaag

SEQ ID NO: 64733 - DNA, 756 bp, Zea mays
  misc_feature: Ceres CLONE 1534780
  misc_feature (43)..(43): n is a, c, t, g, unknown, or other
  misc_feature (45)..(45): n is a, c, t, g, unknown, or other
  misc_feature (47)..(47): n is a, c, t, g, unknown, or other
  misc_feature (756)..(756): n is a, c, t, g, unknown, or other
aaagaaaaaggggaggggggggagaaaaacacgagaaaaaacncncncccccccttcccgcacactggagctccccgcggtggcggccgctctagactagtggatcccccgggctgcaggaattcgtctcacccctagaaaaacctggtgggcggcgccttcgacggcgcgtccatgaaccccgccgtgtccttcggccccgccctcgtcagctgggagtggggctaccagtgggtgtactgggtcgggcccctcatcggcggcggactcaccggcgtcctctacgagctgctcttcatctcccacacccactagcagctcccctccaccgactactaaaagccgaagccgaccgacctacgggtgcgcagcgcagctagcgcatccagctctctctccccgctcgccgccgttaagtatctctcgtgcacgtgcctgcctcgctgactgccttatgcccgccgactgcgcccgcaccgcttcgtatctgttttgcttccattgggagccaacagcccttcccccccccaagcctaaaattctttcgaaaccggtcgtatacccggaagcccttcttgccctctcgcaaatatttctatcccatctcgcccccgaaatcgatctatcaaactacaagaccacaacagtacacccccttacccacgacaccccccccctttacgccaccttaactagatgaagtcaagacaaatcttagaataagaccgcaacaaaatattaaactcctacccaaan

SEQ ID NO: 64734 - DNA, 646 bp, Zea mays
  misc_feature: Ceres CLONE 1534781
  misc_feature: Encodes the peptide sequence at SEQ ID NO. 64735
ggagctccccgcggtggcggccgctctagaactagtggatcccccgggctgcaggaattcgtctcacccctagaaaaatttcttaacgcacacgtgtctgctaatgatgtatgcttataatatctatattttggtctacatcgatttggttgtagcacggataatgtttgtttcaaatattctgctctgcgaattagaattgtgatgttttgcttatcaaaaaactaaaacaacgagacgctcgatgtacccaattctccctatagtgagtcgtattacgagcgctcactggccgtcgattttacaacgtcttgactggtaaaaccctggcgttacccaacttaatcgccttgcagcacatccccctttcgccagctggcgtaataccgaagaggcccgcaccgatcgcccttcccaacagttgcgcagcctgaatggcgaatggaaattgtaagcgttaatattttgttaaaattcacgttaaatttttgttaaatccgctcatttttttaaccaataagccgaaatcggcaaaatcccttataaatcagaacaatagacccacatagggttgagtgttgttccagtttggaacaagagtccactatcaaagaacgtgaactccaacgtcaaaaggcgaaaaacc

SEQ ID NO: 64735 - protein, 33 aa, Zea mays
  misc_feature: Ceres CLONE 1534781
MMYAYNIYILVYIDLVVARIMFVSNILLCELEL

SEQ ID NO: 64736 - DNA, 773 bp, Zea mays
  misc_feature: Ceres CLONE 1534782
  misc_feature: Encodes the peptide sequence at SEQ ID NO. 64737
  misc_feature (18)..(18): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (663)..(663): n is a, c, t, g, unknown, or other
ttttttaaataaaaatgnttgcgagaattttggatggnnnngggggnnnnnnnntnnntggagctccccgcggtggcggccgctctatttctactggatcccccgggctgcaggaattcgtctcacccctagaaaaaagaggaggaaaaaaacacccaaaaaaccaccttcttttcctgcgttcccctgctcgatccccgacgagaattcgctcccgaacccatcgatctgctctccgcagtccgccgatccgtggatcgatccgtgcgcgggctcggtccgccccgggttccgatctggtcgccgcctcgcctgaggagatgaacggcgccgggggcagccaccaccagcaacatcagaggctccggcagcagcatcagcaagcgctcctgatgcagcaggcgctgcaaaattagtagtcgcaacagcagtaccagggacgggagtcctccgccacgagaggcgaggggtggccccaaaaactagaaggaaaccttggttccaaaaggagaaacttataccattgggggatagatacatttccgctctaggctgacaagaggggataggcgggaaataggggaaccccataataggacaaaagaaaagacctttataaaaacaaaccattaccccataatagacagtgagctccgcgccgcnacggcatagcgtatctaaccaaaagatcgcaaatacagcgatacgtctacgttagtgacacgtagccggcaaatacaatctaataacacccaaccgaaatgtataggatt

SEQ ID NO: 64737 - protein, 31 aa, Zea mays
  misc_feature: Ceres CLONE 1534782
MNGAGGSHHQQHQRLRQQHQQALLMQQALQN

SEQ ID NO: 64738 - DNA, 731 bp, Zea mays
  misc_feature: Ceres CLONE 1534783
  misc_feature: Encodes the peptide sequence at SEQ ID NO. 64739
  misc_feature (396)..(396): n is a, c, t, g, unknown, or other
atagctggagctccccgcggtggcggccgctctagaactagtggatcccccgggctgcaggaattcgtctcacccctagaaaaaaaccggtccaacgggacctatgctctagcctcagagcaaaccaccgcctgaattgggcggcaattgggggaggattcgcggcaggcagggcgcggatccgttggcgggatgattgcggctgtcaacagagtgccggcgggctggggcgacgatgagatgtccgtgctgccgcggcacaccaaggtggtggtcaccggcaacaaccgcaccaagtcggtgctcgtgggattgcacggggtcgtgaagaaagccgtcggcctcggaggatggcattggctggtccttactaatggaatagaggtaaagctgcancggaatgctttaagtgtgatagaacctccgactggcaacgaggatgatgataaatttgattgtgaaaacatgcagtggaatagttcagatatggcctccgatgatgcactatcaccaaagccacagcggtcacggagcaggcagcataggggtttccacgaaaatccttcagccgttcaatgtcatgtgactcccactccaagacgtctgtttcctctccttcaagagctccacgaaagttgacctaaccagccagaactgactgcactgctgagaaattggcgtcccttcatcccagggatgccctaatcctccagaaagcagttagttgatcg

SEQ ID NO: 64739 - protein, 148 aa, Zea mays
  misc_feature: Ceres CLONE 1534783
  misc_feature (68)..(68): Xaa is any aa, unknown, or other
MIAAVNRVPAGWGDDEMSVLPRHTKVVVTGNNRTKSVLVGLHGVVKKAVGLGGWHWLVLTNGIEVKLXRNALSVIEPPTGNEDDDKFDCENMQWNSSDMASDDALSPKPQRSRSRQHRGFHENPSAVQCHVTPTPRRLFPLLQELHES

SEQ ID NO: 64740 - DNA, 627 bp, Zea mays
  misc_feature: Ceres CLONE 1534791
  misc_feature: Encodes the peptide sequence at SEQ ID NO. 64741
tggagctccccgcggtggcggccgctctagaactagtggatcccccgggctgcaggaattcgtctcacccctagaaaaaaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaaataagacgttgtgactgtgccatcgtcgcctcaaaaaaaaaaaaaaaaacgagacgctcgaggtacccaattcgccctatagtgagtcgtattacgcgcgctcactggccgtcgttttacaacgtc

SEQ ID NO: 64741 - protein, 63 aa, Zea mays; identical to SEQ ID NO: 8705
  misc_feature: Ceres CLONE 1534791

SEQ ID NO: 64742 - DNA, 624 bp, Zea mays
  misc_feature: Ceres CLONE 1534792
  misc_feature: Translation starting site: 172
  misc_feature: SWISSPROT Homolog: EC 3.2.1.23 Beta-galactosidase
tggagctccccgcggtggcggccgctctagaactagtggatcccccgggctgcaggaattcgtctcacccctagaaaaaatctgttttatcctgcatcatcataacaagttgctacaagtcttgcatgttcgtgttgtttgtgcatttccgcgagaacatagcatttttatatgctcctcctccctacacactaccctcttccacaagaaagaggaagaaaaaaaaaaaaaactagcccccccaggtacccaattccccccatagtgaatcatattacccgcgctcactggccatcggtttacaaaatcgtgactgggaaaaccctggctttacccaacttaatcgccttgcagcacatccccctttcgccagctggagtaataacgaaaaagcccgcaccgatcgcccttcccaacaattgcccaacccgaatggcgaatggaaattgtaacccttaatattttgctcaaattccccttaaatttctgttaaatcagcccatttttttaacccataggccgaaatcggcaaaatcccttataaatcaaaaaaatacacccacatacggttgaatgttgttccagtttggaacaacagccccctattaaataacgtggactccc

SEQ ID NO: 64743 - DNA, 634 bp, Zea mays
  misc_feature: Ceres CLONE 1534796
  misc_feature: Pfam Name: SecE Pfam Description: SecE/Sec61-gamma subunits of protein translocation complex
aagctggagctccccgcggtggcggccgctctagaactagtggatcccccgggctgcaggaattcgtctcacccctagaaaaaaagctgatttcccaaacgcaaaaccgcatcctgcacatcagcttccttccacattcgtctggagatctcgccccgtcaccatgggacgctgatcgacagcggggtggatcccctccgcgacttcggctaggacagcgtccgcctcgtctagcgctgccacaagcccgaccaccaggagttcaccaaggtggaagcgcggacgagagatcgggctcgtgcgccgtgggcttcgtcggcttcttcgattacgctcatcgtcatccccgtcacctatatcgtctccggttccggctaagcttagaggattactgggcgacgagctggagagtaaagccctacttttgggagccttagatcactaggatcccggcctcccgaacagtgttggtaatgaaatctttcagttccgctgtgtatcggacttaatcactgtactgagcagaccttctggatagcagaatgctgacgagactattgtgtccttgatcgctgtgccttttagcgaaatcaacccatacgcttgacgtacccaactcactcgaaaagtcccg

SEQ ID NO: 64744 - DNA, 559 bp, Zea mays
  misc_feature: Ceres CLONE 1534797
  misc_feature (46)..(46): n is a, c, t, g, unknown, or other
  misc_feature (47)..(47): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
ggagctccccgcggtggcggccgctctagaactagtggatcccccnngggctgcaggaattcgtctcacccctagaaaaaaccttcttcggctacctccccggcatcatctacgccgtctgggccatcaccaagtagccggccggtgcgttagcatgcaatgcgcgcgcagggtgatctcgtggcgggggacgcggtgtgcgcgtgnnntcttgagatgtgattcctttccttcccttggtttagttgctgctgctcctgctgatgtagtactggtgtatcaagtctttttaatttccttgaatagtttgctccgctgaaaaaatcagaaccctggcttggggttgctgcccactccttgtatttttaaaaccgttcctccctggaagatggtggccccctttcccccttttttggttaccccgggaatggagggaaatggaaaaatcccgggttgggccccccaaaaaaaaaaaaaaaaccggaacccccccagaggaccccaattttcccccccatttggggggggctatttttccgcccccccccccccccccccg

SEQ ID NO: 64745 - DNA, 661 bp, Zea mays
  misc_feature: Ceres CLONE 1534799
  misc_feature: Encodes the peptide sequence at SEQ ID NO. 64746
  misc_feature (388)..(388): n is a, c, t, g, unknown, or other
  misc_feature (390)..(390): n is a, c, t, g, unknown, or other
ggagctccccgcggtggcggccgctctatttctcgtggatcccccgggctgcaggaatttgtctcacccctagaaaaaccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcttacctgaccccccagttgggcggcgagggcngntgggacaccgccgggctgtccccggacccggaaggcgtcgcgccgaacagggcgctggaggggatccacggccggtgggcaatcctgggtgccctgggcttcttccccccgggagggttggaaaaatggggtgcccggggacttcacggagcccggtggggtccagggcccggccccccaatttttcgggaggggggggcttgaacaccttggccaaccccccccctgggtgctccgccaaaagcatcccgggttcggggggggggggggg

SEQ ID NO: 64746 - protein, 150 aa, Zea mays
  misc_feature: Ceres CLONE 1534799
  misc_feature (83)..(83): Xaa is any aa, unknown, or other
MASTIMAATSRIVAAKTPFLGQGRAAAAAANASPLRDVAAAAAGGRITMGNDLWYGPDRVKYLGPFSAQTPSYLTPQLGGEGXWDTAGLSPDPEGVAPNRALEGIHGRWAILGALGFFPPGGLEKWGARGLHGARWGPGPGPPIFREGGA

SEQ ID NO: 64747 - DNA, 643 bp, Zea mays
  misc_feature: Ceres CLONE 1534802
  misc_feature: Encodes the peptide sequence at SEQ ID NO. 64748
  misc_feature (532)..(532): n is a, c, t, g, unknown, or other
  misc_feature (548)..(548): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (583)..(583): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
aagctggagctccccgcggtggcggccgctctagaactagtggatcccccgggctgcaggaattcgtctcacccctagaaaaaactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttcgtggcggcggtggctatggtggcggcggctacngtggtggtgaggaatnggtggttggtgcgtcatgnnnnnnnnggtgaagcnaaaaaaaaaaaannnnnnnnnnnnnnnnnnnnnnaaaaaaaaaannnnnnaaaaaaaaat

SEQ ID NO: 64748 - protein, 135 aa, Zea mays
  misc_feature: Ceres CLONE 1534802
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (125)..(125): Xaa is any aa, unknown, or other
  misc_feature (130)..(130): Xaa is any aa, unknown, or other
MALANKLGGLLKKATSSNLSVYQAIRCMSSKLFVGGISYQTDDHSLRDEFAKYGQVIEARIIIDRESGRSRGFGFVTYTSSEEASAAITALDGKTLDGRSIRVNHANEKTGGFRGGGGYGGGGYXGGEEXVVGAS

SEQ ID NO: 64749 - DNA, 686 bp, Zea mays
  misc_feature: Ceres CLONE 1534803
  misc_feature: Encodes the peptide sequence at SEQ ID NO. 64750
  misc_feature (127)..(127): n is a, c, t, g, unknown, or other
  misc_feature (128)..(128): n is a, c, t, g, unknown, or other
  misc_feature (292)..(292): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (524)..(524): n is a, c, t, g, unknown, or other
ggagctccccgcggtggcggccgctctagatctagtggatcccccgggctgcaggaattcgtctcacccctagaaaaaacgcggtacgcgcacacagccaaaccatcctcctctccgccgcccgccnnagcagcacccaccgggcaagatgaagacgatcctggcgtcggagacgatggacatcccggagggcgtcacggtcacggtggccgccaagctggtcacggtggagggcccccgcggcaagctcacccgcaacttcaagcacctcaacctcgacttccatctgcangaggccggccgcaagctcaaggtggacgcctggttcggcacccgccgcaccatggccgccatccttttttcctcccccccctcgggaggggcggcgaggnnntcaccaagggctaaccgctaccaaatgagggtccgcctacgcccactttccccatcaccgcctccattaaccaacaacaacacccccaatccaaaatcaggaactttcctccccctatataaaaggtctngaaaggcggaccctgcttttaatggccatgcccctcccccctggtccaaaaaaaggtcaacgcatcaatctcctccctcttaacagaaaaccaacccccaatcctcaaatctccccttcccccccccctttcttccaccctaaaatgggcctgtgtgggagg

SEQ ID NO: 64750 - protein, 152 aa, Zea mays
  misc_feature: Ceres CLONE 1534803
  misc_feature (48)..(48): Xaa is any aa, unknown, or other
  misc_feature (82)..(82): Xaa is any aa, unknown, or other
  misc_feature (126)..(126): Xaa is any aa, unknown, or other
MKTILASETMDIPEGVTVTVAAKLVTVEGPRGKLTRNFKHLNLDFHLXEAGRKLKVDAWFGTRRTMAAILFSSPPSGGAARXSPRANRYQMRVRLRPLSPSPPPLTNNNTPNPKSGTFLPLYKRSXKADPAFNGHAPPPWSKKRSTHQSPPS

SEQ ID NO: 64751 - DNA, 683 bp, Zea mays
  misc_feature: Ceres CLONE 1534804
  misc_feature: Translation starting site: 556
  misc_feature (683)..(683): n is a, c, t, g, unknown, or other
acgctggagctccccgcggtggcggccgctctagaactagtggatcccccgggctgcaggaattcgtctcacccctagaaaaaagaagaagcgcggtttgctgacgtctccatcccatcatgtattatcctcagcctaccgtctccttggcggcggcggttgccctcctccgcccctcactccgccgccactctcaaagggcgtcatcccttctccgctcctccacgccgcctccatgggttagtgcgaggaggaggacggccgtctccgacgacttcttcaccgtctagttggacgctactgggagtggaaccggaaccggattccatcgacgacgggctcccctctccatgggagggagctgttttctacccccccgacggtgggggggggcacctcaaataccccaacacgctggagcgcctcggcctaggggacctcctcctcccccgattccggggggcgcgcccgttaaactgggcccttgcctggaaggacccctgaacagccctggccgcgcaacctccgaacccccctggctcgtctccccccaaaatgaccaagggccccccggccgcctacccccttggacgggaatccgggcgcccccggccctacaccctccgggcgcgtttacagggtggttcaagacatcaaatctcccccacaggggacatttttcn

SEQ ID NO: 64752 - DNA, 659 bp, Zea mays
  misc_feature: Ceres CLONE 1534814
  misc_feature: Encodes the peptide sequence at SEQ ID NO. 64753
  misc_feature (634)..(634): n is a, c, t, g, unknown, or other
ggagctccccgcggtggcggccgctctagaactagtggatcccccgggctgcaggaattcgtctcacccctagaaaaatcacggcggcggcggcggaagagtagcagcagcaggcggcgccgagtagcgtctccccacctcgagcttgccaccatggctagaggattgaagaagcatttgaagaggctcaatgcgcccaagcattggatgctggacaagcttggcggagcttttgctcccaaaccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaacgagaactacaggctgctgtatgacactaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaaggccaacgacaccatcnagatcgatctggagaccaacaagaa

SEQ ID NO: 64753 - protein, 168 aa, Zea mays
  misc_feature: Ceres CLONE 1534814
  misc_feature (94)..(168): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (161)..(161): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIXIDLETNK

SEQ ID NO: 64754 - DNA, 656 bp, Zea mays
  misc_feature: Ceres CLONE 1534815
  misc_feature: Encodes the peptide sequence at SEQ ID NO. 64755
aagctggagctccccgcggtggcggccgctctagaactagtggatcccccgggctgcaggaattcgtctcacccctagaaaaaacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctgggagaaggccggcgcctgcttcggcctcagcgagaaagactacttcgagactgccctctccttccgtaacccggatcacccactcctttcccctcaaagccaaaggtatcgagcccggacttcgggcgtctacggcccccaaggggaatccccagggccttccaaaagccggattcaacgccgacgcccggggaacccatggcaa

SEQ ID NO: 64755 - protein, 188 aa, Zea mays
  misc_feature: Ceres CLONE 1534815
  misc_feature (30)..(186): Pfam Name: Ribonuclease_T2 Pfam Description: Ribonuclease T2 family
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWEKAGACFGLSEKDYFETALSFRNPDHPLLSPQSQRYRARTSGVYGPQGESPGPSKSRIQRRRPGNPWQ

SEQ ID NO: 64756 - DNA, 656 bp, Zea mays
  misc_feature: Ceres CLONE 1534823
  misc_feature: Encodes the peptide sequence at SEQ ID NO. 64757
  misc_feature (386)..(386): n is a, c, t, g, unknown, or other
  misc_feature (387)..(387): n is a, c, t, g, unknown, or other
  misc_feature (389)..(389): n is a, c, t, g, unknown, or other
  misc_feature (395)..(395): n is a, c, t, g, unknown, or other
  misc_feature (402)..(402): n is a, c, t, g, unknown, or other
  misc_feature (407)..(407): n is a, c, t, g, unknown, or other
ccccgcggtggcggccgctctataactagtggatcccccgggctgcaggaattcctctcacccctagaaaaacgtacttcagggatacatacaaggttgatatggtcttctatgttgatgagattgcaagggttgtgcaagatcatttcgggaaccatggaaagcctcttctgtttctgctacatgggaggaatactgactctggaaatttctcaaagcctgctagttttgaagggatggagaactttgatactgatttaattacacttcatccttttttacccgaatggcgggtgattaaatctgatctgtatcttgccctccatccgtatgctaaagcaggcttttttttttcccccccccaggggaaaagaaaggggggccanncnttaaanaatttcncttanaaacaatctaacaacaccatgtttatatgggggggggggtgcgacattcctccttaaacctgacaagggcccccccgaacaaaaaacggcctccctaccataaaggacaatgccgcacccttcccaaacacccgcattcttaaactatgacaaaacagcgccctattcaccaactcgctaacctcaaaaccccattcccacggccactctaactccccccggcccccctacccccaccggagaggggga

SEQ ID NO: 64757 - protein, 120 aa, Zea mays
  misc_feature: Ceres CLONE 1534823
  misc_feature (95)..(95): Xaa is any aa, unknown, or other
  misc_feature (96)..(96): Xaa is any aa, unknown, or other
  misc_feature (98)..(98): Xaa is any aa, unknown, or other
  misc_feature (101)..(101): Xaa is any aa, unknown, or other
  misc_feature (102)..(102): Xaa is any aa, unknown, or other
MVFYVDEIARVVQDHFGNHGKPLLFLLHGRNTDSGNFSKPASFEGMENFDTDLITLHPFLPEWRVIKSDLYLALHPYAKAGFFFSPPQGKRKGGXXLXNFXXKQSNNTMFIWGGGCDIPP

SEQ ID NO: 64758 - DNA, 612 bp, Zea mays
  misc_feature: Ceres CLONE 1534825
  misc_feature: Encodes the peptide sequence at SEQ ID NO. 64759
  misc_feature (302)..(302): n is a, c, t, g, unknown, or other
  misc_feature (317)..(317): n is a, c, t, g, unknown, or other
  misc_feature (442)..(442): n is a, c, t, g, unknown, or other
tggagctccccgcggtggcggccgctctagaactagtggatcccccgggctgcaggaattcgtctcacccctagaaaaaagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtgncgcccgactacctgnacggctcgctggtcggcgactacgggttcgacccgttcggtctcgggaagcccgtggagtacctgcagttcgagttggactcgctgggacagaaccctgcccagaatgaggccggcggcatcatncggcacccggttcgagtcctccgaagtccaagtccacccggttgcagccctacagccaagtgttccggcttccaacgtttccccgcaggtgcaagttcattcccggcccctttgggccttggttccccaccctttgggggccctttccccgtcaaagggggttcccccgg

SEQ ID NO: 64759 - protein, 166 aa, Zea mays
  misc_feature: Ceres CLONE 1534825
  misc_feature (64)..(64): Xaa is any aa, unknown, or other
  misc_feature (69)..(69): Xaa is any aa, unknown, or other
  misc_feature (110)..(110): Xaa is any aa, unknown, or other
MASSVAAAASTFLGTRLADPAPQNGRIVARFGFGLGGKAKPAPKKVAKTSTSSDRPLWFPGAVXPDYLXGSLVGDYGFDPFGLGKPVEYLQFELDSLGQNPAQNEAGGIXRHPVRVLRSPSPPGCSPTAKCSGFQRFPAGASSFPAPLGLGSPPFGGPFPVKGGSP

SEQ ID NO: 64760 - DNA, 635 bp, Zea mays
  misc_feature: Ceres CLONE 1534826
  misc_feature: Encodes the peptide sequence at SEQ ID NO. 64761
  misc_feature (635)..(635): n is a, c, t, g, unknown, or other
aagctggagctccccgcggtggcggccgctctagaactagtggatcccccgggctgcaggaattcgtctcacccctagaaaaaatccttcggttggtgacgaacgcacagcatcggcaggcatctgcgtgcgcgtgccagtgacagacgacagatgatctccttcttcgacgaggccgaggccatgatgcagcttgacttcgccgccggccagccgctgctgccagtgccagtgccagtgccaggcatgcacgccgtcggcttcgccttagacgacttcgacttcggagcgacgacggccggcgatgcttccggtttccatttcggcgccggcacggcgacgtgcggccgcgctgcgggcggttccggtttcggtacctgcacgacggcaggcggcgccgaggacgaggaggagcggctgcgccggctgaagcgcaagatatcgaaccgggagtcggcgcggcggtcgcgggcgcggcggcggcagcgggcggaggagctggcgcgcgccgcggaggcgctccgcgcccagcgccgcgcgctggcggcgaggtcggacgccgcggcggcccgcgcgctcgccgcaaggatcgacaacgcgcggctccaggcggaggcgcgcgcgctccggcgccn

SEQ ID NO: 64761 - protein, 160 aa, Zea mays
  misc_feature: Ceres CLONE 1534826
  misc_feature (86)..(149): Pfam Name: bZIP_1 Pfam Description: bZIP transcription factor
MISFFDEAEAMMQLDFAAGQPLLPVPVPVPGMHAVGFALDDFDFGATTAGDASGFHFGAGTATCGRAAGGSGFGTCTTAGGAEDEEERLRRLKRKISNRESARRSRARRRQRAEELARAAEALRAQRRALAARSDAAAARALAARIDNARLQAEARALRR

SEQ ID NO: 64762 - DNA, 763 bp, Zea mays
  misc_feature: Ceres CLONE 1534834
  misc_feature: Encodes the peptide sequence at SEQ ID NO. 64763
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (763)..(763): n is a, c, t, g, unknown, or other
ttttnnnnnnnnggagnnggctggcggcggaggttgtggtgcctnnnnttttcatagctggaactccccgcggtggcggccgctctagactagtggatcccccgggctgcaggaattcgtctcacccctagaaaaactagaaaaacaaaatggatcaaagcatccaaaggagaaacctccgagcacatcgagcaccgaataaccatggctggtcgtgacgcagaaatatagatcctgcttggctggtttgaggatctttaagtccgtctgatccatgccttggacctcaacgtcagttatatactctctagtgtgttcatttcctcttgtttcaagtattgtgttgtcgtgctgccaatgtgtctccaaactgtatgtggtcaccatggcattgggatgatgcgaaaaaattatgagcgcaaaaaaaaaaaaaaaaacgagacgctcgaggtacccaattcgccctatagtgagtcgtattaacgccgcgctcactgggccgtcgtttttacaacgtcctgactgggaaaaacccctggccttaccccaacttaaaccgcccttgcaaaaaaatccccccttttcaccagcttgggcgtaaataagcgaaaaaaggccctgccacccaatttgccccctttcccaaaaagttttgcgccaaccccttgaatgggccaaaaagggaaaaaatgagaaaccgcgtataaaaaatttttggtgttaaaaaattcccgcgggctaaaaaaattctttggacaaaaan

SEQ ID NO: 64763 - protein, 41 aa, Zea mays
  misc_feature: Ceres CLONE 1534834
MPWTSTSVIYSLVCSFPLVSSIVLSCCQCVSKLYVVTMALG

SEQ ID NO: 64764 - DNA, 1707 bp, Zea mays
  misc_feature: Ceres CLONE 1534835
  misc_feature: Encodes the peptide sequence at SEQ ID NO. 64765
agagcctccctcctcaccctggaaaacacacgcacgcagacctcccccaaccgctctcagtctctccctccctgtctctctgttcaatctctcggctcgccatggacgctccgagcaactgcacgcgtcctgcgcgcgccaagtgaccgaacaagctgagctctgctgctacagttgcttgcccctgtgccaaactggcaggaggtaggtagcttatagcatagcagctagagctaagctgtggtgcgtagcggcagctagagctagcttgtgcacgcgcaggtgcgtgctagctagctagcttgttagctgtgtactagctgtgtagcagcagcagcagcacagtagcagtagtcggtgataaaaggaatttctttggggacatgtcggtggagagagccccggtgctggtgaggcacggcggcggcggcgtggaggcgctccggcagctcccgccggggttccggttccgccccacggacgaggagctcgtggtgcagtacctccggcgcaaggccatcggcgtgccgctccccgccgccgtcatccccgtcttccgcgacctctacagccgcgacccctgggacgtcgttgccgtctctgcccctgatacgaggagcgagggggagaaatacttcttcgcggtgcggccggcaagcggcggcaagagcagcggcgctggtactggtagcagggcggccgcgagcgggcggtggaagccgtcggggaaggagaagccggtggtgctgccccgcccgtgtggcggagggagcctcctggtgggcgtgaagagggcgatgacgttcgtgccccgccgccggaagaagacggcggcgttgccgtcgtcggcggccctgaagaccggctgggtcatgcacgagtaccgcctcgccgcgctgctgcacaagaacggctgcagcctggctcaggcgcaaggagagtgggtcgtctgccgcgtcttccagaagggcggcaacaggccgaggaggaggcagcgagaagcgtcgccgccgccgcccgctagcagcagctgcgtcacggatgcgtcgagctcggacctggacgaggtcagcagctagcttagctagctagctagcagaaccgaccgtacgtgccggctggccacaacatgcagtcaagaacgtacgtacgtacgtatgtataccgccaccagctcgtcgcgcgcgcagctgtgctgtgcatgccgtacgtgtgcggccggcctcgacctcgatctcgaagagaggatgtgatcaagctgagttacggataagggggaacaacccatccacacgcacttctcctccgacccaacattatttgttgttaactagtttttcttttctttatctctttctttcttttgcactctgtacgtgtaatgtaatgcagtgtaatttaattagtgagagaagcatgacgccctactaccggccggattattagttaacagcaaattaattactacgtacctactactcgcgtcagcagcttctactgtacttgaggtttcagaagcccaatatgtatattgtcaaattagtaacctgcattatatgcagaggtcgtcgtacgtgtccttaattagtgtctttgtaatatctcttcatgaagcgaggaggaaggaaggaacctgaatccatgcgtaacagcgcagtcgttgctgcatatatgcgttgggctctgtgtcaaaaaaaaaaaaaaaaa

SEQ ID NO: 64765 - protein, 231 aa, Zea mays
  misc_feature: Ceres CLONE 1534835
  misc_feature (23)..(170): Pfam Name: NAM Pfam Description: No apical meristem (NAM) protein
MSVERAPVLVRHGGGGVEALRQLPPGFRFRPTDEELVVQYLRRKAIGVPLPAAVIPVFRDLYSRDPWDVVAVSAPDTRSEGEKYFFAVRPASGGKSSGAGTGSRAAASGRWKPSGKEKPVVLPRPCGGGSLLVGVKRAMTFVPRRRKKTAALPSSAALKTGWVMHEYRLAALLHKNGCSLAQAQGEWVVCRVFQKGGNRPRRRQREASPPPPASSSCVTDASSSDLDEVSS

SEQ ID NO: 64766 - DNA, 830 bp, Zea mays
  misc_feature: Ceres CLONE 1534838
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
nnnaaaaaaggaaaaaaaaggagaaaaagaaacaaccaataatatattattgaaaaaatggaactcaccgcaatggcggccgctctataactagtggatcccccgggctgcaagaattcgtctcacccctagaaaaactttttgaatcaatttcttttgtaatcaactccgacgatatatattgtaatcttgttataacttgtaaatgttgtaacttgtaaccattttgtaataaagaagttccgctgcatagctatcacaataaacaaaaggacagctaaaaaaagtaaaaaaaaaaagaaaaaaaaaaaaaaaaaaaactatatataaataataaattaaagaataagtttaaggagcacagaaacacacatcgttacttgtggtaaataatagaaaacaatcgcccccgctcgagggaaacattcttattagacttattagatgaaagaaaaatacacaccccgcacaatataaagtccatgtatttttaatataaccatcctcgagagggaaaatcaacttgtggtacttatttcacaaattaaagagcccctaggaagacgaaataaatacctttattcatccgtgtatttggtttcacaccggaatacaacaaagatggatcatggaacgagacaccggttctcataaattactagccacgaacccatgtatagacggataatgatgcatacaaaagacaaaatatcaaaatatatagtgagttgtccatcatcggctaacaatcaacattactatacctacaaaatacatatgttttcttgttcagatactaaagagcgcgggggcgaaggattaaactactc

SEQ ID NO: 64767 - DNA, 479 bp, Zea mays
  misc_feature: Ceres CLONE 1534839
  misc_feature (192)..(192): n is a, c, t, g, unknown, or other
  misc_feature (204)..(204): n is a, c, t, g, unknown, or other
  misc_feature (205)..(205): n is a, c, t, g, unknown, or other
tggactcccgcggtggcggcgctctgaatagtggatccccgggctgaggaattcgtctcacccctagaaaaaatccaacgaactgaccacaactacctaagctaaaagctaaccaccgtacccccggccatggcgctcgcgccacctcgctgcgtgctcagacccgttctcggggcagggcgcctcgcaagncggggctcgcgnnggtcgtaatcgcgcgcggcgccgcaaaagtcctgatcccgccatcagaggaccccaaatcgcaccggcctgggtcaagggtccttccccggaaattgggttcaacccctggggtggggaaagaccgcgtttcctcagggggcccggggggggaatttacccccgggggggggaaaagggccccctttggaatttttgggggggggggggaagaggttctccttttttaaaggggggggaaaaaaaaagaaaatacccccttttcttctgggggg

SEQ ID NO: 64768 - DNA, 826 bp, Zea mays
  misc_feature: Ceres CLONE 1534842
  misc_feature: Encodes the peptide sequence at SEQ ID NO. 64769
  misc_feature (11)..(11): n is a, c, t, g, unknown, or other
  misc_feature (12)..(12): n is a, c, t, g, unknown, or other
  misc_feature (42)..(42): n is a, c, t, g, unknown, or other
  misc_feature (683)..(683): n is a, c, t, g, unknown, or other
ctttttctctnnttttttttttatggtaaagtatttccaaancacctcttttcccaaactggaactccccgcggtggcggccgctctagactagtggatcccccgggctgcaggaattcgtctcacccctagaaaaactccaaacacctacctctctacgaactacctgccgccggaaaaccctagagcgctcgaccatggatccgcagcagccggagcctgtcagttacctctgcggagattgcggagctgagaacaccctgaagcccggagatgtcatccagtgccgtgaatgtggctaccgcatcctctacaagaagcggacccgccggattgtccaatattaagcgcgctgaagagtgaagacaagggaaaaacctgaagaaggttgaactattactccgccacatttccctaggtaaacacgcctttctgggggggaaaaatggaaaaatggtcaaaatttaaacggattggaaatgtccggggggggcctccccttttgaaacctcggaagcctgtgataaattgttgtgtaaacccctttggaacctgggggggacactgaatatttgaagaaaacatggaaaacccctgtgccagccataatattgtttggaatgggggcccctctaaggggggccaaaatctcaattgcccctcgcccgtggttatcgtccccntcagcagaagaaggtggaaactttccagatagacagcaaatattctgggtaattaagataaagaaaagaatccccgggggacccctcctcgtggtgtaccacaattttcccccccccctattttgggggggtgcctaatttta

SEQ ID NO: 64769 - protein, 49 aa, Zea mays
  misc_feature: Ceres CLONE 1534842
  misc_feature (11)..(42): Pfam Name: DNA_RNApol_7kD Pfam Description: DNA directed RNA polymerase, 7 kDa subunit
MDPQQPEPVSYLCGDCGAENTLKPGDVIQCRECGYRILYKKRTRRIVQY

SEQ ID NO: 64770 - DNA, 617 bp, Zea mays
  misc_feature: Ceres CLONE 1534843
  misc_feature: Encodes the peptide sequence at SEQ ID NO. 64771
aagctggagctccccgcggtggcggccgctctagaactagtggatcccccgggctgcaggaattcgtctcacccctagaaaaaaaccatcaggacgcggatgcggctcacatcaaacaccccctcctcccccttcagctgtgctcactgccgcaaaaccacacagccacacaggcaaccagcgcccagcgccctttgacatcaccacatccacgctccgttccatggccatgtcgagcagcgccagcaagaagcaagcccaggcccaggcccagaaggcgcgaaggcccccggcggtgtcgtcggccgcggccgcggacgcggagatgcagagggtgttctcgcgcatcgacgcggacggcgacgggcggatctcgccgtcggagctggcggcggtgtcgcgcgccatctccccgccggcgagctcctcgcacgggcggcgcgaggtggcggccatgatggaggagctggacacggaccgcgacggcttcgtggacctgggcgagttcagggcgttccacgcgcgcggcgccggcgacgacgacgacgacgccgagctccgcgccgcccttcgccgtgtacgacgccgacggcgacgggcgcatcacggcggccgag

SEQ ID NO: 64771 - protein, 129 aa, Zea mays
  misc_feature: Ceres CLONE 1534843
  misc_feature (32)..(60): Pfam Name: efhand Pfam Description: EF hand
  misc_feature (72)..(100): Pfam Name: efhand Pfam Description: EF hand
  misc_feature: SWISSPROT Homolog: EC 2.7.11.1 Non-specific serine/threonine protein kinase
MSSSASKKQAQAQAQKARRPPAVSSAAAADAEMQRVFSRIDADGDGRISPSELAAVSRAISPPASSSHGRREVAAMMEELDTDRDGFVDLGEFRAFHARGAGDDDDDAELRAALRRVRRRRRRAHHGGR

SEQ ID NO: 64772 - DNA, 826 bp, Zea mays
  misc_feature: Ceres CLONE 1534847
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (53)..(53): n is a, c, t, g, unknown, or other
nnnnnnnnnnaaaataaagaaaaaaacagaagcaaaaaacactcttnnnnntnttaaaactagagctcaccgcgatggcggccgctctagaactagtggatcccccgggctgcaagaattcgtctcacccctagaaaaaattcaccaagtgttggattgttcacccaccaatagggaacgtgagctggggttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggattatgactgaacgcctctaagtcagaatccaagctagctaccggagcctctgctcgccgcccgccccgacccacgtttagggcgtttcgcgcccccaaggggcccgtgccctaatattaaaaaaaaaaaaacgtagaccgcttcaaggttacccaatttccggcccttatggtggtagtccgttattaaaagcggcagccttccctttggcccggtgcgttttttaacaaaccgttccttgggacttaggggaaaaaaccccctggagggttttacccccaaatttctaatatcaacactttggcaagcaataatccccccccttttcccacccaggctggggcccttatataatccttaaaaaaaggccccgaaaacctgaatttaaccccttcgccccaaatcatgattgtcgcccaacccttgaaaattggccgaaatgtggaaaatttggtattaccccgtttaaaaaaatattatgggataa

SEQ ID NO: 64773 - DNA, 472 bp, Zea mays
  misc_feature: Ceres CLONE 1534848
  misc_feature: Encodes the peptide sequence at SEQ ID NO. 64774
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
ggagctccccgcggtggcggccgctctagaactagtggatcccccgggctgcaggaattcgtctcacccctagaaaaaagagcagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccccgacagcagctgtggttcgcgtccagcagcccctctctacctcgaatggaccgctgcccggcgaatatggtttccaccccctggggccttttcgaaccccgaagggccccccggnnnnggggggggttttttttttttttaagcccccccagggggggggggcgccc

SEQ ID NO: 64774 - protein, 101 aa, Zea mays
  misc_feature: Ceres CLONE 1534848
  misc_feature (84)..(84): Xaa is any aa, unknown, or other
  misc_feature (85)..(85): Xaa is any aa, unknown, or other
MAAQALLSGRQLLGRPVQSAVSRSSARKAPFVVRASSSPPAKQGAPTAAVVRVQQPLSTSNGPLPGEYGFHPLGPFRTPKGPPXXGGVFFFFKPPQGGGAP

SEQ ID NO: 64775 - DNA, 698 bp, Zea mays
  misc_feature: Ceres CLONE 1534859
  misc_feature: Encodes the peptide sequence at SEQ ID NO. 64776
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (453)..(453): n is a, c, t, g, unknown, or other
  misc_feature (518)..(518): n is a, c, t, g, unknown, or other
  misc_feature (553)..(553): n is a, c, t, g, unknown, or other
  misc_feature (554)..(554): n is a, c, t, g, unknown, or other
  misc_feature (593)..(593): n is a, c, t, g, unknown, or other
  misc_feature (594)..(594): n is a, c, t, g, unknown, or other
  misc_feature (608)..(608): n is a, c, t, g, unknown, or other
  misc_feature (609)..(609): n is a, c, t, g, unknown, or other
  misc_feature (644)..(644): n is a, c, t, g, unknown, or other
  misc_feature (662)..(662): n is a, c, t, g, unknown, or other
nnnnttttnnngggcccaggcccccacctctttnnnnnnnnnnnnnnnntttttnnnnnnnaatactggagctcaccgcggtggcggccgctctatactagtggatcccccgggctgcaggaattcgtctcacccctagaaaaatcagccatcccctcccgcggcaagtctctctgaattgtgggtctccggcgatggcggctctagctccatccaagattctgggcaccaagctcaacttcgccggctcctcccgctacgccacggcagcgcccaccgcggggggctccgaaagatcggtcttcccctctttcagcaagaaagcctggcccagaaaggcccccaggcccctcttgcgggtggttcgtcccctctttcctcccggggaacatcaagctgaacccaaagcccccgcccaaaggtgggggtnnnncagggatctctttggacccngggcaagggaatcctaccccccgggccccgggaatttgggccccctccccctcccccaccccccntctgcggggggagggggggggggggggaacataanntcttcaaccaccgggaataaacaggcccccccgggtggnngaaccatacgagannttaaataacaccccctttttcgcgttttcctcgcncccccaaaagaatccccntcggggcgcgttttccccccccaaacccccccctcg

SEQ ID NO: 64776 - protein, 140 aa, Zea mays
  misc_feature: Ceres CLONE 1534859
  misc_feature (79)..(79): Xaa is any aa, unknown, or other
  misc_feature (80)..(80): Xaa is any aa, unknown, or other
  misc_feature (87)..(87): Xaa is any aa, unknown, or other
  misc_feature (120)..(120): Xaa is any aa, unknown, or other
  misc_feature (134)..(134): Xaa is any aa, unknown, or other
  misc_feature (138)..(138): Xaa is any aa, unknown, or other
  misc_feature (139)..(139): Xaa is any aa, unknown, or other
MAALAPSKILGTKLNFAGSSRYATAAPTAGGSERSVFPSFSKKAWPRKAPRPLLRVVRPLFPPGEHQAEPKAPAQRWGXXRDLFGPXARESYPPGPGNLGPLPLPHPPSAGGGGGGGNIXSSTTGNKQAPPGGXTIRXXK

SEQ ID NO: 64777 - DNA, 619 bp, Zea mays
  misc_feature: Ceres CLONE 1534860
  misc_feature: Encodes the peptide sequence at SEQ ID NO. 64778
  misc_feature (512)..(512): n is a, c, t, g, unknown, or other
ggagctccccgcggtggcggccgctctagaactagtggatcccccgggctgcaggaattcgtctcacccctagaaaaacaaaagaggaaaggcttgcggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcanggctaaatactcctgggtgaccgatagcgaagtagtaccgtgagggaaaagtgaaaagaacccccaatgggtagtggattgggctttcttaaaggtgggttggcttt

SEQ ID NO: 64778 - protein, 88 aa, Zea mays
  misc_feature: Ceres CLONE 1534860
GAPRGGGRSRTSGSPGLQEFVSPLEKQKRKGLRWIPRHPETRKGVASDEMLRGVENKHRSGDSQIGQPFELPAESMSRQETTWRTETS

SEQ ID NO: 64779 - DNA, 641 bp, Zea mays
  misc_feature: Ceres CLONE 1534861
  misc_feature: Encodes the peptide sequence at SEQ ID NO. 64780
tccccgcggtggcggccgctctagaactagtggatcccccgggctgcaggaattcgtctcacccctagaaaaaatgtgtccaagagcgatcctgaaggcttatcaaacttcggaattgaaggaatgtcgcctgaacttgtcaaaactgccactgatatgattggctcaatgaaaccagaggagcttcagaaaatgttcgaagttgcttcttcattgaatagcactagctccgctggtccaaatctgggacccaatatgccagaaatgtctcctgatatgcttaagatggcatctgacatgattgctagtatgcctcctgatgacgtacagaaaatgatgagttttgcttctcacatgggtgggcctggtggtgcccccaggagttcagagaatattaactttggaccttcagtgagagctacaacgagtaattctgcccgtggatcatcatctcaacctgttttgcagaaccctgatcgactatcacatgaccaaaggatgagccagtcatcctctagtcttccaccttctacagctgatatgcaagaaaccatgaggaaatctatgaaagaccctgcaatgcggaagatgcttacctccatgatgaataacatgagccccgagatgatggcaaatatgag

SEQ ID NO: 64780 - protein, 172 aa, Zea mays
  misc_feature: Ceres CLONE 1534861
MSPELVKTATDMIGSMKPEELQKMFEVASSLNSTSSAGPNLGPNMPEMSPDMLKMASDMIASMPPDDVQKMMSFASHMGGPGGAPRSSENINFGPSVRATTSNSARGSSSQPVLQNPDRLSHDQRMSQSSSSLPPSTADMQETMRKSMKDPAMRKMLTSMMNNMSPEMMANM

SEQ ID NO: 64781 - DNA, 687 bp, Zea mays
  misc_feature: Ceres CLONE 1534863
  misc_feature: Translation starting site: 149
  misc_feature: SWISSPROT Homolog: EC 3.2.1.23 Beta-galactosidase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (47)..(47): n is a, c, t, g, unknown, or other
  misc_feature (48)..(48): n is a, c, t, g, unknown, or other
  misc_feature (55)..(55): n is a, c, t, g, unknown, or other
  misc_feature (59)..(59): n is a, c, t, g, unknown, or other
nnnnnnnnnnnaaaaaaaaaaaataaaaaaaaagcataaattaggtnntggatantctnctcaaactgagactccccgcggtggcggccgctctataactagtggatcccccgggctgcaggaattcgtctcacccctagaaaaacatatgaaaactaatgtcggtgaagcaggacttacattcaacagtgcggagtcagcaaaagcatttgctgaaaaacatggatggaattatgtggtacggaaacggcatacacctcttctgaagcctaaggcctacgctgagaacttcaagtggaaaggccccccgaaggcggagcaagcatgagctcaaggcctccaccagcatgtgaccctgacactggaatgatgttattttcctcctgagctctagagtctagacctcttgtccgtgagccttttctttcaacagtgtccgtcgtgaaagtacgagctagaatacgcatctatcaaacttgtaataagcatgatctgtaatcaaacaaaaatccttccaaaacgtttgttccttgaaaaaaaaaaaaaaaaacgagacgctcgaggtacccaattcgccctatagagagtcgtattacgcgcgctcactggccgtccgtttacaacgtcgtgactgggaaaaccctggcgttacccaacttaatcgccttgcaagaaatccccctttcc

SEQ ID NO: 64782 - DNA, 758 bp, Zea mays
  misc_feature: Ceres CLONE 1534868
  misc_feature: SWISSPROT Homolog: EC 1.1.1.288 Xanthoxin dehydrogenase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (24)..(24): n is a, c, t, g, unknown, or other
nnnttccccctccccgccccaagnatgtttcgttttcttcttcccccccctcaaaagtggtactccccgcggtggcggccgctctagactagtggatcccccgggctgcaggaattcgtctcacccctagaaaaagtcgcccaggcggtgctctacctggccagcgacaaggcgaggtacgtcagcgcggtcaacctcatggtggacggaggcttcacagccgtaaacaataacctcagggcgtttgaggattagttgaggcatttatgccagctctgggattgggagggagtattaccactatttcttcagctgttgtgacaagtgagtgcaagactaataaactgcagcatgttcatgtagccaacagatgattgaacattcccagtatctttgctgaattcacgcatatagttgctcttccaaaagattaagtacaattccgtcccaaaataaaaaataaaaaaccaaaacgctccgaggtaaccccaattcgcccccaattaggggaaccttatttaacgcggccttcaccgggccaatcggttttaaaaacgtagaagacggggaaaaaaccctgggggtttacaccaactttatttcacctttagcaaaaaaattcccccccttttcacacagcctgagggtaattaagcgaaaaaaggcccccacaccaatctgcccctttcccaaaaaaatttggccaaaaccttgaatgggcctatagggaaaaatcgggaaagcggtttaaatttttt

SEQ ID NO: 64783 - DNA, 633 bp, Zea mays
  misc_feature: Ceres CLONE 1534873
aaagctggagctccccgcggtggcggccgctctagaactagtggatcccccgggctgcaggaattcgtctcacccctagaaaaaacttcgattcgctcccacgcacacacacactcctgcggttgccactcgcgtagcagtagcaccagacagcagcgcgcacgcgacgtccgcaatggcggcgcgggcaaccgtcgtcctctgcgccgcgctcctcgtcctgctctccgccaccagctccctcgcgcagtcccccgcggccgcgccggctaaggcgccgcccaagtcctcctccaaggccacgccggccgccgcccccgcgcccaagtcctcctccaaggccagcccatcggcgccggccgccgcgccaaccaccccggcacccgcggcggcgccggccacgacaaagcccaaggcccccgcgcccgcgcccgccaccaaggccgccgccccggccccggccccggccacccctgcacccgtcgccactccccccgcggcgacgcctcccgccgccgatgcgcccgtgcccgccgcggcaccggcccccgagaccaagcccgtcgaggcccccgcccccgcgccggccaagaagaagagccgtcgtccccctcctcaaggacaagaagagaa

SEQ ID NO: 64784 - DNA, 867 bp, Zea mays
  misc_feature: Ceres CLONE 1534880
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (466)..(466): n is a, c, t, g, unknown, or other
  misc_feature (468)..(468): n is a, c, t, g, unknown, or other
  misc_feature (487)..(487): n is a, c, t, g, unknown, or other
  misc_feature (577)..(577): n is a, c, t, g, unknown, or other
  misc_feature (815)..(815): n is a, c, t, g, unknown, or other
  misc_feature (867)..(867): n is a, c, t, g, unknown, or other
nnnnnnnnnnnnnnggggnttttttttcccaaacttnnnggccctaannnnnncaacacgggactccccgcggtggcggccgctctagaatagtggatcccccgggctgcaggaattcctctcccccctagaaaaattcgaccacgacgaccgaacccgccgtccgacccattcacccccgtggaccgtgccggtgccgcggcacgccgccgccgcaacgccatggggaaaccatcccgccgcccggaaacttccgttcttcaccaaatcctcctcgtccctctccaaagggaaaaccctccgggcgttcccctccccttccccttctatatgaatcacttcccccacgggtcgttggtgcgcccccccatgggcggtcttttttgttccggggagccgggaatatggtagccgggtgttttttttttcccccccccccccccgtggggggggggggggggtaccncncatattaccattatcatgnaatttttcccgcgcctaaaccacccataactataacccctgtttcttgggggggggtgggggtacttctctgctcccccccgtaccaccnccgggccgaccccccctattatcctcctcctcctctcaataagctcggcccactccttttttcgcccctaaccccgcgtgttcgtccccccaccgactccggccccgtgccccgggcggcccccggcgtggccttgtagacgagtccgcgccgctctcccacggagggtccccctccgccgccgcagcacagaggactacgcgggggggagatgatcatcttgattcgttagcaaaanggtcgaaaagttactagttatgtattccgtcttatccgtggtggcttgtctn

SEQ ID NO: 64785 - DNA, 574 bp, Zea mays
  misc_feature: Ceres CLONE 1534888
  misc_feature: Encodes the peptide sequence at SEQ ID NO. 64786
  misc_feature (430)..(430): n is a, c, t, g, unknown, or other
atagctggagctccccgcggtggcggccgctctagaactagtggatcccccgggctgcaggaattcgtctcacccctacaaaaactagtatagtgcagggctgcggggccgcagcagcgccatgaacgccgtcgaaccctccgccgccgccatcgccgaagaccccattactccggccgcctccgcagccccgtaccctggccgcctccgcgaagcacttaccgcccttagccaggcttgcgagtccggcaacttcaatgcttccgaaaccgcctccttcaccatctccgacattcttgacaccgcagccggcgtaagtggcgagctcgatgacgggagcgacgacagccaagacgcgtcgaggtcaggggcctccgaaatgctgcttcgcgaggtgctcgagttcctctctcgcccgtcatcgatctcnaaacaaatggccctttgacgcgctctcgcttgtgctttcccaaccccggggcgaagctaggggctccaatggggaaatgccgggatgttgcccgccacctatcccaaaagttcttcgtggaccaaatggcaatcccgagggacc

SEQ ID NO: 64786 - protein, 108 aa, Zea mays
  misc_feature: Ceres CLONE 1534888
MNAVEPSAAAIAEDPITPAASAAPYPGRLREALTALSQACESGNFNASETASFTISDILDTAAGVSGELDDGSDDSQDASRSGASEMLLREVLEFLSRPSSISKQMAL

SEQ ID NO: 64787 - DNA, 816 bp, Zea mays
  misc_feature: Ceres CLONE 1534893
  misc_feature (1)..(1): n is a, c, t, g, unknown, or other
  misc_feature (11)..(11): n is a, c, t, g, unknown, or other
  misc_feature (18)..(18): n is a, c, t, g, unknown, or other
  misc_feature (35)..(35): n is a, c, t, g, unknown, or other
  misc_feature (816)..(816): n is a, c, t, g, unknown, or other
nccccaaaggntagtggngattatacaggggaaantatccaactaaataaatactagggctccccgatgtggcagccgctctaaaactagtggatcccccgggctgcaggaattcgtctcacccctagaaaacatcaagaactcgtggggcgagaactggggggagaacggatactacaagatatgcaggggttccaacgttcgcaacaagtgcggcgtcgattccatggtctctaccgtgtccgcagtccacgcctgcgaggagtagactccggtcagcggtgataatcgtgattccatatatttgtagaaccataatccctgctaataatccatttgagctgtttaatgtttcggaggcagccaagatgtgtgaagcggcgatggggatggttggctacacagaaaaaatgttcaacgttgctaggcatgctaacaccctatctgaaatgacccaaatattatccccataccctcctacggtttttctcagacgacaaaacgctgacaataatttgcgccctcaccacctatagttccagcccctaaaaacgacaccagaaaaaaaatggaaaaaagtgcgtgagagtcaccaatatttcccccccttatatggataatcacaccattcaggacaccaccccacgcagggacgcgagaccgctttatacaaccacagcaagggacacatatcgaaataaccgccccacactgaattatctccaacgcttggaaatccgagacttttgataaacaccaccttcatcacactttttttccacatacctcgcggacattatttgacgcgaaataaan

SEQ ID NO: 64788 - DNA, 745 bp, Zea mays
  misc_feature: Ceres CLONE 1534894
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (81)..(81): n is a, c, t, g, unknown, or other
  misc_feature (207)..(207): n is a, c, t, g, unknown, or other
  misc_feature (212)..(212): n is a, c, t, g, unknown, or other
  misc_feature (266)..(266): n is a, c, t, g, unknown, or other
  misc_feature (328)..(328): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (388)..(388): n is a, c, t, g, unknown, or other
  misc_feature (389)..(389): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (476)..(476): n is a, c, t, g, unknown, or other
  misc_feature (478)..(478): n is a, c, t, g, unknown, or other
nnttacacacnnncaaacctggagctccaccacggtggcggccgctctagactagtggatcccccgggctgcaggaattcntctcacccctagaaaaagcgacccccaggtcagtcgggactacccgctgagtttaagcatataaataagcggaggagaagaaacttacgaggattcccctaggagcggggagcgaaccgggagcancccancttgagaatcgggcggcctccccgcccaaattgattctggaaaggcttcctcancgacggaccgggcccaatttctctgaaaaggaatttttcccaggaggagaggagaaaaccancccggactttttttttttaaaaaaacgccgaccaatgaaacnnnnntttttttttttccnnccaaacccggggggaaaagaaagggggnnnnnnnnnnntnnnnnnnnnnnnnnnnnncnnnnnnaaaaaaaaaaaaaaaaaacaaantncccccccccgcgggggggggggcgggccccttccccccccttaaactccccctcctccccgccccacacatcatctccttcatcaaccgcccctctccaacaagcccctcgacctccttccccccccatcgcaccccccataacgcccccctcagtatccctccctccccatccccctctccccccacccatgtccctcctgtcccccccctggctcttcacttcatccccctcccccacattcaacgtaccccccctcctcgcccc

SEQ ID NO: 64789 - DNA, 816 bp, Zea mays
  misc_feature: Ceres CLONE 1534905
  misc_feature: Encodes the peptide sequence at SEQ ID NO. 64790
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
tttatttttatttatctttttttgtagagcgagcccacataactcgccgggnnnnnnnnnnaactggagctccccgcggtggcggccgctctagactagtggatcccccgggctgcaggaattcgtctcacccctagaaaaagctgacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacgggaacattgagatttggaaaattaagaaactgattaacgcattgaaatcagccagaggcaatggcacaagaatgatctctctgatcatgccctccccgtgatcagggttggctcaagtgggttaaaatgttagggggacacaaaattgggaagtgggttccaaaaattcagaaagaaaaagtttaactggtacactcccgtggttggggtgggtcacaacaccccccggcttcccacagaaggggttgggaaagctcctttcaaaaaaaaaatgggccccccccaaaaaggggaattggggtctccgtcacccctgggggaacattttttggttttcccggtaataaccgggtataaaaaaaaaaaaaaaaaaaacacgggggaccctcctggagaggggaaacgagattcccccccccccttctcgttgggagccgtcaaatatttaccccgcgccctaccccgggggcggcccctcgttttccaaaaagcagcccggggggggcgggggaaaacaccc

SEQ ID NO: 64790 - protein, 41 aa, Zea mays
  misc_feature: Ceres CLONE 1534905
MSDSHETDGNIEIWKIKKLINALKSARGNGTRMISLIMPSP

SEQ ID NO: 64791 - DNA, 652 bp, Zea mays
  misc_feature: Ceres CLONE 1534922
  misc_feature: Encodes the peptide sequence at SEQ ID NO. 64792
aagctggagctccccgcggtggcggccgctctagaactagtggatcccccgggctgcaggaattcgtctcacccctagaaaaaaaggcataatttagctactacccctacccccgcgcattggttccgttccatcccaagctaacacaggcatcgtatatatggcgggcgacgacggggcggacgcgtcggagcggctggagagcatcctgacggcggaggcggcggcgtcgccgtgggccgcggccgccatcgagctgcggctgctgacgcggctggcggcgcccgcggtggtgatgtacatgatcaactacctcatgtccatgtccacgcagatcttctcgggccacctcggcaacctggagctcgccgccgcgtcgctcggcaacgccggcgtccagatgtttgcctacggcctaatgctgggcatgggcagcgcggtggagacactgtgcgggcaggcctacggcgcccacaagtacgagatgctgggcatctatctgcagcgctcggccgtgctgctgtgcgtcacgggcgttccgctggccgtcatctacgccttctcggagccgatcctggtgctgctggggcagtcgccggagatcgcccgcgccgcgtccgtcttcgtgtacggcctcatcccgcagatcttc

SEQ ID NO: 64792 - protein, 164 aa, Zea mays
  misc_feature: Ceres CLONE 1534922
  misc_feature (42)..(164): Pfam Name: MatE Pfam Description: MatE
MAGDDGADASERLESILTAEAAASPWAAAAIELRLLTRLAAPAVVMYMINYLMSMSTQIFSGHLGNLELAAASLGNAGVQMFAYGLMLGMGSAVETLCGQAYGAHKYEMLGIYLQRSAVLLCVTGVPLAVIYAFSEPILVLLGQSPEIARAASVFVYGLIPQIF

SEQ ID NO: 64793 - DNA, 652 bp, Zea mays
  misc_feature: Ceres CLONE 1534931
  misc_feature: Encodes the peptide sequence at SEQ ID NO. 64794
caaagctggagctccccgcggtggcggccgctctagaactagtggatcccccgggctgcaggaattcgtctcacccctagaaaaagctgacattctctatccatttcgttctggacgctgcttgcttccacagctccaccgtcatccattgcatcgcgtaatcctgcaggtgcagctaccggcatcctatcgcggcttcgcttcgagacggaaggctgtcccgcgaggtgtggagccgagagcggttcgccgtccgagaagggttcacatcacctcttcctctgcccccctccggtctgtcttcggggtctcccattggtggctgcagttgttttgatgggaactcagtaaccgctcgagaggagaggaaaggagcggatgctcaactgtagcaggaagatgggtagatccgcgagtgttcttcaagtccttctggtttccgcaaccatcgttgttgctcagacgcaatgggctagtggtgtatggggcatgtactgcgaggacttgacagcgagtgtagaaaggccgcacagggcctcggtaaccgatttcggcgccgtcggagatggtgcgactcttaacacgaaggcgtttcagaatgcgctcttccacctcgactcattcgcgaagaatggcggggcgcagctgttcg

SEQ ID NO: 64794 - protein, 91 aa, Zea mays
  misc_feature: Ceres CLONE 1534931
MLNCSRKMGRSASVLQVLLVSATIVVAQTQWASGVWGMYCEDLTASVERPHRASVTDFGAVGDGATLNTKAFQNALFHLDSFAKNGGAQLF

SEQ ID NO: 64795 - DNA, 662 bp, Zea mays
  misc_feature: Ceres CLONE 1534932
  misc_feature: Encodes the peptide sequence at SEQ ID NO. 64796
aaagctggagctccccgcggtggcggccgctctagaactagtggatcccccgggctgcaggaattcgtctcacccctagaaaaaaccgggagcgtgcgtgaccgtcacgaggaaggagatcgggagcgcagccgcaagccggctagcggaagggaacggctcgtcgccggcggggccacgtacccaggccggggtcaccgtccgggaggctggggtgggcgaatcgattctgcgtgcgcggctgggtcgaggtcgagatagcctttggacggggtgaggaaagcgagagataaaagcgagacattgaaggcgcacaacccaaagaatgggtaagagaggaaagtggtttagtgcggtgaataaagtcttcagctcctccgatccagatggaaaggaagccaaggcccagaaggctgactaatcgaaatccaagaggagatggccatttggaaagtccatgcactcggagccttccatatcgacggtgccaggcactgctcaagcagtagctccgttgccttcaccaccagcaactcatccccactctctggagatcaaaaatgtcaatccagttgaaacagacagtgaacagaacaagcatgcctactccgttgcgcttgcgtctgctgtcgctgctgaaactgcatcagttgcttgccatg

SEQ ID NO: 64796 - protein, 68 aa, Zea mays
  misc_feature: Ceres CLONE 1534932
MHSEPSISTVPGTAQAVAPLPSPPATHPHSLEIKNVNPVETDSEQNKHAYSVALASAVAAETASVACH

SEQ ID NO: 64797 - DNA, 669 bp, Zea mays
  misc_feature: Ceres CLONE 1534939
tgtggatcccccgggctgcaggaattcgtctcacccctagaaaatgtatcccttcgtttcatgttctgggtgcgtgacttgtcgactttgctgcttctggggttctgaccttggtaaggagagaataaagagataatatgagtgcgagatgcttgctgaactggtgctcagtaaattgatcccttgattgaatggttctgttctgttatcttttgccgcacttctcctgaaaagttcctcctatgccatcagatcttatactcattcgaaaaaaaaaaaaaaaaacgagacgctcgaggtacccaattccccctatagtgagttcgatttccccccccctcctggccggtcgttttacaacgtccgtgactgggaaaaaccccgcccgttacccaacttaaatcgcctttgcagaacattccccctttttccccagctggcgtaaataaccaaaagaggccccgcacccgattcccccctttccccaaacttttgccccaccctttaaatgggcaaaatgggaaattgtataaccctttaaaaattttggttaaaaaattcccccgttaaaattttttggttataaaccccccctccctttttttttaaacccaaaaggcccaaaaattcggacaaaaatccctttaataaattataaaaaaaatagct

SEQ ID NO: 64798 - DNA, 635 bp, Zea mays
  misc_feature: Ceres CLONE 1534941
  misc_feature: Encodes the peptide sequence at SEQ ID NO. 64799
  misc_feature (635)..(635): n is a, c, t, g, unknown, or other
agtggatcccccgggctgcaggaattcgtctcacccctagaaaaatactcctacatttttgcaatctgctggtatgaatgtaaaccaagtccttacaaggtgtcttttcgctggactgtgtttccatgcataccaacaggtgtcttacatgattttggcgatggtgtctcctgtcactcattctgtgggaaactgtgttaaacatgttggggtcattgtaacatcagtgcagttcttcaggacacctgtttcttcctatcaactctctcggtactgcgattgcccttgccggagttttcctgtactcacagctcaagcgactttatccccaagccgaagacagcttaaatagggattgtattttccatcactctgtgtcaatggacctaaacacttctatgttttactaaaatatgtacaaatttaattttaaatataataaaaaaccaagcccctcggggaacccaatttccccctatagtggagtcgaaatacccccccccccctggcccgtcctttttaataacccccctgactgggaaaacacccctgtcttttaccccccacttaattcggaaatagcagacaatttccccctcttctccccaactttggctttaaaataacacaaaaan

SEQ ID NO: 64799 - protein, 92 aa, Zea mays
  misc_feature: Ceres CLONE 1534941
MNVNQVLTRCLFAGLCFHAYQQVSYMILAMVSPVTHSVGNCVKHVGVIVTSVQFFRTPVSSYQLSRYCDCPCRSFPVLTAQATLSPSRRQLK

SEQ ID NO: 64800 - DNA, 626 bp, Zea mays
  misc_feature: Ceres CLONE 1534947
  misc_feature: Encodes the peptide sequence at SEQ ID NO. 64801
  misc_feature (626)..(626): n is a, c, t, g, unknown, or other
aaagctggagctccccgcggtggcggccgctctagaactagtggatcccccgggctgcaggaattcgtctcacccctagaaaaaagtcattgccgcgagaggggagaaaggctagctatcaggagagatccatcgctcaggaacaggaagaagtgaggcgacagctctgcaggatggcatcggagaaggtggagacgatcgtggcagggaactacatggagatggagcacgagcccggcggcggcggagaccatgaccagcaacccagcggcggcgcggcgtcgtccacttcatccagctccaggggcggcggcaagaagaaggccctgtcgagcctgttctggcacggcgggtcggtgtacgacgcgtggttcagctgcgcgtcgaaccaggtggcgcaggtgctgctgacgctgccctactccttctcgcagctgggcatggcatccggggtggtgttccagctcttctacggcctcatgggcagctggaccgcctacctcatcagcatcctctacgtcgagtaccgcaccaggaaggagcgcgagaaggtcgacttcaggaaccatgtcatccagtggtttgaggttctggatgggctactggggaagcactggaggaacgtn

SEQ ID NO: 64801 - protein, 151 aa, Zea mays
  misc_feature: Ceres CLONE 1534947
MASEKVETIVAGNYMEMEHEPGGGGDHDQQPSGGAASSTSSSSRGGGKKKALSSLFWHGGSVYDAWFSCASNQVAQVLLTLPYSFSQLGMASGVVFQLFYGLMGSWTAYLISILYVEYRTRKEREKVDFRNHVIQWFEVLDGLLGKHWRNV

SEQ ID NO: 64802 - DNA, 566 bp, Zea mays
  misc_feature: Ceres CLONE 1534949
  misc_feature: Encodes the peptide sequence at SEQ ID NO. 64803
ataactggagctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaagaagatcttcctccgcgagcttatctccaactcttccgatgcgctggactagatcagggtcgagagtctcactgactagagcaagctcgatgcgcagcctgagcttttcatccaccttgtccccagacaaggcacgacacgctctcatcatcgacgcggcatcggcatgacaaggtcgaccttggcaaaaacctcggaccctccccagtcccggaaaaaagaatttctgaaaccccttggctcccggccctaatgtccccatatttggccattctcggggcggtttttattttggcaaacctctccccaaaaaaaattttcccgcccc

SEQ ID NO: 64803 - protein, 45 aa, Zea mays
  misc_feature: Ceres CLONE 1534949
MASETETFAFQAEINQLLSLIINTFYSNKKIFLRELISNSSDALD

SEQ ID NO: 64804 - DNA, 848 bp, Zea mays
  misc_feature: Ceres CLONE 1534952
  misc_feature: Encodes the peptide sequence at SEQ ID NO. 64805
cccccccgattggcgtcgtaggcagcgcatatccatccccctcccccccccccaacctggagctcaccgcggtggcggccgctctagaactagtggatcccccgcgctgcaggaattcctctcacccctagaaaaagaattcatgtttggcatatgccagctctgaccgaaatctttggagatgattccgtcttacaatttggtggaggaactttaggacatccttggggaaatgcacctggtgcagcagctaatcgtgtggctttaaaagcctgtgtacaagctcgtaacgaagggcgcgatcttgctcctgcaggtaatgcaattatcaaagcagcttgtaaatggagtgctgaactaacccccagcttgtgaaatatgggaaggagatccaaatttgcagggtcttcaaaagcgatgggatccgcctcccacacccataaatacggctgtggctctcgggaccgcctccgaggtccccctaatttccccccaaataggcgaatccccataactaccgcggccgcctcaaatgggacccgttcgtcataacacaacacccctggtagcgtctgggaaaaaaacccccctgggcgctttttccccccaccttaaatccccgcccttcgaaacaccacaattaactgcactatattcgttcaactgttgggtgggttagcaaggtcgaaaaaacaggccgccgatacccttcattctttccccacttccacctctatatctttcagcccagcaactcagcctttatggggcccacaatggcaaaaatattgtaatttgcccctctaaccatcctcccctcctcaacgaaaacatacacccgattatag

SEQ ID NO: 64805 - protein, 73 aa, Zea mays
  misc_feature: Ceres CLONE 1534952
  misc_feature: SWISSPROT Homolog: EC 4.1.1.39 Ribulose-bisphosphate carboxylase
MPALTEIFGDDSVLQFGGGTLGHPWGNAPGAAANRVALKACVQARNEGRDLAPAGNAIIKAACKWSAELTPSL

SEQ ID NO: 64806 - DNA, 620 bp, Zea mays
  misc_feature: Ceres CLONE 1534953
  misc_feature: Encodes the peptide sequence at SEQ ID NO. 64807
ggagctccccgcggtggcggccgctctagaactagtggatcccccgggctgcaggaattcgtctcacccctagaaaaaacacagtattgctcatggctactgcttgtgttccgacggtggatgcggaggaagcatgcgccctcctcagctcttccacacaccactatctggatgtcaggatgtgggaggattttgacaagggccatgtcgccggtgctcggaatgttccctactacctctccgtcactccgcatgggaaggagaagaatccccagtttgtggatcaggtttccgcgctctacgccaaggaccaaaacttgattgtgggttgccgctctggcatccggtccaaactcgccactgcagacctcatcaacgcgggcttcaccaacgtgaggaacctacaaggcggatacctttccttgctccgaagcgcaaactagctagcttcctgcttatttgttcgcatgcttgtaataagtgagtcaacatatgctttgaagatcggttcatgaaaaaacagcatcacctccatcatgaaaaaggattaatgaccctgcaaaaaaaaaaaaaaaacgagacgctcgaggtacccaattcccccctaaaaggagtcgtat

SEQ ID NO: 64807 - protein, 116 aa, Zea mays
  misc_feature: Ceres CLONE 1534953
  misc_feature (10)..(114): Pfam Name: Rhodanese Pfam Description: Rhodanese-like domain
  misc_feature: SWISSPROT Homolog: EC 2.8.1.1 Thiosulfate sulfurtransferase
MATACVPTVDAEEACALLSSSTHHYLDVRMWEDFDKGHVAGARNVPYYLSVTPHGKEKNPQFVDQVSALYAKDQNLIVGCRSGIRSKLATADLINAGFTNVRNLQGGYLSLLRSAN

SEQ ID NO: 64808 - DNA, 748 bp, Zea mays
  misc_feature: Ceres CLONE 1534961
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
cccttttaattatcctgggtctcttttttggnnnnnnnnnnnnggttctnnnnnaaacatgaaactccccgcggtggcggccgctctagactagtggatcccccgggctgcaggaattcgtctcacccctagaaaagcgacgaacacacggtgacggagagccgagtggacaggacaggagcgcggagggaggaggaaacaaagcagaaaaagcaacccccgtcttccatcttcgcggaacgacgcccatctggcctgcccatctctttcgtgctcctaccccccgccttcttccgccctcaaggcttttccttccttctcatcttctgctcggaccggggacgggccgacggggacagggacaaaaggtggtgcgattttgttcgggacaaaaaaaaaaaaaaaacgagatttttttggccccccactgggggggatgaggggggggtataacctccgcctctctgggaggccccttctccaccgtcctggactggggaaaaacctagtagggtcacaggcttaggtacgccgtggcgcacctcccccttttctccacattgggcggagctttggtaaaagggttccctgccagcgcccccctctcctggctggtttgcgcctctccggcgcgtgggcctacggggaatcggcacgtgcgccagcgaccgttccggagataacgtccgcgccacttcggttctcttctgccccccgccccgccacgcttttaaatacactgccagtt

SEQ ID NO: 64809 - DNA, 631 bp, Zea mays
  misc_feature: Ceres CLONE 1534964
  misc_feature: Encodes the peptide sequence at SEQ ID NO. 64810
ggagctccccgcggtggcggccgctctagaatagtggatcccccgggctgcaggaattcgtctcacccctagaaaaattgaatatttgcttttatacttgagcacaggcaaggataatgccatggagaacactcagatttaatgagtctgtttgcaacccttacaatgctgattttgacggagatgaaatgaatttgcatgtccctcagacagaggaagctcgcactgaagcgcttatgctcatgggggttcagaataatttatgtactcctaagaatggtgagatactggttgcttccacgcaagacttcttgacctcatctttcctagttacaagaaaagatactttctatgatagatcttcctttactcttttgtgctcataccttggtgatggaatggagaacattgatttgccaacacagccttgattaaacctgtgagcttttgacggtaaacaactattagtgtgttagtccgacctaatgcgccacaaaggtgtttctgaatcttttgctgtcagaaaaaatttattcaaagaaaaaaaaaaaaaaaacgagacgctcgaggtccccattcgccttatagtgagtcgtattacgcgcgctcactggccgtcgttttacaacgg

SEQ ID NO: 64810 - protein, 104 aa, Zea mays
  misc_feature: Ceres CLONE 1534964
  misc_feature (1)..(45): Pfam Name: RNA_pol_Rpb1_2 Pfam Description: RNA polymerase Rpb1, domain 2
  misc_feature: SWISSPROT Homolog: EC 2.7.7.6 DNA-directed RNA polymerase
MPWRTLRFNESVCNPYNADFDGDEMNLHVPQTEEARTEALMLMGVQNNLCTPKNGEILVASTQDFLTSSFLVTRKDTFYDRSSFTLLCSYLGDGMENIDLPTQP

SEQ ID NO: 64811 - DNA, 694 bp, Zea mays
  misc_feature: Ceres CLONE 1534968
aagctggagctcaccgcggtggcggccgctctagaactagtggatcccccgggctgcaggaattcgtctcacccctagaaaaaactcactcgggagtcgggtcctcctcgactcagctcctccacaaacaaagccaccaccatggccaccactacgatgactaagcaccagtgccttctgctgggcgttgccctggttcaccgctactgctactatatccattcgcttgcataaataaagacggctgtgtaccttctggacactggaccaccgttgcgaaaaaaaagaaaaaaaaaaaaaaaacgagacgctcgaggtacccaattcgccctatagtgagtcgtattacgccccgctcactgggcggtcccccccccccgtgggggggggggaaaacccctggccgttaccccaactttaatcccccttgcagccacattcccccttttccccccgcttggccttaaataaccaaaaaggccccccccccggatcccccctttccccaccatttggcccccccctggaattggcaaatgggaaattggaaagccgttaatttttgtggttaaaaatcccgcgctaaaacttttttggtcaaaatccccccccattttttatttaaccgagagcgccccgaaattgccgcaaaaatccccttacaaaacccacaacaaactaagcctcctccctc

SEQ ID NO: 64812 - DNA, 808 bp, Zea mays
  misc_feature: Ceres CLONE 1534974
  misc_feature (1)..(1): n is a, c, t, g, unknown, or other
  misc_feature (44)..(44): n is a, c, t, g, unknown, or other
  misc_feature (45)..(45): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
nttttttttttaggccacgccccgcggagtggcgcaccttcccnngggggttaccnnnacaaaagtggagctccccgcggtggcggccgctctagaatagtggatcccccgggctgcaggaattcgtctcacccctagaaaaactagaaaacttgtgctgtgtatgtctatgctgttgtagttgccttgccttcacaggaagctgaggagtaacacagtgcgaaaaggataattattattattatttaccaattgtgtttacagtactcttccttgaaagtcttctcagtctcttccaaacaagttggtttcttcatttataatctcaagtatttatgaatgcaaaaaaaattaaggtgtttttcaaaaaaaaaaaaaaataaacgagacgctcgagggacccaaattcgcccctaataggtgagtcgtatttaccccgccgcccccttgggccggtcgtttttaccacgttcctggacctggtaaaaacccttggggcgttaccccaatctttaatccgcccttggcagaaaaatccccccttttcccgccggctggggcgttaataacgcgaaaaagggctccccgcccggattcgctccctttcccaaacaattttgccccaaccccttgaattgggcgcaaagggggaaattttgtaaaaggcgtttaaatatttttttggtaaaaaattttcccccggtaaaagtttttttggtttaaaacccccccccctcctttttttttttataaaccaacaaagaggcccctaaaaattgcggcgcaaataactccccccttttagaag

SEQ ID NO: 64813 - DNA, 719 bp, Zea mays
  misc_feature: Ceres CLONE 1534980
  misc_feature: Encodes the peptide sequence at SEQ ID NO. 64814
  misc_feature (15)..(15): n is a, c, t, g, unknown, or other
  misc_feature (19)..(19): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
ttttttttttttttntttntttacttctttngtnntnannnnngnnggagtattttaaaactggagctccccgcggtggcggccgctctagaactagtggatcccccgggctgcaggaattcgtctcacccctagaaaaagcatcccttctcccgatcacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaagggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccgccgaggccgtgatgcgcacccacgaccacatcttcgcgtccccggccgaggtccatggcctcccacatcctccgctacaaacacctggcaacgtggcccttctcgcccgctcggagaaaaaccggcacgcagaacccaggaaagcttgatggaacacccccacctggctcaagccaaactaaaaaggggtctacctccattccccggccaagggtgccgcccaa

SEQ ID NO: 64814 - protein, 160 aa, Zea mays
  misc_feature: Ceres CLONE 1534980
  misc_feature: SWISSPROT Homolog: EC 1.14.13.68 4-hydroxyphenylacetaldehyde oxime monooxygenase
MALQAAYEYLQQAVGHGAWSSTQTLTLLLIAVPTVLLLLASLAKSTSSSGKGKPPLPPSPPGTLPIVGHLHHIGPQTHISLQELVAKYGHNGFLFLRAGAVPTLIVSSPSAAEAVMRTHDHIFASPAEVHGLPHPPLQTPGNVALLARSEKNRHAEPRKA

SEQ ID NO: 64815 - DNA, 667 bp, Zea mays
  misc_feature: Ceres CLONE 1534992
  misc_feature: Encodes the peptide sequence at SEQ ID NO. 64816
aaagctggagctccccgcggtggcggccgctctagaactagtggatcccccgggctgcaggaattcgtctcacccctagaaaaaaccgcctgcagacaacaaagaaaagcggcagcgccagccagtgagaagaaaagctccagctccagcccccctgctcccccaatgcctcacccgtaagccgcgtcgcagctccaccgcgcgtcgcaatggccggccccggcgcatccgtagcggcgctggcggtcctgctcgccgccgccgccgccgccgccttcacacgctgcgccgtcgcggagccgccgccgagcgagcggtcggcgctgctggcgttcctgaccgcgaccccgcacgagcgccgcctcgggtggaacgcctccaccccggcgtgcggctgggtcggggtcacgtgcgacaacgccaacgccaccgtcgtcgaggtgcggctcccgggcgtcggcctcgtcggcgccatcccgccgggcacgctcggccggctcaccaacctccgcgcgctctcgctccgttccaaccgcgtcctcgggaccatccccgacgacgtgctccagctgccgggcctcaaggcgctgttcctgcagcacaacctgctgtccggccccatcccgccgggaatccagaggctcggcggcctcgagcgcctggtcct

SEQ ID NO: 64816 - protein, 152 aa, Zea mays
  misc_feature: Ceres CLONE 1534992
  misc_feature (32)..(69): Pfam Name: LRRNT_2 Pfam Description: Leucine rich repeat N-terminal domain
  misc_feature: SWISSPROT Homolog: EC 2.7.11.1 Non-specific serine/threonine protein kinase
MAGPGASVAALAVLLAAAAAAAFTRCAVAEPPPSERSALLAFLTATPHERRLGWNASTPACGWVGVTCDNANATVVEVRLPGVGLVGAIPPGTLGRLTNLRALSLRSNRVLGTIPDDVLQLPGLKALFLQHNLLSGPIPPGIQRLGGLERLV

SEQ ID NO: 64817 - DNA, 659 bp, Zea mays
  misc_feature: Ceres CLONE 1534994
  misc_feature: Translation starting site: 187
  misc_feature: SWISSPROT Homolog: EC 2.7.11.1 Non-specific serine/threonine protein kinase
aaagctggagctccccgcggtggcggccgctctagaactagtggatcccccgggctgcaggaattcgtctcacccctagaaaaagtcttgtttccattctcccctcctctcctcccccgacagctgcccccgcatggtgtgatcaggccatctggtgcgggaagaaaaggcgcgacacagcgagccatgctcccgccgcgcgccgccgccgtgccgctgctgctgctggccctggcggccggcgcggcccgtggcgccgacgacctggcatcggacgccgcggcgctgcaggccttcctcgcgccgttcggatccgcgaccgtgtcgtggaactcgtcccagccgacatgctcctggacgggtgtcgtctgcaccggcggccgcgtcacggagatccccgcccccggggaaggccctccggggcgcgctccccgtcggcgcgctaggcgggctcaacaagctcgccgtgctgtcgctgcggtacaacgcgctctccggcccgctgcctcgggacctcgccacctgcgtcgaagctccgggtgatcaacttgcagtccaacctcctctcggggggctccctggccggaggtgctgggcgctaccggcgttgacgcagctcaacctcgcgcagaaccgctttgtcggggaaggatatcgcc

SEQ ID NO: 64818 - DNA, 675 bp, Zea mays
  misc_feature: Ceres CLONE 1534996
  misc_feature: Encodes the peptide sequence at SEQ ID NO. 64819
  misc_feature (327)..(327): n is a, c, t, g, unknown, or other
atagctggagctccccgcggtggcggccgctctagaactagtggatcccccgggctgcaggaattcgtctcacccctagaaaaagtccctcctgctcccagatctcttccactcggccactccctagcacatcaaaccctagctccgcccagcccccaaccatgtcggcgatgatgcaaccgcagatcatcctgctcaaggagggcacggacacgtcgcaggggcgcgctcaggtggtgagcaatatcaacgcgtgcacggcggtgggcgacaccgtgcggaccacgctggggcctcgggggatggacaagctcatccacgacgacnagggcggagtcaccatcttcaacgaagggggcacccatcatgcccctcgggggggggggggacccccgccccaaattcctttgtcaaattcccccatcccaaagaacccaaaggtcggggaatggggaaaccaccgggggggcttccacccgcaaaaatcctttaaaggaaacaaaacccttttttgggggaagggggtggccccccccccggtcttttttcccaggttaaaaaacgggggggcataatgggcccccccaagggggttaaaagagcggggcttttacaaaaagaagaaaaaaaccccttgaaaaaaaaaaaaaccccggggtaacaaagggggcccgc

SEQ ID NO: 64819 - protein, 137 aa, Zea mays
  misc_feature: Ceres CLONE 1534996
  misc_feature (56)..(56): Xaa is any aa, unknown, or other
MSAMMQPQIILLKEGTDTSQGRAQVVSNINACTAVGDTVRTTLGPRGMDKLIHDDXGGVTIFNEGGTHHAPRGGGGPPPQIPLSNSPIPKNPKVGEWGNHRGGFHPQKSFKGNKTLFWGKGVAPPPVFFPRLKNGGA

SEQ ID NO: 64820 - DNA, 638 bp, Zea mays
  misc_feature: Ceres CLONE 1535004
  misc_feature: Encodes the peptide sequence at SEQ ID NO. 64821
aaagctggagctccccgcggtggcggccgctctagaactagtggatcccccgggctgcaggaattcgtctcacccctagaaaaactgccgtctcttcctcctccctctgcacccccacgagctccatggccgccaccgccatgattgggattaccaacctacgttgccgccacgacccgctctcctcccttccccgggctacgtcgtcaggcggccggtcctgtaggctgcttcctcctcgatgccgccgccattcttcttgctgctccccttcctcctccgtctctccgtgccgggcccgggtccgaccaacaacaacactgaagcgcatccctgccgccgataccggattcatgggtccagccaacaatgatgccaccacgcttaagcgatcatcgtcagccgaccttcgccgccgccttatcgtacccagctgcaccgctggcaccagaaacgcctccagtgcttccacaggagtgctgcccgtcattatcagggtggcgcatctgctcatgtcgctggacattcggctccccatggacaagttcctcaaacaggaattcgtcgccgcgccgatcacgttcacaagtgcccttttcggcatgttctgcgacttctcagtgctcggagtcttggac

SEQ ID NO: 64821 - protein, 34 aa, Zea mays
  misc_feature: Ceres CLONE 1535004
MDKFLKQEFVAAPITFTSALFGMFCDFSVLGVLD

SEQ ID NO: 64822 - DNA, 591 bp, Zea mays
  misc_feature: Ceres CLONE 1535009
  misc_feature: Encodes the peptide sequence at SEQ ID NO. 64823
  misc_feature (297)..(297): n is a, c, t, g, unknown, or other
  misc_feature (453)..(453): n is a, c, t, g, unknown, or other
aagctgggagctccaccgcggtggcggccgctctagaactagtggatcccccgggctgcaggaattcgtctcacccctagaaaaaagagggcgcggtgagcgggatctccactatcgatagcatgcgtggcgggtactctggccgcgattgcttcgctggcggccggcatagcagcagccgcagcaacgatggcaggggataccacggggaacccttgcttgacgatgcaccaaccgtgggcgtccctgctggtgcacggcatcaagcgtgtcgagggccgctcatggccatccccnatcacaggccgcctatggattcacgcagcatcccagggttcctgaccccgacactatcaaggccatggaagaattctacagggaaaatttatgccgtccatggcatcactgggatcaagatccctgatcattaacctgtctcaaggcttctttggntgtgtttaaagggggaaagcgtcccccaggtcctaaaaaaacttggtttcggggaaatggggcccgaaaccctttagttccccttaacccccaattttcctttccttttggaaaagaaaacaattttttattttaccc

SEQ ID NO: 64823 - protein, 102 aa, Zea mays
  misc_feature: Ceres CLONE 1535009
  misc_feature (59)..(59): Xaa is any aa, unknown, or other
MRGGYSGRDCFAGGRHSSSRSNDGRGYHGEPLLDDAPTVGVPAGARHQACRGPLMAIPXHRPPMDSRSIPGFLTPTLSRPWKNSTGKIYAVHGITGIKIPDH

SEQ ID NO: 64824 - DNA, 623 bp, Zea mays
  misc_feature: Ceres CLONE 1535010
  misc_feature: Encodes the peptide sequence at SEQ ID NO. 64825
  misc_feature (426)..(426): n is a, c, t, g, unknown, or other
  misc_feature (556)..(556): n is a, c, t, g, unknown, or other
ggcggccgctctacaatagtggatcccccgggctgcaggaattcgtctcacccctagaaaaacgaccaactaactgttcacaaagcaatcgccaagaacatcgatgtccattcgaccattcctgacaacccatatcccaatcaatctaccacctctccggccgttccacactgatcggatggcggccttgaccttccacccggccgcctgcttcttcccacgaccacgagaggcagcagcgacaacgaagcagccgctccaccattactgctcgcctctccagaccctcgtccctagaactacaagaccgtgccttctcagggccaggtcctccaacgggctcccgcagaccggcggcgcctcgttcggcagcagcaacgaggtgctggatgggacgccgacgggagatggggcaccggggcaggngcagcggggagggagcaccgtcagcatcacggtcgtcggcgcctccggcgacctcgccaagaagaagatcttcccggctctcttcgccttgttctacgagggctggctcccggagcattttacagtgttncgctatgcccgtagcgagatgaacgaccaagagctcaggaacatgattagcatgaccctgacgtgcc

SEQ ID NO: 64825 - protein, 148 aa, Zea mays
  misc_feature: Ceres CLONE 1535010
  misc_feature: SWISSPROT Homolog: EC 1.1.1.49 Glucose-6-phosphate 1-dehydrogenase
  misc_feature (83)..(83): Xaa is any aa, unknown, or other
  misc_feature (126)..(126): Xaa is any aa, unknown, or other
MAALTFHPAACFFPRPREAAATTKQPLHHYCSPLQTLVPRTTRPCLLRARSSNGLPQTGGASFGSSNEVLDGTPTGDGAPGQXQRGGSTVSITVVGASGDLAKKKIFPALFALFYEGWLPEHFTVXRYARSEMNDQELRNMISMTLTC

SEQ ID NO: 64826 - DNA, 635 bp, Zea mays
  misc_feature: Ceres CLONE 1535013
  misc_feature: Encodes the peptide sequence at SEQ ID NO. 64827
  misc_feature (400)..(400): n is a, c, t, g, unknown, or other
gcgcgtcggaggtccccgcggtggcgggcgctctagacgaagtggaacccccggggtgcaggagattgtttatctttagagaaatatattgatagggatactcttttaacgtaggtgttttctgcaagtttgcgagctcacgattctgctccatggtcagcgatacggagaccttcccatttctcgctgagattgagcagctgctctctctactgatcaacaccttctactccaacaaggagatcttcctccgggaacttatctcccactcttccgatgcgttggactacatcaggttcgagagtctcactgaccagaccaagctctgatgcgatgcctgagcttttcatccaccttgtttccaccaagcggagaggggggggtgctgcatcaaaagtgnttgggattgacaagggcaaccttgccacaacccccggaatttgtcgggggcgggaaccaggattttatggaagccctgccgccgggcccaatttcccctggattgccccttcgggggcggtttttattgggccaccctcgcccccaaaaagttttccggggcccccgccccccggttacaaggcgggggttggtgggatccccccggggcgggggcgtaaaaggggttcgtggaa

SEQ ID NO: 64827 - protein, 58 aa, Zea mays
  misc_feature: Ceres CLONE 1535013
MVSDTETFPFLAEIEQLLSLLINTFYSNKEIFLRELISHSSDALDYIRFESLTDQTKL

SEQ ID NO: 64828 - DNA, 646 bp, Zea mays
  misc_feature: Ceres CLONE 1535018
  misc_feature: Encodes the peptide sequence at SEQ ID NO. 64829
tcaccgcggtggcggccgatctagaactagtggatcccccgggctgcaggaattcgtctcacccctagaaaaattccgcaacacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatggctatgattgatgagcctctttatccaattgctgtactgattgacgagctcaagaatgaagacatccagttgcgtctaaactccattagaagactttcaacaattgcacgggctcttggagaagaaagaaccaggaaggagctgattccttttcttagtgaaaacaacgaccacgaagacgaggtgcttcttgcaatggctgaggaattgggtgtgttcattccgtatgttggtggtgtaaaacatgctcatgttttgctcccacctttggagacattgtggacagtggaggaaacttgtgtccgggacaaaccagttgaatctccggtgcctaattggtgcccaaatgaaggaaacctgactttggtcgactgggttcattccaataagtaaaagagggttagccacctggaaaa

SEQ ID NO: 64829 - protein, 131 aa, Zea mays
  misc_feature: Ceres CLONE 1535018
MAMIDEPLYPIAVLIDELKNEDIQLRLNSIRRLSTIARALGEERTRKELIPFLSENNDHEDEVLLAMAEELGVFIPYVGGVKHAHVLLPPLETLWTVEETCVRDKPVESPVPNWCPNEGNLTLVDWVHSNK

SEQ ID NO: 64830 - DNA, 662 bp, Zea mays
  misc_feature: Ceres CLONE 1535020
  misc_feature: Encodes the peptide sequence at SEQ ID NO. 64831
aaagctggagctccccgcggtggcggccgctctagaactagtggatcccccgggctgcaggaattcgtctcacccctagaaaaaaccggataccaccgcctccaccaaccgattccgttccatcccccctcccccctcgctcgagcgcgaggcttctctcccctcccttcccctcccctcccctcccccccggcgcggattcctacagccagctccctcgccgatcgcggtcccgtcccgagggagaggtgatgataaaggatatctgctgaccaaacttgcagtagttcttcttaaggaaatagaaattggcgtcatgacacatagaaatatgctctggacacatcagtctgttaatcctgaatgggagcaaagacatgtccaagttcaaccaggaagttcctattatgcaggcactgcaagtgatccatccaacctgggtgtgcaagttgctgtgggagttccaggaaatactgctaatgttggtatatgtgatttgcggaatcatgagtgcccgcatgttcataattcatacccacatgccggtgttacatcaagatttgtcttcccaactactatgtacagccctagcatgtcagcagcagctgtcaacatatatattcctcaaactcaaagctttggactgggcagtgtgctaccac

SEQ ID NO: 64831 - protein, 115 aa, Zea mays
  misc_feature: Ceres CLONE 1535020
MTHRNMLWTHQSVNPEWEQRHVQVQPGSSYYAGTASDPSNLGVQVAVGVPGNTANVGICDLRNHECPHVHNSYPHAGVTSRFVFPTTMYSPSMSAAAVNIYIPQTQSFGLGSVLP

SEQ ID NO: 64832 - DNA, 619 bp, Zea mays
  misc_feature: Ceres CLONE 1535024
  misc_feature: Encodes the peptide sequence at SEQ ID NO. 64833
  misc_feature (534)..(534): n is a, c, t, g, unknown, or other
  misc_feature (546)..(546): n is a, c, t, g, unknown, or other
aagctggagctccccgcggtggcggccgctctagaactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagcctctggtgctgcccgcgcaccacagcaatgtcgtcggctcgcgcctgtcgtcgccgtcgccctcggcggccgccgccagcaggaagaccggcggcggcgtgtcctcccggtccggctcccggcggcccgtgcggctgccgaggatcagctgcagcgccaccgaggaggtcagcggcgccgtgtcgtccgtcaccgtggagaggatgctgacggtgacggcgtcnggtggagcgtcnccgggcatcgggcagatgtacttccagcgcgccgtcgacgacgtcggcgaactattcggcaagacgctgctgc

SEQ ID NO: 64833 - protein, 111 aa, Zea mays
  misc_feature: Ceres CLONE 1535024
  misc_feature: SWISSPROT Homolog: EC 1.13.11.12 Lipoxygenase
MMNLNLKQPLVLPAHHSNVVGSRLSSPSPSAAAASRKTGGGVSSRSGSRRPVRLPRISCSATEEVSGAVSSVTVERMLTVTASGGASPGIGQMYFQRAVDDVGELFGKTLL

SEQ ID NO: 64834 - DNA, 672 bp, Zea mays
  misc_feature: Ceres CLONE 1535029
  misc_feature: Encodes the peptide sequence at SEQ ID NO. 64835
  misc_feature (328)..(328): n is a, c, t, g, unknown, or other
  misc_feature (331)..(331): n is a, c, t, g, unknown, or other
  misc_feature (334)..(334): n is a, c, t, g, unknown, or other
  misc_feature (415)..(415): n is a, c, t, g, unknown, or other
  misc_feature (420)..(420): n is a, c, t, g, unknown, or other
  misc_feature (471)..(471): n is a, c, t, g, unknown, or other
atagctggagctccccgcggtggcggccgctctagaactagtggatcccccgggctgcaggaattcgtctcacccctagaaaaatctccctctgctccgggcgcaccgtcaccgggtgaggctgtattgcgtcgacagcaacacctgctttcgctacgacgggagcaccagaggctaggcttgcttcatcagtgacagggagccaagatgccggccggagggttctcggtctcggcgccgtccggcgtcgagttcgaggctaagatcacgccgatcgtcatcatctcctgcatcatggctgccacaggcggtttgatgttcggctacnacntcngcatctcaggtggtgtgacgtcaatggacgacttcctgggcaagttcttcccggcggtgctgcggaagaaactggaggacnagganagtaactactgcaagtacgataaccagccgctgcagctgttcacgtcgtcnctgtacctcgcggggctgacggccaccttcttcggctcgtacacgacggggcgcctcgggcgggggcctcacatggtgggtccccggcgtctttctcatccgggggggggatcttcaaacgggggccccccagaaactcggccaggctaatcctgcgggaggatctttggtccgggtgcgggggtcgggttccccaaacag

SEQ ID NO: 64835 - protein, 137 aa, Zea mays
  misc_feature: Ceres CLONE 1535029
  misc_feature (41)..(41): Xaa is any aa, unknown, or other
  misc_feature (42)..(42): Xaa is any aa, unknown, or other
  misc_feature (43)..(43): Xaa is any aa, unknown, or other
  misc_feature (70)..(70): Xaa is any aa, unknown, or other
  misc_feature (71)..(71): Xaa is any aa, unknown, or other
MPAGGFSVSAPSGVEFEAKITPIVIISCIMAATGGLMFGYXXXISGGVTSMDDFLGKFFPAVLRKKLEDXXSNYCKYDNQPLQLFTSSLYLAGLTATFFGSYTTGRLGRGPHMVGPRRLSHPGGGSSNGGPPETRPG

SEQ ID NO: 64836 - DNA, 645 bp, Zea mays
  misc_feature: Ceres CLONE 1535030
  misc_feature: Encodes the peptide sequence at SEQ ID NO. 64837
ggagctccccgcggtggcggccgctctagaactagtggatcccccgggctgcaggaattcgtctcacccctagaaaaagcatagtggtctatgtcaaatcttctagcgctcgcaattcttctcctctccaccacgccggcgccgacggccggtgaacagaccatctgcagcgatgccacgtacgagcgaaacagcacatacatgtccagtctgaggtcggtagccggcgcactgaccggggacgccgcgaggctgcactcgtccaccggcgctgcaggggagggccccgacaaggtatacggcgccgtgctctgccgggcggacaccgcgggtgctgactgcgccaggcgcctccgggacgcctttgccgccatcaccgacggggacggccgctcgccttgcgcgctccacagggacgtggccgtctactccgagctgtaccagctccgtttctccgacagggacttcctcgctgacttcagcaacgcgccggaatgggttgacgtcacgaacccgggccccgtgccgctcgccatggccgcgcggttcgaccagcgggtcacggagctgctgagcgcactcgctgacgcggcggcggggcgaccgggcatgtgggccgtctgcgaacgccatggtcgtcgtcgg

SEQ ID NO: 64837 - protein, 148 aa, Zea mays
  misc_feature: Ceres CLONE 1535030
MSSLRSVAGALTGDAARLHSSTGAAGEGPDKVYGAVLCRADTAGADCARRLRDAFAAITDGDGRSPCALHRDVAVYSELYQLRFSDRDFLADFSNAPEWVDVTNPGPVPLAMAARFDQRVTELLSALADAAAGRPGMWAVCERHGRRR

SEQ ID NO: 64838 - DNA, 634 bp, Zea mays
  misc_feature: Ceres CLONE 1535031
  misc_feature: Encodes the peptide sequence at SEQ ID NO. 64839
  misc_feature (396)..(396): n is a, c, t, g, unknown, or other
  misc_feature (471)..(471): n is a, c, t, g, unknown, or other
  misc_feature (609)..(609): n is a, c, t, g, unknown, or other
aaaactggagctccccgcggtggcggccgctctagaactagtggatcccccgggctgcaggaattcgtctcacccctagaaaaagcacaaaatctcatttgagcgtgcaagctccttcgcctcgaaccctctcgcgcttggcttgctttcactctccagggccccactcccacctcgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggtgatgttacaatcactaatgatggagcaaccatacttaagatgttggaangtgagcatccagccgccaaggttcttgttgagttggctgagctcccagatcgtgaggtaggagatggaactactnccgttgtcatcatagcggcagagttactcaagagaggcaatgatcctggtaaagaaatagatccctcccaacctctaaaaatcaggggctaccaggcttggctatgccgggaaccccgcaaaaatgttaaagaaaaanttaccaatcaaggggttaacaaact

SEQ ID NO: 64839 - protein, 148 aa, Zea mays
  misc_feature: Ceres CLONE 1535031
  misc_feature (70)..(70): Xaa is any aa, unknown, or other
  misc_feature (95)..(95): Xaa is any aa, unknown, or other
  misc_feature (141)..(141): Xaa is any aa, unknown, or other
MAITAPTPDILGERQSGQDVRTQNVMACGAVANIVKSSLGPVGLDKMLVDDIGDVTITNDGATILKMLEXEHPAAKVLVELAELPDREVGDGTTXVVIIAAELLKRGNDPGKEIDPSQPLKIRGYQAWLCREPRKNVKEKXTNQGVNK

SEQ ID NO: 64840 - DNA, 674 bp, Zea mays
  misc_feature: Ceres CLONE 1535032
  misc_feature: Encodes the peptide sequence at SEQ ID NO. 64841
  misc_feature (611)..(611): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
ctagaactagtggatcccccgggctgcaggaattcgtctcacccctagaaaaagatgggaatcacctcctcaacctccagcccaacctccagcccggaatcgagagcaatggcgctcgccaaggccaaggagatagttgcctccgctcccctcgtcgtcttcagaaaaacttcctgtcctttctgcgtccgtgtgaagcagttgttcgagaagctcggagcaagctacaaggccatttgattggataaggaaagtgatggagctgagctccggaatgccctgaaggagtggactgggaagagggatgtcccaaatgtcttcctcttggggaagcaatttggggggtgcgatggatcctatggtgctgatacattgattggaaacccggggggctctgctgaactgaggctggaagccatccgccggttcctgcctccaaaaaaaacctttcactggtttgaacagggggtgtttaccatttccccgaggccttaaaaaataaggatcgctttacccaagcgcctacaacttggcaaaaagcccaatgtgggaaagtagacagatcccttcccccgaccgtaaaaacccccccttaaccccaccatccccanannnaagcttcctcccgaccggctttagaaacacccccccacaaacgccggtcgccccgcctc

SEQ ID NO: 64841 - protein, 61 aa, Zea mays
  misc_feature: Ceres CLONE 1535032
MGITSSTSSPTSSPESRAMALAKAKEIVASAPLVVFRKTSCPFCVRVKQLFEKLGASYKAI

SEQ ID NO: 64842 - DNA, 648 bp, Zea mays
  misc_feature: Ceres CLONE 1535049
  misc_feature: Encodes the peptide sequence at SEQ ID NO. 64843
  misc_feature (648)..(648): n is a, c, t, g, unknown, or other
ggagctccccgcggtggcggccgctctagaactagtggatcccccgggctgcaggaattcgtctcacccctagaaaaactcccaagttgcaacggccagaaagccacgttagcctagccgagctcctctgctcctctcgtggccgaacaggcagagcgaccagtctccagagcgctccccatggcgtcaggagctgcggcccctgtcgttcagaccctggtgctgaaggtggccatccactgccatggctgcaagaagaaggtccggaaggtgctcaggagcgtcgaaggcgtgcagaacgtgacggtggacgcctcgcagaacaaggtgactgtggtcggcaccgtggacgccgacacgctcatccagaggttgtacaagtccggcaagaagggggagccctggcagtgccacccgcccgtcaagaagagcgagcccgcgccggaggccccgccggctgcgcatccctgccggtggcggcggcaaagacgctgctactgctgcggccgcggtggacaagaagccggaggagccgatgaagaagccgcagggcgacagcttcgaggagaagaagaaaaagccggaggaggcggccaaggaaccgcagagcgagaagaagaacccggaggaggcggccaagggaccgcn

SEQ ID NO: 64843 - protein, 156 aa, Zea mays
  misc_feature: Ceres CLONE 1535049
  misc_feature (14)..(74): Pfam Name: HMA Pfam Description: Heavy-metal-associated domain
MASGAAAPVVQTLVLKVAIHCHGCKKKVRKVLRSVEGVQNVTVDASQNKVTVVGTVDADTLIQRLYKSGKKGEPWQCHPPVKKSEPAPEAPPAAHPCRWRRQRRCYCCGRGGQEAGGADEEAAGRQLRGEEEKAGGGGQGTAEREEEPGGGGQGTA

SEQ ID NO: 64844 - DNA, 647 bp, Zea mays
  misc_feature: Ceres CLONE 1535051
  misc_feature: Encodes the peptide sequence at SEQ ID NO. 64845
acccgcgatggcggccgctctagaactagtggatcccccgggctgcaggaattcgtctcacccctagaaaaaaaagccaaagcagttgttcctcgccgtctcggggtctcggcctctcctcggtctctcctcccagatcgggccatccaggtgctaccgctcttcgccccctccacttcaccgccgccgcgtagatccgtctccgcctcctggaagcgctaccagtggaccaacgccgagccggcggagttagcggcgttagggttgcggttgggaattgattgcgggggacgcagcggtggcgcctggcatggcgggggcgcccggggtcgggccgggtgcggggggtgggggcggcgccgctgctgggctcaagacttacttcaagacgcccgaggggaggtacaagctgcagtacgagaaggcgcactccgcggtgctgcactacagccacggcggcaagaccgtctcgcagttgacagtggcatacctcaaggagaagcctgctagccagggctctcagccatcaacaccaagcgccagcagtgggatgcggtctgcagcagcaaggctgctgggcactgggaatgggagcaagcacttagctttggtggcggtaatggtgcaagccgaagctgtgctggaag

SEQ ID NO: 64845 - protein, 112 aa, Zea mays
  misc_feature: Ceres CLONE 1535051
MAGAPGVGPGAGGGGGAAAGLKTYFKTPEGRYKLQYEKAHSAVLHYSHGGKTVSQLTVAYLKEKPASQGSQPSTPSASSGMRSAAARLLGTGNGSKHLALVAVMVQAEAVLE

SEQ ID NO: 64846 - DNA, 654 bp, Zea mays
  misc_feature: Ceres CLONE 1535052
  misc_feature: Encodes the peptide sequence at SEQ ID NO. 64847
  misc_feature (482)..(482): n is a, c, t, g, unknown, or other
aaagctggagctccccgcggtggcggccgctctagaactagtggatcccccgggctgcaggaattcgtctcacccctagaaaaagacttcaacacactaaacgttggcctgctgctctctcctctcggtcatggcatcgaaacgagccaacgccggcgacgagcagcagaagctgtcaccttctggcctcccggtccacaagatcccgggaagctacggcgtgcccttcttcacgccgttgcgcgaccgcctggactacttctacttccagggcgcggaggagtacttccgctttcgcgtcgccaaacacggcggcgccaccgtcctgcgcgtcaacatgccgccaggcccgttcctctccggtgactcccgcgtcgtcgccgttctcgacgcgcgcagcttccgcgtcctactcgacgactcccgtgtcgacaaggacggcacgctcgacggcacctacatgccctcgctcgcgctcttcngtgggcaccggccgctcgcgttcctcgacggggccgacccgcgccacgttgcgctcaagcgcgtcttgatccgctccgggcccccgggatgcaacactccccgccgggttttggcccccctttcaccgccaattttaaagccctcaacccgggagggggggcggaccccccc

SEQ ID NO: 64847 - protein, 174 aa, Zea mays
  misc_feature: Ceres CLONE 1535052
  misc_feature: SWISSPROT Homolog: EC 4.2.1.92 Hydroperoxide dehydratase
  misc_feature (118)..(118): Xaa is any aa, unknown, or other
MASKRANAGDEQQKLSPSGLPVHKIPGSYGVPFFTPLRDRLDYFYFQGAEEYFRFRVAKHGGATVLRVNMPPGPFLSGDSRVVAVLDARSFRVLLDDSRVDKDGTLDGTYMPSLALFXGHRPLAFLDGADPRHVALKRVLIRSGPPGCNTPRRVLAPLSPPILKPSTREGGRTP

SEQ ID NO: 64848 - DNA, 656 bp, Zea mays
  misc_feature: Ceres CLONE 1535059
aaagctggagctccccgcggtggcggccgctctagaactagtggatcccccgggctgcaggaattcgtctcacccctagaaaaagctaaccctcgctccgttttatcgcccccctctgcttccaaatcgaatcgcgtcctctccattctgccgtctcctctcctactcctcccccctgccgccgcaagatccaccagggctctcgaccgcaatggagccgcagctgacgcccggcgcggtggcggcggtctccgcccacgccgacggcaaacggcacgctgcagccggtgctgcaagttgtggaacgtgcgatggtcaacaacgccaagaaacccctccgcgagcgctttcccgatggtgctcctccgacggcgaacacaccatgcagtccatgctcccccacgccgaaaaaccgcggcgtcccgggacagctcccatccagaaaggcctccatcgtccaccctcccggaagtggaacttggagaacccatccagtttcgcaaggatcctttttgcgttttcaaaaccttgaaggttctgccaaaagggaggggggcccaaaatttgggaaacccccggccccctttgaaattggggaaaacccccccttagtggacagggggcccccaactataccgggccaaatggctgtcaaa

SEQ ID NO: 64849 - DNA, 662 bp, Zea mays
  misc_feature: Ceres CLONE 1535063
aaagctggagctccccgcggtggcggccgctctagaactagtggatcccccgggctgcaggaattcgtctcacccctagaaaaaagccccacctcggctcgcttctcccctccccttctgaaagactacaccccgggtcttggccgtccccaactcaccgcctggagcatgccaccccgatacctaaccgtcggcaccgaagtgaactcttccgtgcggtcggccgcgcgtaaggacatgcccctcgtcgccgcccgcctcctgtgatgtctcatacctgacacctcagctgcttttaccctcggtcgcacaatagcctcctacaagtatcccgagcagacgcttccggagccaaccatttggcctcaccacgacatctcaaatgagccacccctaaaagatctttctcgattcggtcctttaaggattacgagactagctcgttttacggtcaacctctcagaagtcgcttgactactcctacccacaatgtgaagagaccaacatccagattgtcaacctcaacttttcagtgatgactttagacaacgtatctgacttgacgtgtagttcttactgcaaattcagcatagaggcagaccactgatatctgagatgacattcacctgcagtagtgatcacaacgctgcgggatctagcct

SEQ ID NO: 64850 - DNA, 638 bp, Zea mays
  misc_feature: Ceres CLONE 1535072
  misc_feature: Translation starting site: 240
aagctggagctccccgcggtggcggccgctctagaactagtggatcccccgggctgcaggaattcgtctcacccctagaaaatcccgcgttcctccactccacggctcccccaccccactcatcacactctcccaccgcacctcgccgccgcggggcaccgcgccataaagtgcgttcccgtctgcacggacgtcgaggagcagctcgcaagtgtttccttggcgcgtcgatcggcaagatgatcactggcacggacttctaccacgtcatgacggccatggtgccgttgtacgttgccatgatcctggcgtacggatccgtcaggtggtggcgcatcttcacgcggaacagtgctcggggatcaaccgcttcgtggcgctcttcgccgtgccgctgctgtcctttcacttcatctccaccaacaacccctacaccatgaacatccggttcatcgcccgcgaaccgctgcaaaagctgatcgtcctggcgctgctcactgcctggagctacctctcccgccggggctgcctcgagtgaaccatcacgctcttctccctgtcgacgctgcccaacacggtggtgatgggcatccccctgctcaagggatgtacggggacttctccgggaccctcatgtg

SEQ ID NO: 64851 - DNA, 711 bp, Zea mays
  misc_feature: Ceres CLONE 1535075
  misc_feature: Encodes the peptide sequence at SEQ ID NO. 64852
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
aaagctggagctccccgcggtggcggccgctctattactagtggatcccccgggctgcaggaattcgtctcacccctagaaaaaacctagaaaaaagagttcatacttcgtagtactacccttttttcccctttcctcttcgacaatcgaatggcccgagaagctgtaattgcgctgttctgcagcgttttctcttgccaacacgtcatcctcgtcgcactgttcggagtgcagacgagcttgaagtctannnnnnngannnnnannnnnaaannnaaaaaaaaaaacgagacgctccaaggacccaattcgccctatagtgagtcgtattacccgcgctcactggccgtcgttttacaacgtcctgactgggaaaaccctggcgttacccaacttaatcgccttggcacacatccccctttcgccagctggcgtaattaccaaaaaggcccgcacggatccgccttccccaacattggcccacccggaatggccaaagggaaaattgtaagcgttaataattttgttaaaattcccggttaaattttttggtaaatcccgcccctttttttttaacccataagggccaaaatcggggcaaatcccttttaaaaatccaaaagaaaaaaccccgaaaataggggtggaaagggttgttcccagttttgggaacaagaaggcccccttatttaaagaaacgtgggaaccccc

SEQ ID NO: 64852 - protein, 130 aa, Zea mays
  misc_feature: Ceres CLONE 1535075
  misc_feature: SWISSPROT Homolog: EC 3.2.1.23 Beta-galactosidase
  misc_feature (34)..(34): Xaa is any aa, unknown, or other
  misc_feature (35)..(35): Xaa is any aa, unknown, or other
  misc_feature (36)..(36): Xaa is any aa, unknown, or other
  misc_feature (37)..(37): Xaa is any aa, unknown, or other
  misc_feature (38)..(38): Xaa is any aa, unknown, or other
  misc_feature (39)..(39): Xaa is any aa, unknown, or other
  misc_feature (40)..(40): Xaa is any aa, unknown, or other
  misc_feature (42)..(42): Xaa is any aa, unknown, or other
MAREAVIALFCSVFSCQHVILVALFGVQTSLKSXXXXXXXKXKKKNETLQGPNSPYSESYYPRSLAVVLQRPDWENPGVTQLNRLGTHPPFASWRNYQKGPHGSAFPNIGPPGMAKGKIVSVNNFVKIPG

SEQ ID NO: 64853 - DNA, 819 bp, Zea mays
  misc_feature: Ceres CLONE 1535081
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (695)..(695): n is a, c, t, g, unknown, or other
  misc_feature (819)..(819): n is a, c, t, g, unknown, or other
tcctttgtggttttttttttttttttttnnnnaannnnttcaaannnnaaaaaactcgagctcacgcggtgggggacgctctatcctaatggatcccccgggctgcaagaattcctctcacccctagaaaagtcgagagagtcgtccccccgcgtgctctccgcctgcggcctctgtatcccgcaaccaaaaactaccccccaaaaaaagaagaaaaccccaaatcctcgagatctatcagtatccagcgacttaccaatccgattgctacgtttcaccttccaaaccaaaaaaaaaaaacgagatcctcgaggtacccaattcgccctatattgtccccgattactggcggctcaatggccctcctatttccaccccgatgactgcgcacaaaccccggggaccaacctccttttctccccctcgatagatgggggggggaggcgccaacctgtcctccactacataattacccccccccacctataaatccacttctctaaccattttctttcacccttgaattgtgcctcatagattaaactttcaaaccctcttaaatatttttattcacgaatacccacaatagacccttaacttattaaaacccatttattcatctctctccccaaccacataaaagtataaaaaaccgccataataggtcccgccccgcgattatgacgcaacttaanctatcagttaacccctccatttatactcctaatccacccctcttcccctttattcgacgagtttcttgcaccctaaccaccaaattagagaaaattcactcgcacacttcaagaacccacatcn

SEQ ID NO: 64854 - DNA, 668 bp, Zea mays
  misc_feature: Ceres CLONE 1535082
  misc_feature: Encodes the peptide sequence at SEQ ID NO. 64855
  misc_feature (544)..(544): n is a, c, t, g, unknown, or other
tcaccgcggtggcggccgctctagaactagtggatcccccgggctgcaggaattcgtctcacccctagaaaaaagttcacctttctcttctaatggcttcaagccggcgacagcagcaacaatgcgacgttcatttcaccgtttgcttcccgagatacggtcatacggagccacagtttgtcgttactgctcccagccagcgtgaaccgatcccacggagctcatcccacaggccacagcactcctccggtactcccctcgcacgacttcacgagcgcggtcgactgccgccgccaccaccgccgatctgcaaggtcccgtcgaccaccgccactctgcaagtgaggggaaagaggcaagattgaggagggaagcatcgctggtgtatccgccgccacattcgtcgccgggagccagcccatattcgagacgaggtcgagctttgctgccttggcgagcttcagtcgaatcaaggttgagcctggcggcaggccagtaaacagagcaacgcaaaacccttcgaatcaatggagacctccgcagncaccccgacccggccgccccacccggcggcccgcttcccatcgccgtcgccctcgtcgtcgctgaggctgtggaggtcagcggcgcagcgcaacgtgcgcaatcagtggtcccgtctgagcgcg

SEQ ID NO: 64855 - protein, 47 aa, Zea mays
  misc_feature: Ceres CLONE 1535082
  misc_feature (6)..(6): Xaa is any aa, unknown, or other
METSAXTPTRPPHPAARFPSPSPSSSLRLWRSAAQRNVRNQWSRLSA

SEQ ID NO: 64856 - DNA, 907 bp, Zea mays
  misc_feature: Ceres CLONE 1535084
  misc_feature: Encodes the peptide sequence at SEQ ID NO. 64857
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
tttgttttttgggtggttnnncctattataacctccttccttcccccccttattttagagtttcacgcggtggcggccgctctatactagtggatcccccgggctgcaggaattcctctcacccctagaaaaaaaatctgggacatgatctcccaaggtgcttacatctatgtctgtggtgacgccaaaggcatggcccgagacgtatatagagttctccataccattgttcaggaccagggctccctcgacagttccaaggccgagagcttcgtgaacaatctcccaatggaggccacatatttgacggatgtctgcaaaagagcgattggatgaattttctttcttattacaccccgtgtacaactaactaccagtacaaccactgaccatcgcacctgcagtcggacgtttttttttttttccctcccccccctcttatagtggggaggggcggtcctttccattcctctttccactaattccccccccccctgctctacgtgtaagaatcctcccccaagaacattcctttttgcgaccggttcccgccactcccccattattctccccattacaggttgtatctctcggtatcctacagtaactcccatcctccttccaccccaccgcaacaccattgctctccgagatcgccttgtcctcacaattctacccacccctcctatcacactcttttattgatacactcctcaagaacatcactacatcaaaccaccccccctctgacccgcagtacatgaacattcccacggagtccagatacgctgtccaccttgctgtgccctcgccccgcacagcccctcgcccggcccgcctccccacccgttacccccatcacctctctcacccccccacctcgtcaacgccgacgaactacaccacc

SEQ ID NO: 64857 - protein, 63 aa, Zea mays
  misc_feature: Ceres CLONE 1535084
  misc_feature: SWISSPROT Homolog: EC 1.6.2.4 NADPH--hemoprotein reductase
MISQGAYIYVCGDAKGMARDVYRVLHTIVQDQGSLDSSKAESFVNNLPMEATYLTDVCKRAIG

SEQ ID NO: 64858 - DNA, 821 bp, Zea mays
  misc_feature: Ceres CLONE 1535087
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (16)..(16): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (40)..(40): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (571)..(571): n is a, c, t, g, unknown, or other
  misc_feature (821)..(821): n is a, c, t, g, unknown, or other
tggtgtttgnnngggngtgggggnnnagggagggccgggnaccaaacatctttaaacttnnnaaaaactggagctccccgcggtggcggccgctctataactagtggatcccccgggctgcaggaattcgtctcacccctagaaaatgtatcaatctgaagcttattttcttcactggtacaagatgagcagtgctcttttacggatttcgggctggggcagaagtcgcgaactgcaacttttttgaagcggggttattttgacctagttttcctgttaaacattgccagtgccgaaactttgtcgtctcatgttgataaacatttatcggggccattgggcagctgctagtttggcaattgcaaatcaatttacccttttggttcagaagggcataggctgctacccctagtggctaaaaatttcgttgacagggtcttacgtttgccagtttaatttcctgtacattgcccggggcccgttttacccccgttacctttggccagggcagggaccgccttgtggaatcccccgtgttaaataaatggaatttccccacccttggaaccanttatcttagcaaacatacaagcgggaaaaaaaacatacatacttaccccgaaaccgctctcaaaggtaccccaattttccccccctaaagggggaaggccgtatttaacccgcggcgcctcacctggggcccgtcccttttttaaaaacgggtcgtgggaccgggggaaaaaaccccctggggggtttacacccaaatctttaaacccgccccttgggaaaagaaaattcccccccttttttcagacaan

SEQ ID NO: 64859 - DNA, 911 bp, Zea mays
  misc_feature: Ceres CLONE 1535088-R
  misc_feature (378)..(378): n is a, c, t, g, unknown, or other
  misc_feature (911)..(911): n is a, c, t, g, unknown, or other
caaatgggtacctcgagcgtctcgtttgtttggtatatataaaaacatttttgtttcccctttttctttttttatttttatccccatgataattactagactaacattgtaattgagaatttgatcgcttgatgttgcacatgatatagaaacattttattggtagttacagtcagacctactctccttaaagcttaaagctattaggtaatgtcacctagtgacttattctctgctaccaagtctttttgtaaactttgctctggattaacaatctctgtttaaataactgatttaattgaacaggtttttagcactcaaaaaaatcactcaagatacaccttttcttttttaaagttgtttggtaattgttttttncaatttttaacgtcatttaggttgttcaaggctgtaagcaaaaattgtttttcttaaaaaatcccaaaggtccccccagaagaaaaaaaccccctttttatttttgtaaataaacagcgttccccccgtggcgcacttgaaaagggggggttctttttaacttgaaacttttggggactcctcgagggggacctcttttccccaaattttttttccaaaacccaaaaaaaatttcgctctttgcgaaactaatcccccgcctttttttgggcgtttcgataataacatgggaaaaaacaaataaatttcccctcttacccttttgtataggaccaaaagaatagggggggactcttgaaaaaaaaaaaaactacttgattaatttttttgtaaaccaaaacaaatgcccggcgggaggccgcgcgaggtaagaggcagtttgagtatatcggtgtggtctgttacgtatccctactaatcatccaaaaaaaaaaatcaacatgcctcacagtgctgggtcttggaggaatatn

SEQ ID NO: 64860 - DNA, 672 bp, Zea mays
  misc_feature: Ceres CLONE 1535092
tctcaaattagggaatcccccgggttggaggaattcgtttcacccctagaaaaaatctacccgctcctaggttctgcccccccattggaaaaaagcccagagggaatgcgaaatggaaacgccggctcatgtcgtactccttgctgccgtccctggactctacagagaaccccttgtaccctttggggactttatccccctttcctccgaaggggacccccctcctgtaaattatcagcccacagaggggcacccaccaaataaggggatatttgcctttccggtcgggggtttcggtccccggaaagatgcaacaacacaccggggcgcacgagggtgagggtgggctagaacggcccatgcgaggtcgactgaatccgccctcttctgcttgactgacttcctctcgcctggggtatgacggacgcccctggtactcctagggcacaatattctgtcccctatcgatctattaatggtatcgctcgctcctggaaggaattccatcgcctgggccttggttacctctttggcctgcattgggtaaactggccgttccaatgtttccttgccctttattaattggcgtgcctcctcatccctcaggctgatcctggagaccgtagccactaatcattcatgcactccttgggtccccaagttgctcgccct

SEQ ID NO: 64861 - DNA, 792 bp, Zea mays
  misc_feature: Ceres CLONE 1535094
  misc_feature: Encodes the peptide sequence at SEQ ID NO. 64862
  misc_feature (38)..(38): n is a, c, t, g, unknown, or other
ctcttgttcgttcgctccttatagggaactaatattgngcggcccccctaacgcaaacctggagctcaccgcggtggcggccgctactttactagtggatcccccgggctgcaggaattcgtctcacccctagaaaaagtccttatcgccagccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgcccaggggtttctttgaggtcaatcatgatgtcctctccccttacatgtgcctgaatttctcccgtggctcctgggggtccagacacctggttaataggtcgctttcctctaacagttgtgtcatgaaccgcgggaagccccttgagaccctttgaagggatcccaccgtgggtttttggctgtccaaggttccttcacctggaggagggtgtaaacctttggaccccctgttggggttaacaaaacacgccccttgtggttttttctcactacctaaaacggggggtaggaaaaattttcccttctgaccct

SEQ ID NO: 64862 - protein, 75 aa, Zea mays
  misc_feature: Ceres CLONE 1535094
  misc_feature: SWISSPROT Homolog: EC 1.11.1.6 Catalase
MDPYKHRPSSGSNSSFWTTNSGAPVWNNNSALTVGQRGPILLEDYHLIEKLAQFDRERIPERVVHARGASAQGFL

SEQ ID NO: 64863 - DNA, 791 bp, Zea mays
  misc_feature: Ceres CLONE 1535099-R
  misc_feature: SWISSPROT Homolog: EC 2.7.9.1 Pyruvate, phosphate dikinase
cctcgagcgtctcgttttttttttttttttcctttttttataaccgataattgatgatgtattgaaaaacaaagttttgaaccatggagcattttggaagttttacttgactggggaaaaaaaaggacatgggattgtagcttttatgagcactgctactagtaatgttcacatagcatggctctgtaataatactgttgatcaccacatccaccagcagcaggcaatccggttgccaatgaggaggcagcctcaaacaagcacctgagctgcagctagcctagcaatcggaaccctgaaaggggagcaagaaacgtaatccagcccagccttcgcaaaaaaggccacaaaggaaggctctccaccgtgttctccacaaatgcccaccttcaagttaggcctagctttgcggcccctctctgtagcaaacttcaccagctcgcccactcccctctggtccaggacctcaaaggggtcatgttggaggatgccctgagcaaaataaacgggaatgaacttccccacatcatccctgctgtacccaaaggtcatctgcgtcaggtcgttcgttccaaaggagaaaaattcagcctgctccgctatctcatcagccaccagagctgccctggggatctcaatcattgttccaactttgtacccgatagtcttgcccacattggcgaacactttctcagcaacttggcggataagagtcacttgatgccccaattccctgtggtgttccaacaagaagaaccattatctctgggaacacttaaaaaccctgttgt

SEQ ID NO: 64864 - DNA, 657 bp, Zea mays
  misc_feature: Ceres CLONE 1535099
  misc_feature: Encodes the peptide sequence at SEQ ID NO. 64865
gcggtggcggccgctctagaactagtggatcccccgggctgcaggaattcgtctcacccctagaaaaagttcgcctctcacgtttttgttgtactctctcgtcacacgactagcctgtgagctaaggaggagctacggagaaaaagaggcgcgagacagacacagtagatagatagattgctcctccctctccccttgctccataagagcgtgtaacccatcgagaaaatcttgtggactgactttacctgggctcggcacaggaggggatctaaaggatggggtgttctgtttccagtgacatctgcgtgtcttaatgccgggctcagaaagtatcagggacagggaagcgacctccttcgctcgcccatcggacgtatggccgaggagcccgcacgccaaaaccgccggcgtcatccgctacgactccggcgcgggcacggggccagcattgctcgccactgagggccgacgttgacggcgctcagatatagacgagcagcaagagggtgtgccactttcgcaagggcaagacccagggcaacaagaccatgaacgagctgctgggcggcaagggcgcgaacctcgcggagatggcgagcatcgagatgtcgatgccgccggagttcacggtgtcgacgggagcgtgctagcatt

SEQ ID NO: 64865 - protein, 33 aa, Zea mays
  misc_feature: Ceres CLONE 1535099
  misc_feature: SWISSPROT Homolog: EC 2.7.9.1 Pyruvate, phosphate dikinase
MNELLGGKGANLAEMASIEMSMPPEFTVSTGAC

SEQ ID NO: 64866 - DNA, 725 bp, Zea mays
  misc_feature: Ceres CLONE 1535106
  misc_feature: Encodes the peptide sequence at SEQ ID NO. 64867
  misc_feature (9)..(9): n is a, c, t, g, unknown, or other
ctataacangtggatcccccgggctgcaggatattcgtctcacccctagaaaaaagaggagagagtcgctctgcactgcacgactcctcccccatctaccactacctgtctacctacccagcccatcgactgcccctcgcaacgcaatggcgctcgccaccaactccgccgctgccgcagcagctgccgtatccggcggcgcggcatcccagccgcaccgcgcggccacgttcctcccgctgaagaggcgcaccatctccgccatccacgccgccgacccgtctaagaacaacgggcccgccgtccccgcggccgccgccgctaagtcatctgcctctgcggtggccacgccggagaagaatccggcgggcgcctgtaaccccccccggccgacagctggaagtccaaaaaaggcgcctgcagctccccagagtaccccaaaccagggaggagcttggaacccggtgcttccaagaacaatcgagaaccttccccccccggtggtggatcgcccggaaaaggccgcctcaccccccaggaagcccatgggcctaagggctgcccattgggcccgggcccttttattcctccaagggtgggggaactggcgcccaagagctttccaaggagttttccacgcccaacaaacatcccggggaacccctttcccgtaaaatcaggcctacaaaagggggcgcccccgggctcatggttcccgggggggt

SEQ ID NO: 64867 - protein, 175 aa, Zea mays
  misc_feature: Ceres CLONE 1535106
  misc_feature: SWISSPROT Homolog: EC 2.5.1.54 3-deoxy-7-phosphoheptulonate synthase
MALATNSAAAAAAAVSGGAASQPHRAATFLPLKRRTISAIHAADPSKNNGPAVPAAAAAKSSASAVATPEKNPAGACNPPRPTAGSPKKAPAAPQSTPNQGGAWNPVLPRTIENLPPPVVDRPEKAASPPRKPMGLRAAHWARALLFLQGWGNWRPRAFQGVFHAQQTSRGTPFP

SEQ ID NO: 64868 - DNA, 663 bp, Zea mays
  misc_feature: Ceres CLONE 1535108
  misc_feature: Encodes the peptide sequence at SEQ ID NO. 64869
tccccgcggtggcggccgctctagaactagtggatcccccgggctgcaggaattcgtctcacccctagaaaaaactcgatccagatatcccagagcaacgcacacggagcacacagcattgcagtatagcaagcgccagcgccttggtttgcatcgtcctcgctcgctgtcgctgctaactcagagcacgcatcatcatcagcatttgcgcgacgttgatcgagagagctagtcagatgcaacgtcagagagctaagatgccggcaggccagctgagctggccgttactgctaggcgcggtgttagcctttggagttgcagctagcccggcccaggcctccaggaacactcactacgacttcgttataaaggagaccaatgtcacccggctctgccacgagaagaccatcctggccgtgaacgggcagttccccgggccgaccatctacgcgcgcaaggacgacgtggtcatcgtcaacgtgtacaaccagggcagcaagaacatcaccctccactggcacggcgtggaccagccgcgcaacccgtggtccgacggcccggagtacatcacgcagtgccccatccagcccggcgccaacttcacctacaagatcatcttcaccgaggaggagggcacgctgtggtggcacgcgcacagcgact

SEQ ID NO: 64869 - protein, 135 aa, Zea mays
  misc_feature: Ceres CLONE 1535108
  misc_feature (36)..(135): Pfam Name: Cu-oxidase_3 Pfam Description: Multicopper oxidase
  misc_feature: SWISSPROT Homolog: EC 1.10.3.2 Laccase
MPAGQLSWPLLLGAVLAFGVAASPAQASRNTHYDFVIKETNVTRLCHEKTILAVNGQFPGPTIYARKDDVVIVNVYNQGSKNITLHWHGVDQPRNPWSDGPEYITQCPIQPGANFTYKIIFTEEEGTLWWHAHSD

SEQ ID NO: 64870 - DNA, 663 bp, Zea mays
  misc_feature: Ceres CLONE 1535110
  misc_feature: Encodes the peptide sequence at SEQ ID NO. 64871
  misc_feature (639)..(639): n is a, c, t, g, unknown, or other
tcttaactagtggatcccccgggctgcaggaattcgtctcacccctagaaaaaagggttttactccgcagccacaccgcgccgccggagcagcgcgagacccgcgaggcgagccacgcgagagagatgaggctcctgacgcacaacatgctggcgtcgaacgtccggggcgcaaccaccggctacccgctgacgctggaggcgaccaactggtgcaccaaggaggtggagctcaactccgacttcatccgcggtctcctccccaagatcgactggcgcgcgctcgtcgccgccacccgcgcgatcggcctccccgagctcctccccgaggagcagccccccgaggaggagatcttcgccgagggcgccgccgacgtcgagggaccctccatccgccgcatccaccacgcgctcctcgaggttcatgtcccggaagggctccctcgtctgcccccgaccccagccggctgcttccccatcaaccaagggcatcccccaacctgatgcttccccgaggaacgaaggcctgatttttggcggggtcagttttccccccggccctctttttgctcccgccacctgcctctacatggggcctggcccccaaaggggaatccgggcgctttggggaactttcaancctcccaattttgtaccctttgga

SEQ ID NO: 64871 - protein, 125 aa, Zea mays
  misc_feature: Ceres CLONE 1535110
  misc_feature (2)..(121): Pfam Name: Trm112p Pfam Description: Trm112p-like protein
MRLLTHNMLASNVRGATTGYPLTLEATNWCTKEVELNSDFIRGLLPKIDWRALVAATRAIGLPELLPEEQPPEEEIFAEGAADVEGPSIRRIHHALLEVHVPEGLPRLPPTPAGCFPINQGHPPT

SEQ ID NO: 64872 - DNA, 535 bp, Zea mays
  misc_feature: Ceres CLONE 1535113
  misc_feature: Encodes the peptide sequence at SEQ ID NO. 64873
  misc_feature (127)..(127): n is a, c, t, g, unknown, or other
  misc_feature (289)..(289): n is a, c, t, g, unknown, or other
  misc_feature (331)..(331): n is a, c, t, g, unknown, or other
ccccgcggtggcggccgctctagaactagtggatcccccgggctgcaggaattcgtctcacccctagaaaaatcgtcggtagccgtcggttcacttctccaggtaaggaaagggttcgtactcatgngcgccgccgcagccaaagtcgggccttttcgttggcatcaacaagggtcatgtcgtccaccaagcgcgagctgcctccccgcccgtgccacgcaagggggaaatcacgaagagggtgtctatggtcaggggcctgatcagagaggttgctgggtttgctccntatgagaagcgtatcactgagcttctgaagggtggcaggganaaccgtgcccctgaactttgctaagaaaaactttggaactcaccaaagggcaaaaaaaaaaaaaaaaggggaaatggggggccgtccccccaagaaaaaataaggtccgtctgggccccccccccggcccaaaaaaaaaaaatggggaggcgttttcaaggttctggggggcgtggggcccccaaaaaaattttttctcccggg

SEQ ID NO: 64873 - protein, 35 aa, Zea mays
  misc_feature: Ceres CLONE 1535113
  misc_feature (28)..(28): Xaa is any aa, unknown, or other
MVRGLIREVAGFAPYEKRITELLKGGRXNRAPELC

SEQ ID NO: 64874 - DNA, 661 bp, Zea mays
  misc_feature: Ceres CLONE 1535115
  misc_feature: Encodes the peptide sequence at SEQ ID NO. 64875
  misc_feature (661)..(661): n is a, c, t, g, unknown, or other
tacccgcggtggcggccgctctagaactagtggatcccccgggctgcaggaattcgtctcacccctagaaaaagcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcgggtgggcgtggcgcccgaggtgggcaggggtcgtcgtccgcgaccacaatgctcagcaggcggcgcagctccctccgccgcccgccgctgccgcggtggtccctcgcaacgaggcgcccgccgtcgtaccgagaactgtggtggctcctgcggcgcccgaggaccagcagctggcggtgaccaccccgtgacttgatgcacctctgggcggctcgtccaaggagaagggacggggn

SEQ ID NO: 64875 - protein, 104 aa, Zea mays
  misc_feature: Ceres CLONE 1535115
MSALLDLLMGIFRQQTLGGAALELAALAAPLWLAALVGLLIGWAWRPRWAGVVVRDHNAQQAAQLPPPPAAAAVVPRNEAPAVVPRTVVAPAAPEDQQLAVTTP

SEQ ID NO: 64876 - DNA, 761 bp, Zea mays
  misc_feature: Ceres CLONE 1535117
  misc_feature: SWISSPROT Homolog: EC 3.2.1.23 Beta-galactosidase
  misc_feature (16)..(16): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tcctttgcgtgtccanccctttagttctaacgtctcaactaccannannnttaataatggaactccccgcggtggcggccgctctttactagtggatcccccgggctgcaggaattcgtctcacccctagaaaaaaacgcagctgcgcggtgcacacaaagcgaactattctttcgccttttactaaagaataccgtgtgtgcgccgcaaatagcagcatacgctaatttttggagggatcctctattttagagggcccctgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggggtaatagcggaaaaggcccgcaccgatcgccctttccccaacacccccccaacctgaatggcgaatggaaattgtaagcgtaaaaatttttgttaaaattcccgttaaattttttggttaaaccacctcattttttttaaccaaataagcccaaaatcgggcaaaatcccccttataaatttcaaaaaaaaattacacccgacaaaaagggtttaaaatggtttgttccacatttgggaaaaaaaaaagtcccccttagtaaaaaaaacgggggaacccccaagcggctcaaggggggggaagataaacaccctctttatcaggggggaagtagga

SEQ ID NO: 64877 - DNA, 669 bp, Zea mays
  misc_feature: Ceres CLONE 1535118
ggcggccgctctagaactagtggatcccccgggctgcaggaattcgtctcacccctagaaaaaatttttgctttgcttcctcttctctcgctcctccgcgcccgcctcctctcccctaacgcttagggttagccaggcagcgacctccctcgcgaatcctccatagccgccatggacaccgaggttctcagatgccacgatgcactcaacaaccgcctgcatctcggacgcgtacaccccgtccccggcgaagccgcgcctgcgccgtagccccaagtcggcggccgcatctacgccgctcgcaagggtcgcggcgcccataacctcgacgtcgccgccgaagcctgctgcagtgcacaagacggcgacgcacgttaagggtcctgcagccccccccacgccgttcgcccgccgtcaggcccgctgactccgcgcggagcagctgtcccccctcaggagaatcaccacggcggcttgtcatggacgaggccggaatctgaattgcggcgaggaacctgccgtccaactcccgagccggaccatacgctggtgaagcagcccaccccgttagccagccgctggggtggaccagggcccctctgcttcattggccggaccgggccccaggccccgcccgggggcccaaaaaaaaaaagggttgtcttccca

SEQ ID NO: 64878 - DNA, 657 bp, Zea mays
  misc_feature: Ceres CLONE 1535119
  misc_feature: Encodes the peptide sequence at SEQ ID NO. 64879
  misc_feature (317)..(317): n is a, c, t, g, unknown, or other
ggcggccgctctagaactagtggatcccccgggctgcaggaattcgtctcacccctagaaaaagcgagcacatggaagaccgactcgaccagacaaaacagcagcccatccccccagtctgcggtcttcccctccctgcctcctcgtctcctcggtctcccctccctgtcttccagagacacagagcagggcgctcttcggtcggaggagaagcgcgaccacgaccatgggctttatctcgttcgtcggccgggttctcttcgcctccctcttcctcctctcggcctacccagagttcattgaatttggaaatgacngtggacctgcagcgaagaccttgaaccaaagttcaatttgttcgtcaagctagtgtccaaagaattactggactgggggctgcccccattgggatttaaaaactggtctttgccgctaccatggtttcttaaagggtttggggggcctttcggttccatagtccgccccctccttttggaaccattccccccggggcccttttacttgggggttttaatacccccctattgtgggttggctttcctcccccccttgaaaggggaggcccaccccgggtttgggggcacttttttttttttcaagattcccacccaaaaaacttgggggtgttttttgggg

SEQ ID NO: 64879 - protein, 47 aa, Zea mays
  misc_feature: Ceres CLONE 1535119
  misc_feature (31)..(31): Xaa is any aa, unknown, or other
MGFISFVGRVLFASLFLLSAYPEFIEFGNDXGPAAKTLNQSSICSSS

SEQ ID NO: 64880 - DNA, 663 bp, Zea mays
  misc_feature: Ceres CLONE 1535123
  misc_feature: Encodes the peptide sequence at SEQ ID NO. 64881
tccccgcggtggcggccgctctagaactagtggatcccccgggctgcaggaattcgtctcacccctagaaaaagaccgcaggcagactactagactcggcatctccgccgctcctctctccacccggcgcgcgcgcacacacagcacagacacctacagtcaccacacgcgccatggctacgcactcggtcgccgccgcgcacgccaccatcgccgcgcgcgcgggcgccgccggggcgccggccccggccgagcgcctgggcttccgccttctgggctcgcccgccggcggcctgcgctccgcccgccgcgcgccgcccgcggccgcctcccgccgccatcgcgtcgtgcgcgccgccgccgtcgagacgctccagggcaaggccgccaccggcgagctgctcgagaagtcggtcaacacgatccggttcctggccatcgacgccgtcgagaaggccaactccggccacccgggcctccccatgggctgcgcgcccatgggccacgtcctctacgacgaggtcatgcgctacaaccccaagaacccctactggttcaaccgcgaccgcttcgtcctctccgccggccacggctgcatgctccagtacgccctcctccacctcgccggatacgacagcgttaaggaggaggacttgaagcagt

SEQ ID NO: 64881 - protein, 163 aa, Zea mays
  misc_feature: Ceres CLONE 1535123
  misc_feature (76)..(163): Pfam Name: Transketolase_N Pfam Description: Transketolase, thiamine diphosphate binding domain
  misc_feature: SWISSPROT Homolog: EC 2.2.1.1 Transketolase
MATHSVAAAHATIAARAGAAGAPAPAERLGFRLLGSPAGGLRSARRAPPAAASRRHRVVRAAAVETLQGKAATGELLEKSVNTIRFLAIDAVEKANSGHPGLPMGCAPMGHVLYDEVMRYNPKNPYWFNRDRFVLSAGHGCMLQYALLHLAGYDSVKEEDLKQ

SEQ ID NO: 64882 - DNA, 2153 bp, Zea mays
  misc_feature: Ceres CLONE 1535124
  misc_feature: Encodes the peptide sequence at SEQ ID NO. 64883
acttcacactcccaggctccggctccagctacagcatcagccccagccccagccccagccccagccccagccaggagccagccacgggaacaaaggaaccagtgcaccacaagctccaaagcagccaacacacaccaagaaaaaaccaaaagccatgcccccggtagcagcaaaagcaccaatcgttccccgccgccgtctctaagctactgtgcatacccccacctcgcggccgctcgccggtccatgggtgcggctcgtccgcggcgctggaagctgccgttccaccgcaccgtcagcgccgtgggcggcgggggcggcgcgccgtgctcgccctcgtccaggtcgtcctcctcgcccgcgcggtccgaggcgtgggcggccgaggcggtgccggaggagttcctgtgcccgatctccggcgcgctcatggcggaccccgtcatactgccgtcggggaagaccttcgagcgggcctgcctccaggcctgcgcggagctcgcgtttctgcctccgggagtcgaggccggggacgcggacactgtcatccctaactccgcgctcaaggcggccatctgcacttggtgcgcgcgctccggacgggaggtgccggcgccgccgtccgccgaggcggcgcggcaggccgtgcagcgcgctatgcctccggcggctgccaagtccgtgaggacgaccaccacaaggcgcgcggtggtgatggccgcgagcacatcaaactcgtccacgtcgtcgtacgggtcggcctcggagatcaccgcggcggaggacgaggccaaggccaaggaagaggcgccgcggaggaggacggtcaaggaagcggaggtggagccggcggcggcgccgccggctgacccgctggaggacgatgtggtgggcaaggtgatggacgcggacgacgacggcgtggtcgctgcggcgatgggcgcgctgcgggaggccacgcgcgagggcgaggagcggcggcgcgcgctatgcacgccgcgccttctcggcgcgctgcgccgcgtgctgctgctcccacgccacgcggccgcccgggtggacgcggtggccgcactggtcaacctctccctagagcccgccaacaaggtgcgcatcgtgcgcgcgggggcagtgccggcgctcgtcgaggtgctccggtcgggcgcgtcggcgcccgaggcgcgggagcacgcggcgggggcgctcttcgggctggccctcaacgaggacaaccgggccgccatcggcgtgctgggcgcggtaccaccgctcctcgacctgctcacgtcgcccacccacgcgccccgcgcgcgccgcgacgccgggatggcgctctaccacctcaccctcgcggccgtcaaccagtccaaggtcgcgcgcttccccggcgcgcccaaggcgctgctcgccgtggcctcgggcgccgcggagccggggcccatccggaggctggcgctcatggtggcctgcaacgtggccgcctgcgccgagggccgcaacgcgctgatggacgcgggcggcgtggcgtccgtctccggcatcctcctctcgccttctcacgacaccaccaacggcggcggtggcaccgcggacctggaggagtggtgcctgtcggcgatgtacgcgatgagccgaggcagcctccggttccgcggcctggcgctcgcgtccggcgcggaccgggcgctccggcgcgtggtggccgacgagggcggcggcgtccggcgcgagattgctcggaagaccctccgcgccatgcggagcgacctcgacgaggacggcggcgagtacaacgacctgaccggaagcagcgcggagtgcggcgacggtgaggactgcggcgggagcatcgtgtcggacgggctcatgtcgttccggcgccggcagcgcgagctcggcgtctcgtcgtgcggcaacaccgccgagttctgaacccgttctccggcgaccggtgcccgtccacgtccattgcgactgatgttttgcgcatgtataaattgcttggttttaggttcacgaggttagacatttgtgccgtgtgtgaagcagatgatgaaaaacttccatggtttttggaacctgtgtgtgtgactgtcagtgaaaaaaaaaaaaaaaaaaaaaaaaaaaaaaaaaaaataaaaaaaaaaaaaaaa

SEQ ID NO: 64883 - protein, 561 aa, Zea mays
  misc_feature: Ceres CLONE 1535124
  misc_feature (48)..(120): Pfam Name: U-box Pfam Description: U-box domain
  misc_feature (283)..(325): Pfam Name: Arm Pfam Description: Armadillo/beta-catenin-like repeat
  misc_feature (326)..(368): Pfam Name: Arm Pfam Description: Armadillo/beta-catenin-like repeat
MGAARPRRWKLPFHRTVSAVGGGGGAPCSPSSRSSSSPARSEAWAAEAVPEEFLCPISGALMADPVILPSGKTFERACLQACAELAFLPPGVEAGDADTVIPNSALKAAICTWCARSGREVPAPPSAEAARQAVQRAMPPAAAKSVRTTTTRRAVVMAASTSNSSTSSYGSASEITAAEDEAKAKEEAPRRRTVKEAEVEPAAAPPADPLEDDVVGKVMDADDDGVVAAAMGALREATREGEERRRALCTPRLLGALRRVLLLPRHAAARVDAVAALVNLSLEPANKVRIVRAGAVPALVEVLRSGASAPEAREHAAGALFGLALNEDNRAAIGVLGAVPPLLDLLTSPTHAPRARRDAGMALYHLTLAAVNQSKVARFPGAPKALLAVASGAAEPGPIRRLALMVACNVAACAEGRNALMDAGGVASVSGILLSPSHDTTNGGGGTADLEEWCLSAMYAMSRGSLRFRGLALASGADRALRRVVADEGGGVRREIARKTLRAMRSDLDEDGGEYNDLTGSSAECGDGEDCGGSIVSDGLMSFRRRQRELGVSSCGNTAEF

SEQ ID NO: 64884 - DNA, 755 bp, Zea mays
  misc_feature: Ceres CLONE 1535131
aaacggattttcgccggacaccgctggcgccggccaccgcccgagaacctcaaaactggaactccacgcggtggcggccgctctataactagtggatcccccgggctgcaggaattcgtctcacccctagaaaaagcccctccgaatctcgaatcccgctaatccaaatccatcgagcgggagaaccccgaattccaaaaatccccaaaacctcttcccaaccctagctcgctagcctcactgttccccttcgactcttccccttcgcacctctgattcctcgcgccctcgtcccccgctcaatttccagaagcttctagaaccgggtttccagccctaatcgcgcaaaaagatgctttctcgcgcctagtagcctgggacggaggcatggacagcggcggcggggagggaggctcgactggcgggaggttccctattctgcaggcgaataggggacccccccccccaatcgggagggggacgttgccaaaagactcgagcagtacctgctcaagatctgttcagggggaaggtctccggcgaggacgagtcccattctgtcaactgtgccgaagcggcgtttactactcccaaggatcgggtcaggtacacagtcggaagggcggaagaccttgtacctcccttggtgccttcatgacgataggagttcctcctcaccaaaaggaaacgccggatcaaacgggggaaaaatggtaaccagcttgtatttctaaaggcccaaggcgggacccctg

SEQ ID NO: 64885 - DNA, 828 bp, Zea mays
  misc_feature: Ceres CLONE 1535131-R
ccgattgggtacctcgagcgtctcgtttttttttttttttttaatgcgaatagaacttgttttgattcgattgttgattacaaatcggccgcaaacctctctttatagaggaggggggctgaaccctttacacgactggattccgggttaattccgcaaatctagccaacaaacatagcataaaactcggaaccctaaactgctctgcgcatgcccggctgtccggaccgcggaccgtccggcctcaaagccggaccgtccaaccgctcaatatggtgctcaacagctagtttattgaaccaggaaaaaatctcccaatatcattagctataaaacggcaagtcggtaaacaaatcttgccctgttaccattaggcttgaaagctgatacaaatacgtacaaaacagcacaatgaactattgtacatgttacatgtacacccgctagctaggcctaatgtcaacagtaccccatctgaaccaggaaccatggtcactgtctcgtcaaaagagctgattgcacagcattcgttgcctgccaatgaaaccgccactgaagttgcaacaattagaaaaatcagactctagatgcccatcagtcagtctgccattggcaatcaggctctaaatgcccatgagtcagtctgccattgggattcatcccctggattcaaaattgatccgctgcattaaatgagtgattgaacttcgcctttccctttccggcttgaatcaaacctgatccccgtcctggacttggaactttgccttttttattaaatggcttcttgggggcaccccttgtccttcccggggagaatcccccccc

SEQ ID NO: 64886 - DNA, 663 bp, Zea mays
  misc_feature: Ceres CLONE 1535135
  misc_feature: Encodes the peptide sequence at SEQ ID NO. 64887
gcggtggcggccgctctagaactagtggatcccccgggctgcaggaattcgtctcacccctagaaaaaatcccctccactccactccactcgtttctttcgcttcccgcggcgaaagccctcgaagcagataaggcctaccggctgccgccgtgcccgtgccggtgcccgcgctcgaccaccgccggccatggtcggcgtcgccctcgcgccggcagtgtcccgcgtgccttgccgtcccggcgcttccttccacgcctcgcgcccctcctcttcggcgcggctcccggccaggccgcgggcgcgggcgccgccggagaggctcgtggttgtcgcgcggtactcgtcctcgtacgaggtcgagggcgaggaggaggaggaagatgaggaagggctcgggggtggcggaggctgggggaggagggaccgcgggcccgaccccgactacgacccggcccttgacatcgaacgcatcgagtcctcgaccgtaaggctattggacgaacagaaaagaatggttggtgtagtatctgtcagcgaggcagttcagattgcagacgataatgatcttatactggcaatattatcaatggatggggaccccccagtacttcgactctttgaggagagagattacaaaaaacataggtatgaacaacagaag

SEQ ID NO: 64887 - protein, 158 aa, Zea mays
  misc_feature: Ceres CLONE 1535135
  misc_feature (93)..(158): Pfam Name: IF3_N Pfam Description: Translation initiation factor IF-3, N-terminal domain
MVGVALAPAVSRVPCRPGASFHASRPSSSARLPARPRARAPPERLVVVARYSSSYEVEGEEEEEDEEGLGGGGGWGRRDRGPDPDYDPALDIERIESSTVRLLDEQKRMVGVVSVSEAVQIADDNDLILAILSMDGDPPVLRLFEERDYKKHRYEQQK

SEQ ID NO: 64888 - DNA, 825 bp, Zea mays
  misc_feature: Ceres CLONE 1535138
  misc_feature (1)..(1): n is a, c, t, g, unknown, or other
  misc_feature (6)..(6): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
nggggncccctgnnggtancccctttccctttctccnncnnnnaaatatccccccataatttgattccaccgcggtggcggccgctctagaatagtggatcccccgggctgcaggaattcgtctcacccctagaaaaaatgtgcgagcctgaagctcaaagcaaagttgcagaataaggagccatgctcccttgtgtaatttcataagactacatccctattagggcttgtttggttgtgtctgtatcgaagggaattgaaggtgattaattttccttctattctaatagaggggttttaatcccctctaatactcctcaatccccccctagacgaacaatctcttaataagatagcagaaattggccgtatctgtgtattactctcgactaaactttgccattaagtatcccatttttttttcccccccccccacgagggggggggggggccccctctttttctcccctaaccactcccactctccacgcacccacatatatccgcttaccggttcggcggtgtacgacggcggctagcacatggagcccgatcggtcggctcgaagccggggtgcgtctggggagggcgctcggtgcccggttgtccccactgcgggtctcgcccagttggggaaaaaaggtgaggcggggtgaaagccgtggttgggggggggagaacatgagttggaagggtgggagatccgcgactgaggcgtacagagcggcggaaggctggccgcggcacgggggtcggcggggagtggggagcgggcgcccacgtgcgacagagtgtgcggtaaaggacgggcggtcgacggagccg

SEQ ID NO: 64889 - DNA, 667 bp, Zea mays
  misc_feature: Ceres CLONE 1535141
  misc_feature: Encodes the peptide sequence at SEQ ID NO. 64890
ccccgcggtggcggccgctctagaactagtggatcccccgggctgcaggaattcgtctcacccctagaaaaaaacgagcgtatctgcttttttttttttggtaaaagaatttgtttttgcaaagctagctcctacgctgccgccgccatgtaccgcttcgccgccgacagggcgcgccgcgcggtggccgcgtccctgcgcggtgcagcttccagagcagcagcagcgccgtcgcgtcacgctacggcgcctcgccatccaacctccccagtcggggcggcggcgccggttgctgacgccgccatggcgagggccgccatgtccacggcggagcgccggcgtgccaccaccggtgtcggacgagacatcagccgcaacgggccgccagtgtcgctcgacaccatcaacaccaaggtcatgaagtgtcaatttgcagtccggggagagattgtcacacgtgctcagaaactgcaacaagaactgcagagaaatccagagtcgcttccttttgatgagatactctactgtaacattggaaatccccattccattggccaacagccagttacctatttcagagaagttctatctttatgtgagaatccagctctcctggacaaaagtgaaacgcatgctttatacaggtcagatgctatagagagagcag

SEQ ID NO: 64890 - protein, 121 aa, Zea mays
  misc_feature: Ceres CLONE 1535141
  misc_feature: SWISSPROT Homolog: EC 2.6.1.2 Alanine transaminase
MARAAMSTAERRRATTGVGRDISRNGPPVSLDTINTKVMKCQFAVRGEIVTRAQKLQQELQRNPESLPFDEILYCNIGNPHSIGQQPVTYFREVLSLCENPALLDKSETHALYRSDAIERA

SEQ ID NO: 64891 - DNA, 883 bp, Zea mays
  misc_feature: Ceres CLONE 1535146
  misc_feature: Encodes the peptide sequence at SEQ ID NO. 64892
gtacgggttttccccccaccagcctctgtcgcggcccccccccccccaaccataccggaactccacgcggtggcggccgctctagaatagtggatcccccgggctgcaggagttcgtctcacccctagaaaaacaccggcatcccataccagatgggttctgttgcatttgctgtcatacaacttgttggaatcattgccgtgatgtctcaggttgcatggcaggtgttcgttgttttcattcccgtggctgctacgtgtttctggcatcagccatactacattgataccgccagcgagatgcaaaggctagtatgtgtctgcaaagctcctatcatacagcatcttgcccaatcaataacacgatcgattaccctcacaacttttggcaaggaatatcagttctgtctcatcaaacagacatctacggggatgccctagctcctatacgccgaaatatcgtaagacccccctaaatctatgtgaggcggacatacgctgtcccccccagagaagggcgctcgtccatccgcgacataaagattatgacggaacctgcttgcgaaaaaacccctgtgcaaccaagtctttaaacacccgctggggttcttcctaatcccgacatttccctggaaatatggcactggaatcccttgtcaaacgacatcaatacataggaccaatccaaccattatacaacgttcgctgtgccaggccacaccgggttttaaccctacgcaccccattttacccatcccctcaaagaaaccccagatataccatatccgccaactagaaagaaacccgtgactcaattctatcgatgccctttcccgggcacagagcactccacattatttatccaccccccgaaactcgttgcc

SEQ ID NO: 64892 - protein, 95 aa, Zea mays
  misc_feature: Ceres CLONE 1535146
  misc_feature: SWISSPROT Homolog: EC 3.6.3.44 Xenobiotic-transporting ATPase
MGSVAFAVIQLVGIIAVMSQVAWQVFVVFIPVAATCFWHQPYYIDTASEMQRLVCVCKAPIIQHLAQSITRSITLTTFGKEYQFCLIKQTSTGMP

SEQ ID NO: 64893 - DNA, 806 bp, Zea mays
  misc_feature: Ceres CLONE 1535148-R
cggattgagtacgtggagcgtctcgtgggacgattttatgcagcccgggggatccgctagttctagagcggccgccatccgcggtggaggtcccgcttttgttcactttagtgagggttaattacacctttgatttttccccgccccgacttacaaaatttgaaaaaaattttgccggtggcccaaacccttgatttccgcagttagttagcttgtttttaccgggcctgcaccccactgacggacagttggttcagcgggaagggcgacttgtcggatttggaccccaacccgccggagttgtcgtttttgccgctggaccccttgactttaataaagggaggctgggggggccgggaaaaccccccccccttgggatccctgccgctgggattctccaccaccttccacatggggggccaaaggttcggcaaccccggggcgcccagagggccgacgtggaacacccggggggggtcctcctccgagcactgctcgcggaggttcgggtccaggagctccctaggggggcccccggtgaagggtccccctatcagggccttgagtgaaaggccttcggcaaatgaccccaccgagttggggctcttccggccggtgaagatctcgaggaccagcagcccgtacctgaaaatgccggccttctcggtgagctgcccggggaacgatgtaccccggggccttgttcccaaaatttccggggaggccgggggcttaaaggggccctggtccccccatgaaattcccggggggaggccctaagtcggggaatcttcggccctgaaacc

SEQ ID NO: 64894 - DNA, 666 bp, Zea mays
  misc_feature: Ceres CLONE 1535154
  misc_feature: Encodes the peptide sequence at SEQ ID NO. 64895
aagctggagctcaccgcggtggcggccgctctagaactagtggatcccccgggctgcaggaattcgtctcacccctagaaaaaattgggttcttcaccgtaccccacacacacccttctcccccaaccccatctctctctctctgcctgcgttctcctggtgctgctctcactctcctcccctgctttgacctccccgcctttccccgccgtttcttggatttctaggatccagacaaccgcccttgtgagcctgccttcctgcctactacctgcgtacgtacaggagggtccttgcttgggtgatccgggtgcctggtttctcggttccgcggcttccgctgctgtaggattcgccgagccggagccgccggagatgaccgtcgacgagctgaagctgcatgcgagggccagcggcggccacggcgccaaggaccagttccccgtcggcatgcgcgtgctcgccgtcgacgacgacccgacctgcctcaagatcctcgagaacctcttgctccgctgccagtaccatgtgacaacaacgggacaggcagccacggccttgaagctgctgagggagaagaacgaccaatttgaccttgtgatcagcgacgtccacatgcctgacatggacggcttcaagctcctcgagcttgtgggcctcgagatg

SEQ ID NO: 64895 - protein, 97 aa, Zea mays
  misc_feature: Ceres CLONE 1535154
  misc_feature: SWISSPROT Homolog: EC 3.1.4.17 3',5'-cyclic-nucleotide phosphodiesterase
  misc_feature: The sequence is a functional homolog of SEQ ID NO 1104 in the 11/479,226 US patent application
  misc_feature: The sequence is a functional homolog of SEQ ID NO 2404 in the 10/374,780 US patent application
  misc_feature: The sequence is a functional homolog of SEQ ID NO 550 in the 10/225,066 US patent application
MTVDELKLHARASGGHGAKDQFPVGMRVLAVDDDPTCLKILENLLLRCQYHVTTTGQAATALKLLREKNDQFDLVISDVHMPDMDGFKLLELVGLEM

SEQ ID NO: 64896 - DNA, 656 bp, Zea mays
  misc_feature: Ceres CLONE 1535156
  misc_feature: Encodes the peptide sequence at SEQ ID NO. 64897
tccccgcggtggcggccgctctagaactagtggatcccccgggctgcaggaattcgtctcacccctagaaaaaaaaatcactcccaccgtctccacagcaaccagcacacatttccctttggcggatcgaaggaaggaaggaggagatgggtggcggcatggaggtgcacaaaaaccggtggatcgaagagtggaacgccggccgggagaacctcgagttcaacttccgctggacccgccgcagcctcgccgtcgtcggcctcttcggcctcgctgtccccatcctcgtctacaagggcatcgtccgcgaattccatatgcaggacgaggatgcaggtcggccatacaggaagttcctgtaagaggcgtccagggctgcaggatacgtcgattcctcgaccggccctgagaggaggggagtttccattcagtttgtgtcggtattgttttagtctgaatctgatgaagcaatttggaatgctgaattattgtgcctgatccaaatgaataaggtgtaatgactcgtctttcaattactgaaactggacatgtttgaatttatttggtcacttgtatggtaaaaaaagtccttccctccgcctccgcccccgcccactcctggcttccaccactcctgtcacctctttccgcgccga

SEQ ID NO: 64897 - protein, 71 aa, Zea mays; identical to SEQ ID NO: 58870
  misc_feature: Ceres CLONE 1535156

SEQ ID NO: 64898 - DNA, 650 bp, Zea mays
  misc_feature: Ceres CLONE 1535160
  misc_feature: Encodes the peptide sequence at SEQ ID NO. 64899
gcggtggcggccgctcttgaactagtggatcccccgggctgcaggaattcgtctcacccctagaaaaagcttccaccgtcctccgcctccgcctccatccgccccgcgcccagtactcgtctcttgctttctccctctctctctctccgcgcgcgcacccacgcacgcagtttgagagggtgtgcggcgctcgaggggcgaggagcggggcggtccatggcagaggcaggctgttccgcggtgaggaccaggacggcggggctcgccgccgccgccgccgccgcggcggcgctcctcgtgctcgtggttgtcgccggcagcgcggcgctccctggcgcgcgggtgagggtcctcgacggcctccggcacaggagcacggccgtggcggcgggcggcgcgaggcgttggctgcggtactcctcctggccggcggcggcggcggcgacgacgacgacgaggggcagggccgacgacggcgacgccggcgggccatcgagggccgtcaccggcgcggtggaggatccggaggccgtggccaacgacgtgcacgtgtccatcaggaacagcacggcccggcgaaacctcgggtacctgtcgtgcgggacaggcaacccgatcgacgactgctggcgctgcgactcggactggca

SEQ ID NO: 64899 - protein, 144 aa, Zea mays
  misc_feature: Ceres CLONE 1535160
  misc_feature: SWISSPROT Homolog: EC 4.2.2.2 Pectate lyase
MAEAGCSAVRTRTAGLAAAAAAAAALLVLVVVAGSAALPGARVRVLDGLRHRSTAVAAGGARRWLRYSSWPAAAAATTTTRGRADDGDAGGPSRAVTGAVEDPEAVANDVHVSIRNSTARRNLGYLSCGTGNPIDDCWRCDSDW

SEQ ID NO: 64900 - DNA, 817 bp, Zea mays
  misc_feature: Ceres CLONE 1535163
  misc_feature (12)..(12): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (817)..(817): n is a, c, t, g, unknown, or other
ttttttttctgnttttttttttttcccccccnnnnggaatannnnnntatctggattccacgcggtggcggccgctctattctcctgaatcccccgggctgcaggaattcttctcacccctagaaaaaaaacctgtactcgcttcgttttctctgcatgcgtgtataattgtgttcaataataagtgagagcggtgtgatgtgtggctccccttgtcaggctgaaaaaaaaaaaaaaaaacgagacgctcgaggtacccaattcgccctatagtgagtcgtattacgcgcgctcactggccggcgttttacaacgtcgtgactggggaaatccctgtcgttacccaactataatcgccttgaaacacatccccccttttccccacctggcgtaaaaaaaaaaaaagacccttatcttattcccctttccaagggggggggggggcctgtattggccaattcggaaattccccccccctatattttctgctcaaaactcccccgttaaactttttgcttgaacctctacccttttttttttaacttattattctccacatcttgccacaatatcatatatataaatcctcaaataatcacccctcttttcttccctcccactcttttttttttcacttctcaacaacaatattctcaccccataaaagaatctagcgacactcccccaccctctagattgaaagaataataaattttccaataaatgtggcgacatataccctctatatctaatctcaaacttcccaaccaccaaaatacaaatttatttctattctcactcatacaccacactcctn

SEQ ID NO: 64901 - DNA, 664 bp, Zea mays
  misc_feature: Ceres CLONE 1535165
  misc_feature: Encodes the peptide sequence at SEQ ID NO. 64902
  misc_feature (664)..(664): n is a, c, t, g, unknown, or other
ctccccgcggtggcggccgctctagaactagtggatcccccgggctgcaggaattcgtctcacccctagaaaaaatgctggcagtggagtgacagcggcggcaacaccacgcctacgcggcgccggagccgatcccccgatggatctcccgccgctctcccaccagggcctcttcgccgccgtccgatccgccgacgcgcccgccgtccgcgcgctcctggccgacgccgaggcgtcggccacctccttggccgcgctcgccgccgctcagacggacgccggggaaaccgcgctgtacgttggcgcggaggccggcagcgaggaggtcgtgcgcctcctcctccctctctacgacttcgaggcagccaccgtccgctcacgccttgacctcgacgccttccatgtcgccgccaagcagggccacaccggggttgtgaaagagttcttggggcggaggccagagctttgctcagtctgtgactcttccaacactagtcccctctactccgctgctgtcaacgatcacttggatgtggcaaatgctatactggacactgatgatagctgcatcaccattgtgctgaagaatgggaaaacatccctacatactgctgcaagaattggataccatcgtattgtcacagcactcatggagagagatccn

SEQ ID NO: 64902 - protein, 175 aa, Zea mays
  misc_feature: Ceres CLONE 1535165
  misc_feature: SWISSPROT Homolog: EC 2.1.1.43 Histone-lysine N-methyltransferase
MDLPPLSHQGLFAAVRSADAPAVRALLADAEASATSLAALAAAQTDAGETALYVGAEAGSEEVVRLLLPLYDFEAATVRSRLDLDAFHVAAKQGHTGVVKEFLGRRPELCSVCDSSNTSPLYSAAVNDHLDVANAILDTDDSCITIVLKNGKTSLHTAARIGYHRIVTALMERDP

SEQ ID NO: 64903 - DNA, 673 bp, Zea mays
  misc_feature: Ceres CLONE 1535166
  misc_feature: Encodes the peptide sequence at SEQ ID NO. 64904
cgcggtggcggccgctctagaactagtggatcccccgggctgcaggaattcgtctcacccctagaaaaagtcttggtcgtagtactcgcgccatcagcaccaacccacgccacggcacaccccaaccccaacgaacaacgaggtatacaattcatttcccaacagatcaatcatcctctacatgttacagcgactcggcctgccgcgatttttataatgcgccgcggtggccgtcgctagtggtacatatcagcaccgcccctgcctcgaggttgcgtgttttgttctctgtgagcgccgtgggtgttgatggcgtcaacggcgtactcgcggccatccaagccgccagggccggcggccggagacaggagcggaccgcggctggccaaggagctcggcaggatcgagcccaagaagctgggcatcgggctggttgccggctgctgcttcgcgctgctcacctacctctcctttgcccggctgtttgccatctactcgccggttttcggtaaggcctttgaatccgattccctaccaagaattaaattcgtctcttgcgtgtgcggtgagagttccttcaatggacccgggccgcagacagctcgtcgtccatggtgttgaagaacatgccgccagccaacgacgacggtgcccgggtacagctacaggggcg

SEQ ID NO: 64904 - protein, 103 aa, Zea mays
  misc_feature: Ceres CLONE 1535166
MASTAYSRPSKPPGPAAGDRSGPRLAKELGRIEPKKLGIGLVAGCCFALLTYLSFARLFAIYSPVFGKAFESDSLPRIKFVSCVCGESSFNGPGPQTARRPWC

SEQ ID NO: 64905 - DNA, 653 bp, Zea mays
  misc_feature: Ceres CLONE 1535171
  misc_feature: Encodes the peptide sequence at SEQ ID NO. 64906
gggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccccctcgctcatcggcgacgtgtccgccaggctcacgtggaaggacctctgcgtcaccgtggctctgggccccggcaagacgcaaaccgtgctggacgagctcacccgggtacgcggaccccgggtcgctgaccgcgctcagggggccctcggggtccgggaagttccaccttgctcgaagcccttctccgggcgccttcgctcgccaaagcctttctttttccggaaacggtgttccctcaacggccgcaagggccaaatttttcccttctgggcccccggggtacgtggac

SEQ ID NO: 64906 - protein, 160 aa, Zea mays
  misc_feature: Ceres CLONE 1535171
MRRVGGDLQGDGTTPRSAAAGQAMMELQANGSAAVGGAMVVGLSPLSEALWRDSKALPPGAGPPSLIGDVSARLTWKDLCVTVALGPGKTQTVLDELTRVRGPRVADRAQGALGVREVPPCSKPFSGRLRSPKPFFFRKRCSLNGRKGQIFPFWAPGVRG

SEQ ID NO: 64907 - DNA, 653 bp, Zea mays
  misc_feature: Ceres CLONE 1535174
  misc_feature: Encodes the peptide sequence at SEQ ID NO. 64908
  misc_feature (638)..(638): n is a, c, t, g, unknown, or other
  misc_feature (653)..(653): n is a, c, t, g, unknown, or other
tggcggccgctctagaactagtggatcccccgggctgcaggaattcgtctcacccctagaaaaacggccgaaaccaagtttctccgcggccgcccggatccccgacccccggccccgagcgttccatgggctcgccttccgcatcgaggcattagcaagcctcgcgccgcactgccgagcccccgacgcctgcctttgcctcactggttttggaaggaatccaagatgggtgtaatcagcacagtgctgggtttctctggttttggctttgggttctcggctggcattgttattggttacttcctcttcatctacgtccagccaactgatgtcaaggttcgcccgcttgtagaatatgattcaaaatccttggagggcatccttcctgaaattcctttatgggtcaagaatcctgactatgatagaattgattggctgaataggttcttggagttgatgtggccttatcttaacaaggctatctgcagaactgcacaggatatcgcgaagccaattattgctgagaacactgcaaagtataagatagactctgttgagtttgaatcacttactttgggtagcttaccacccacctttcaggggatgaaagtctatgtcacagaggagcaagagctgantatgggaccatctcn

SEQ ID NO: 64908 - protein, 142 aa, Zea mays
  misc_feature: Ceres CLONE 1535174
  misc_feature (138)..(138): Xaa is any aa, unknown, or other
MGVISTVLGFSGFGFGFSAGIVIGYFLFIYVQPTDVKVRPLVEYDSKSLEGILPEIPLWVKNPDYDRIDWLNRFLELMWPYLNKAICRTAQDIAKPIIAENTAKYKIDSVEFESLTLGSLPPTFQGMKVYVTEEQELXMGPS

SEQ ID NO: 64909 - DNA, 616 bp, Zea mays
  misc_feature: Ceres CLONE 1535175
  misc_feature: Encodes the peptide sequence at SEQ ID NO. 64910
  misc_feature (616)..(616): n is a, c, t, g, unknown, or other
tcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagcccatgatagttgttcagcacaaggcggaggagaaacagtttgcagccgaagagatctcctccatggttctcatcaagatgcgtgagatcgcctgaagcttacctgggcagcacgatcaagaatgctgttgtcacggcccctgcctacttcn

SEQ ID NO: 64910 - protein, 135 aa, Zea mays
  misc_feature: Ceres CLONE 1535175
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKAEEKQFAAEEISSMVLIKMREIA

SEQ ID NO: 64911 - DNA, 581 bp, Zea mays
  misc_feature: Ceres CLONE 1535176
  misc_feature: Translation starting site: 101
ccccgcggtggcggccgctctagaactagtggatcccccgggctgcaggaattcgtctcacccctagaaaaagcatccctcccgatcagatccctcgacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaggggcaagccgccgctccctccctcgccgccgggcaccctccccatcgtggggcacctacaccacatcgggccccagacccacatctcgctccaggagctggtggccaagtacgggcacaacgggttcctgttctccgcgccggcgccgtgcccaccctgatcgtgtcgtcgcccagcgacgccgaggccgtgatgcgcacccacgagcacatcttcgacgtccgggccgtggtccattggcctacccacatcccttccgctaacaacacctggcgaactggcctttccctccccgttcggggaaatacgggcccccaaaccaggaacct

SEQ ID NO: 64912 - DNA, 632 bp, Zea mays
  misc_feature: Ceres CLONE 1535177
  misc_feature: Encodes the peptide sequence at SEQ ID NO. 64913
tatttctagtggatcccccgggctgcaggaattcgtctcacccctagaaaaagcatccctcccgatcagatccctcgacaatggcactccacgcagcctacgagtacctgcaacaggccgtcggccatggatcgtggtcatccacacaaacactgacgctgctgctcatcaccgtacccaccgtactactgctgctagcgtccctcgccaagagcacgtcgtcttccggtatgggcaagccgccgctccctccctcgacgccaggcaccctccgcatcgatggggcacctatgctacatcggactccagagccacctctcgctccaggagctggtggacaagtacgggcacaacgggttcctgttcctccgcgccgaggccatgcccatcctgatcatgtcgtcggccagcgccaacgaggccgtgaaacactaccacgagcacttatttgcctcccgggcgcgtgccatggtctactcagtctcccgtaccatcccctgtgactagtccttctttcccgatcgaaaaaatcctggccttcagaccctggaaccttgattaaatccgttcgctgccccaaaaaacaaaaaagggtttacttcccttcccgccccttgggcccccgaatttaa

SEQ ID NO: 64913 - protein, 75 aa, Zea mays
  misc_feature: Ceres CLONE 1535177
MGHLCYIGLQSHLSLQELVDKYGHNGFLFLRAEAMPILIMSSASANEAVKHYHEHLFASRARAMVYSVSRTIPCD

SEQ ID NO: 64914 - DNA, 573 bp, Zea mays
  misc_feature: Ceres CLONE 1535178
  misc_feature: Encodes the peptide sequence at SEQ ID NO. 64915
  misc_feature (224)..(224): n is a, c, t, g, unknown, or other
gcggtggcggccgctctagtactagtggatcccccgggctgcaggaattcgtctcacccctagaaaaaaaaatcaaacccgaggctgcgctgcgcagcagttccacaactaaacccctcgccgccagcgcctccgaatccggcgatgtcgtcgtcgtcgccgcctcgccggccgcagcgccgcgcggcgtcgtcgcggccggcgtcgtacgatgagtccctccntcgacgccgagctgcaggcctacctcggcgacgccggcctcgcgccgcgtgcggcggctgcgccggcttctcggcggaggagcggcaccgggagacggaaacggaggggctcatcgcgcctctccctggggatttccccattgaagaagctgggcccccccgggggaagggggccccttttggggccccccccatttgtggggaaagaggcgccccaaaaaaagataaataatttttgcgggtttggggggaaaaacaccaattttccccccccccccctgggggggggcggacaaaaaccccgggggggggggggcccccccctttttctcccccttttggggggggg

SEQ ID NO: 64915 - protein, 103 aa, Zea mays
  misc_feature: Ceres CLONE 1535178
  misc_feature (27)..(27): Xaa is any aa, unknown, or other
MSSSSPPRRPQRRAASSRPASYDESLXRRRAAGLPRRRRPRAACGGCAGFSAEERHRETETEGLIAPLPGDFPIEEAGPPRGKGAPFGAPPICGERGAPKKDK

SEQ ID NO: 64916 - DNA, 820 bp, Zea mays
  misc_feature: Ceres CLONE 1535180
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (12)..(12): n is a, c, t, g, unknown, or other
  misc_feature (16)..(16): n is a, c, t, g, unknown, or other
  misc_feature (39)..(39): n is a, c, t, g, unknown, or other
nnnnnccccggnggangagggggcgttgtgttattttanaaaaaatgggtgttttatactctagatctccgcggtggcggccgctcttgaactagtggatcccccgggctgcaggaattcgtctcacccctagaaaaaaatcaaaggccagccggggggcgctcgaggtctctcgttggacacccgccgcggccgaacaagatcatgggcttccaggtggccgcggtggcaccgtcgccgtgcgcgcgctcctcctccgcctcaacgtcgccctcaacctcctctcggccgttgcccgccttccttggagggaggtggccgcgggtgcgccgggctcgcgagatccccggtcacccgtatactgggggaaccggtgtgatggtgcggccgccgcctcctgctcggaccccagcgaagtgcgccctgaacgcgaagtttggatggtattgggtgggcgggggacattggagtttacccaccacaaacgaaggaagcttcccggccggaggctgggttttgcatttgcaatcccgcggcgcgccccggtgggggctgcccgtttgggcccccttctaatcgtgtgaagcgcgaacccccaaaatatactccggggactggccccctggtccccttgccaattggatcaaagtctgaaaaaagggcaaccaaacacccttggatgggccggcgggggtcgagcaatcctccggtctggtaactaaggagggctagcttaggccttcccgccccgcccgggggtaacccaaaccggagccccgccactttcccccatacaatagggggcttccactgtgccgca

SEQ ID NO: 64917 - DNA, 657 bp, Zea mays
  misc_feature: Ceres CLONE 1535184
  misc_feature: Encodes the peptide sequence at SEQ ID NO. 64918
tccccgcggtggcggccgctctataactagtggatcccccgggctgcaggaattcgtctcacccctagaaaaaaaaaaaaaaaaagagctcaagcctcaagcaagcagagcgccgtgacatcacgaaacatatagagctagctgctctgcctctgcttcaccaatcacctgcttggccgcgcggaggggaaggtttccccctttgacacagccgagctcccctccatcagcagccagctcctcgtcgcaaagcaagaagatgatgctcgcgtacatggaccgcgcgacggcggccgccgagccagaggacgccggccgcgagcccgccaccacggcgggcgggtgcgcggcggcggcggcgacggatttcggcgggctggcgagcgccatgcccgcggccgtggtccgcccggcgagcgcggacgacgtggccagcgccatccgcgcggcggcgctgacgccgcacctcaccgtggccgcccgcgggaacgggcactcggtggccggccaggccatggccgagggcgggctggtcctcgacatgcgctcgctcgcggcgccgtcccggcgcgcgcagatgcagctcgtcgtgcagtgccccgaccgcggccgccgctgctgcttcgccgacgtccccggcggcgcgctctgggaaga

SEQ ID NO: 64918 - protein, 132 aa, Zea mays
  misc_feature: Ceres CLONE 1535184
  misc_feature: SWISSPROT Homolog: EC 1.5.99.12 Cytokinin dehydrogenase
MMLAYMDRATAAAEPEDAGREPATTAGGCAAAAATDFGGLASAMPAAVVRPASADDVASAIRAAALTPHLTVAARGNGHSVAGQAMAEGGLVLDMRSLAAPSRRAQMQLVVQCPDRGRRCCFADVPGGALWE

SEQ ID NO: 64919 - DNA, 604 bp, Zea mays
  misc_feature: Ceres CLONE 1535186
tccccgcggtggcggccgctctagaactagtggatcccccgggctgcaggaattcgtctcacccctagaaaaaaagcggcactcgctccatcaatgtactcattgtccggatgtgtcctccaataccgcttcctccgcgtcatccctatcgtcgtggcgtcatgatgctacggctgcgggcacctcaggctgcaggctcatggggaatctcccctgtcttcgaacgaccgccaccaccgtcttgtaaacgcggaaagccgggagcctacgagctccacgagagagatactgtgatacagaaacgcagggcatccgccaaccttgtggcaatcagagttcagggcacatacgccagataacaggaggaggagaacaatatagatgaccatctgcatctgccttcttagacaaaaggatgggcctccgatagtagaagccgatggctgatgccaatgcctcatcactcgtttggatcggaagcactccctacctgccaactcctgcctcaaggcttctcctcagggcatggatccctgcgtatagatcttagagtactggtgcctataattttgacaacgaagcctatcccagaggccgtaggggg

SEQ ID NO: 64920 - DNA, 687 bp, Zea mays
  misc_feature: Ceres CLONE 1535192
  misc_feature: Encodes the peptide sequence at SEQ ID NO. 64921
  misc_feature (414)..(414): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (597)..(597): n is a, c, t, g, unknown, or other
  misc_feature (598)..(598): n is a, c, t, g, unknown, or other
  misc_feature (600)..(600): n is a, c, t, g, unknown, or other
  misc_feature (601)..(601): n is a, c, t, g, unknown, or other
  misc_feature (606)..(606): n is a, c, t, g, unknown, or other
  misc_feature (619)..(619): n is a, c, t, g, unknown, or other
  misc_feature (623)..(623): n is a, c, t, g, unknown, or other
  misc_feature (624)..(624): n is a, c, t, g, unknown, or other
  misc_feature (626)..(626): n is a, c, t, g, unknown, or other
  misc_feature (632)..(632): n is a, c, t, g, unknown, or other
  misc_feature (633)..(633): n is a, c, t, g, unknown, or other
  misc_feature (673)..(673): n is a, c, t, g, unknown, or other
tccccgcggtggcggccgctctagaactagtggatcccccgggctgcaggaattcgtctcacccctagaaaaaaatagtcatgtgcgctcgacgcgtcgcgtgcctctctctccgctccctctgacttgttcgcttgccgtcctcgctcgcggcaaagctgcagcgtgtctcggctccggcgcgccaccgctcgggacgcccgacggatccgctcccgcgtgcgctcgatatcccttgcttcaacggtccaagtcaacccccccaccaaatcgccgtccgtccggccgctgccgcaccctagcaggatcgcggcgtgcacagctcttcttcaatctgcaggattgcagccacgcacaagtcgtagctgtttccttggaactttgagctttggaagatgccaaggagaacagganatgctgcttcgaccaaatcagttgaattggtcaaacaagaccaaatggagtttgatcatcctgatgaggtagatgaagaggaagaagttgagtatgaagaaattgaggaggaggttgagtatgaagagtagagtaaggaggaggagggannnnnnnnnnnnnnnnnnnnnnnncnnnnncccnncnnccccncgcccccccggtngccnncnctgcgnncggccggcccgcgccccccccgggggcccgccctccccgncgggccgccgcccc

SEQ ID NO: 64921 - protein, 49 aa, Zea mays
  misc_feature: Ceres CLONE 1535192
  misc_feature (7)..(7): Xaa is any aa, unknown, or other
MPRRTGXAASTKSVELVKQDQMEFDHPDEVDEEEEVEYEEIEEEVEYEE

SEQ ID NO: 64922 - DNA, 653 bp, Zea mays
  misc_feature: Ceres CLONE 1535195
  misc_feature: Encodes the peptide sequence at SEQ ID NO. 64923
ccccgcggtggcggccgctctattactagtggatcccccgggctgcaggaattcgtctcacccctagaaaaacctcgcttccaccgtcctccgcctccgcctccatccgccccgcgcccagtactcgtctcttgctttctccctctctctctctccgcgcgcgcacccacgcacgcagtttgagagggtgtgcggcgctcgaggggcgaggagcggggcggtccatggcagaggcaggctgttccgcggtgaggaccaggacggcggggctcgccgccgccgccgccgccgcggcggcgctcctcgtgctcgtggttgtcgccggcagcgcggcgctccctggcgcgcgggtgagggtcctcgacggcctccggcacaggagcacggccgtggcggcgggcggcgcgaggcgttggctgcggtactcctcctggccagcggcggcggcggctacaacgacgacgaggggcagggccgacgacggcgacgccggcgggccatcgagggccgtcaccggcgcggtggaagatccggaagccgtggccaacgacgtgcacgtgtccatcaggaacagcacggcccggcgaaacctcgggtacctgtcgtgcgggacagcaacccgatcgacgactgctggcgctgcgactacgacg

SEQ ID NO: 64923 - protein, 143 aa, Zea mays
  misc_feature: Ceres CLONE 1535195
  misc_feature: SWISSPROT Homolog: EC 4.2.2.2 Pectate lyase
MAEAGCSAVRTRTAGLAAAAAAAAALLVLVVVAGSAALPGARVRVLDGLRHRSTAVAAGGARRWLRYSSWPAAAAATTTTRGRADDGDAGGPSRAVTGAVEDPEAVANDVHVSIRNSTARRNLGYLSCGTATRSTTAGAATTT

SEQ ID NO: 64924 - DNA, 648 bp, Zea mays
  misc_feature: Ceres CLONE 1535197
  misc_feature: Encodes the peptide sequence at SEQ ID NO. 64925
ggcggccgctctagaactagtggatcccccgggctgcaggaattcgtctcacccctagaaaaaatgtgcagcagctgtaaagacatttttttttcacctcatcttctcccaaggtgttgttggtgccccatgtggaggcaactgccaaagtgtttgggtttcttgaatgttaggcttttttggggaggaggaagggcttgatcaattatgttcagccattcttgccccagtgttcttggattcatggtcgtggaattaatccaagggtagctggagctgctcattttcccttccgagaaaacgaatgcgatcgtttgaacggtagctagctgttgccgttgagccggtgcaatgtcgtcttcctgcatgccgaccggcctgcggctggacctgtacatggtgaatgctgcggcgtcgccgggcgcgcactcgtcgccgctgcgcccggtgcactcgtcgccgtcgtcgacgctgtcggaggcgtccaactcgtcgtcgtcggcgacgtccgtgtcgctgaagcggacgcgcgcgcctcgtaagcggccgaaccatgcgtacaacgaggccgccgcgatgctggcgtccatccactcctccgtcttcgccgtcaagaaagccccaagacggtgccgccgcacccgccgt

SEQ ID NO: 64925 - protein, 99 aa, Zea mays
  misc_feature: Ceres CLONE 1535197
MSSSCMPTGLRLDLYMVNAAASPGAHSSPLRPVHSSPSSTLSEASNSSSSATSVSLKRTRAPRKRPNHAYNEAAAMLASIHSSVFAVKKAPRRCRRTRR

SEQ ID NO: 64926 - DNA, 727 bp, Zea mays
  misc_feature: Ceres CLONE 1535201
  misc_feature (32)..(32): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (493)..(493): n is a, c, t, g, unknown, or other
  misc_feature (727)..(727): n is a, c, t, g, unknown, or other
aacaaccaacggaaaaaaaaaacagagggtcnctgtgnnnttcccnnagaacaaagggagggggttaccgcgggggcggccgctctatagccaatggatcccccgggctgcaggagtccctctcacccctagaaaaagtgttgtccgttcgctgccgccgtcgcctggttcgtatcgcatacagcgcctcagtccagatcgatcctccctcttcccagatcgggtctagttggacggcagcagccgccgccgcggcatctgtcatattcacgccgcgtgtgctctctctttctgtctccctctctatctgcgacgactgggtgtgataccgcagccgccgccctacgctaggttcccgagccttcgccgatctcttctccggcgaagagcgcccaccagatccgccactgagcatcgatgtctcctttggctcttctccaagctctcatctgtcatcctggtgctggcgccccctctgggctttctggatttncttctcggaacttaccccttgaagaaagtgcttggtgaaaatgaaccaattgggcaaccttcgaagggcttttgaaggggctctccttaaacccggccgggtcaaaaggggaggttctcgaaagaaaaaaaaccgcccttttttttgcccctccgacaaaaaaaagctccgggctttctcaaactttttggggcacagggggagaatatgcccttctcggcccgagtagcaaan

SEQ ID NO: 64927 - DNA, 643 bp, Zea mays
  misc_feature: Ceres CLONE 1535202
ggatcccccgggctgcaggaattcgtctcacccctagaaaaactgcgctcaacattcgcctcgtgctctcggccttttggattcgggattcctcctcctccttctcctcctgatcacctcccactcccactcggccagccccgcccaccgccggccccccacgcaacggggagcacaggagcagatcgatccagcctcgcggccgcggcacgcgaccgaccgagctgcttgcctgcctgcgtgcgtgcgtggtgatcacgtcgcgcctggcggtggtggaggtccggcgggcaaccgcggtgccagcagggcgagcaacaacggcggcgcgatgcaagagccgctgctgccgaaggcgcccaagagcggggggtggctctggaaggggacgcgcccgtccgcgtccggcgacctcccgtcgtccaaggccgtgctgcggccgcccccgccacgtgcccgcgctgctctgcacgctcatcgtcgcgctcgggcccgtccagttcggcttcaccagcggggtactcttccccgacgcaggacgcccgcttccgggacctccaacctctccctcctcaaaaatttctcgggcggttcgggtcgctgtccaaacgggggcctcatgtgtcggggggaaacccccaac

SEQ ID NO: 64928 - DNA, 637 bp, Zea mays
  misc_feature: Ceres CLONE 1535203
  misc_feature: Encodes the peptide sequence at SEQ ID NO. 64929
  misc_feature (637)..(637): n is a, c, t, g, unknown, or other
ccgcggtggcggccgctctataactagtggatcccccgggctgcaggaattcgtctcacccctagaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgacccgtcagtgcagagtgacatgaagctatggccgttcaaggtcatcccagggcctggtgacaaacccatgattgtagtcaactacaagggcgaggagaagcagtttgctgctgaggagatctcctccatggtcctcatcaagatgaaggagattgctgaagcctaccttggttccaccatcaagaacgcagtggtgacagtgcn

SEQ ID NO: 64929 - protein, 149 aa, Zea mays
  misc_feature: Ceres CLONE 1535203
MAKSEGPAIGIDLGTTYSCVGVWQHDRVEIIANDQGNRTTPSYVGFTDTERLIGDAAKNQVAMNPTNTVFDAKRLIGRRFSDPSVQSDMKLWPFKVIPGPGDKPMIVVNYKGEEKQFAAEEISSMVLIKMKEIAEAYLGSTIKNAVVTV

SEQ ID NO: 64930 - DNA, 616 bp, Zea mays
  misc_feature: Ceres CLONE 1535209
  misc_feature: Encodes the peptide sequence at SEQ ID NO. 64931
  misc_feature (607)..(607): n is a, c, t, g, unknown, or other
acccgcggtggcggccgctctataactagtggatcccccgggctgcaggaattcgtctcacccctagaaaaagcctagactccttgagccttctcgtctccccccttcgtccgcaccctataacctttgcatcatcttccttgcccgcgccctaacccttgcaccctcctccttgctgccgccggggccgatctccgctgccgccagccatggaggacttctgcgtggtgtgcgcagatacgctggagtgggtggcctacggtccgtgcggtcaccgcgacgtgtgctccacctgcgtcgctcgcctccgttttgtgatggacgataagaagtgctgcatctgcaagaccgtctgccccttcgtcttcgttactaaggccatgggtgaatacactagagtggttgctgatttctcagtgttccccattggggtaaatgagggcaaagctggtgatttctggtaccatgaggatactcaggcatactttgatgatgtggaccactacaggatgatacgggcaatgtgtcgactttcttgtagcgtttgtgacaatgcagaagatcaggttgcccttgctgctcaagcaaagcgcagaagcaagttcangagcatcga

SEQ ID NO: 64931 - protein, 135 aa, Zea mays
  misc_feature: Ceres CLONE 1535209
  misc_feature (133)..(133): Xaa is any aa, unknown, or other
MEDFCVVCADTLEWVAYGPCGHRDVCSTCVARLRFVMDDKKCCICKTVCPFVFVTKAMGEYTRVVADFSVFPIGVNEGKAGDFWYHEDTQAYFDDVDHYRMIRAMCRLSCSVCDNAEDQVALAAQAKRRSKFXSI

SEQ ID NO: 64932 - DNA, 773 bp, Zea mays
  misc_feature: Ceres CLONE 1535209-R
  misc_feature (271)..(271): n is a, c, t, g, unknown, or other
  misc_feature (273)..(273): n is a, c, t, g, unknown, or other
  misc_feature (274)..(274): n is a, c, t, g, unknown, or other
  misc_feature (288)..(288): n is a, c, t, g, unknown, or other
  misc_feature (309)..(309): n is a, c, t, g, unknown, or other
  misc_feature (322)..(322): n is a, c, t, g, unknown, or other
  misc_feature (333)..(333): n is a, c, t, g, unknown, or other
  misc_feature (338)..(338): n is a, c, t, g, unknown, or other
  misc_feature (339)..(339): n is a, c, t, g, unknown, or other
  misc_feature (350)..(350): n is a, c, t, g, unknown, or other
  misc_feature (351)..(351): n is a, c, t, g, unknown, or other
  misc_feature (386)..(386): n is a, c, t, g, unknown, or other
  misc_feature (387)..(387): n is a, c, t, g, unknown, or other
  misc_feature (435)..(435): n is a, c, t, g, unknown, or other
  misc_feature (672)..(672): n is a, c, t, g, unknown, or other
gcgattgggtactcgagcgtctcgtttttttttttttttttattttttttttggacaatactaccaaacatgttcccgttgtaatgcacagaaaatctagtagtatatttgtaccacattaaatgttgaccaccacatcattacgaatttgaaatggatgactatgaaatttgcgcagtctgccggtagcaatgaacagggcattgcctaattgttgatcaggtatatatggacacacctaaatgtagttgcagtgacctcctcactttgntnnccattggctcaaanaacgagtgttctggccaccantttcttccaagcnacctggcgctngtcannaccccgtcccnncacggctatgcagtttggaaaatgacttatttccnngtccattgctcgaaaaagagttttctgccccccccgcatttctttccnaggcaaccttcgcgcctgggcaaacccttgttcttaaggggccttggcaaatttccccttttttttgggggagacttttttcaaggggggggctttttttccccccctttggggggggaaaaccccccttttaaaaaaaacaccacacggggggggggggggggggcctataaaaaaaaagggggttggttttttgtgccccccccccccccccaaaaaaaaaaaaaaaaaaaaaanaccccttcccccttttttggaggggaaaaaaaaaaaaaaaacaaatatggtgtgggtgggggggggggggttttctttttctctcctctttgggggggggg

SEQ ID NO: 64933 - DNA, 649 bp, Zea mays
  misc_feature: Ceres CLONE 1535210
  misc_feature: Encodes the peptide sequence at SEQ ID NO. 64934
ccccgcggtggcggccgctctttcctagtggatcccccgggctgcaggaattcgtctcacccctagaaaaagcatggagccaggcgcgccgtggcgcgatccgcgccagggttactcctacggggtcggatcggcgatgcagctccagctccagctgcagcagcgggccgacgcggcagccggtggaggagtgctcaagaggagcctcggcgagctggagaggtggcagcaccaccagcagcagcaggtggccgcgcaacaggcgctgtacctgcgcgccgtgaggcagcgcacggctgcggcggtcgatatcgccgccttgctgggaggcaccccggctcagcctctggttctacccgggtccagctttggagggggcctagcgtcgccttcgtcgacgctctcgtcgtcgctcaccaccgcgtccagggcggcggtgccgctgatgcagccgcagctgcagcggcaggtgccgctcacgacgtcctcaccgcagacgcagcccttcgggctgtcgacggcgccgctgcctcagccgtcggtttcgagcgagctgttcattttgcaggagctcgagaagcagctggctggacgacgactacaaccacaagcccggtgcgggcataaacgggcaccggttccgccctcc

SEQ ID NO: 64934 - protein, 192 aa, Zea mays
  misc_feature: Ceres CLONE 1535210
MEPGAPWRDPRQGYSYGVGSAMQLQLQLQQRADAAAGGGVLKRSLGELERWQHHQQQQVAAQQALYLRAVRQRTAAAVDIAALLGGTPAQPLVLPGSSFGGGLASPSSTLSSSLTTASRAAVPLMQPQLQRQVPLTTSSPQTQPFGLSTAPLPQPSVSSELFILQELEKQLAGRRLQPQARCGHKRAPVPPS

SEQ ID NO: 64935 - DNA, 677 bp, Zea mays
  misc_feature: Ceres CLONE 1535211
  misc_feature (387)..(387): n is a, c, t, g, unknown, or other
tctccgcggtggcggccgctctataactagtggatcccccgggctgcaggaattcgtctcacccctagaaaaagttgccctccggaaatccaaagctcccggcctcctgcactgcgtccctgtcaggcctgctaagctccagccaaaaaatcgttggcctcggtctggtgcctgctcctcctgccgtcctcgctcctccccacctcccgcggcctcccacgcgacatgattgcattgcgggctgccgcggagctcagctctcctgtcctgccaccaccacgccgctgacgatgccttcctctcgcctgcctctgcctgcgcacaaccgaaacggctagcccgcccttcctcccctcccctttgcttccgcagcgagatttgggcggnctttccttcttccgacaaagttgacacccgtcgtctcgtcgtgggcctggcagatactggtaggtggtctgggtcgtgacttgttcagcccccctctcccggtgccaagccagggtgactgttccaaggagcctggcctggaccctggggaaaaaagggcaaggggtttcggccccttcaaaaaaggcttccgcccccaaatcaagggagaaaaaaaaggaaagggtaagggaggaatccgcagcttacaaccccagccccgggaaaaatcgaaccccttttacctcccg

SEQ ID NO: 64936 - DNA, 660 bp, Zea mays
  misc_feature: Ceres CLONE 1535216
  misc_feature: Encodes the peptide sequence at SEQ ID NO. 64937
gcggtggcggccgctctagaatagtggatcccccgggctgcaggaattcgtctcacccctagaaaaaatgggtcctccgcatctcccatctcacatctcctggctctcctcttccttctcccctgcgatcttctccaccgtatcacctcgctctaaccctagactcaccttcgggcccattgctccttcgggcgccatgtccgccgctcggcttctccgtcactcccgcaagctgcggagattgcctaatgctgtaggatgtgagaatgttggttttgctcggggtttctccactctgtctgggtcctttaacaccagagaaaatggctctgtagagataaccatacgtaccaaatattctgatcatagccagccagaacaactgctcgaaacattctgcgctggagtaaatagaagctgcacttgtagaatagatgcaacacccttacctcagcgctgctagctggcacagtggttcattctcatggggacaggaagctgcatacccggccatttctcaaatagtggcagacctagcctgcaaattcaaggaaattggggaggggcgttctactttcccctttgccatgtgacggggggggaaaaccttggccaaggtgggcttttggaaagggaaggggaaaatagggttttccccct

SEQ ID NO: 64937 - protein, 88 aa, Zea mays
  misc_feature: Ceres CLONE 1535216
MSAARLLRHSRKLRRLPNAVGCENVGFARGFSTLSGSFNTRENGSVEITIRTKYSDHSQPEQLLETFCAGVNRSCTCRIDATPLPQRC

SEQ ID NO: 64938 - DNA, 870 bp, Zea mays
  misc_feature: Ceres CLONE 1535216-R
  misc_feature: SWISSPROT Homolog: EC 2.3.1.12 Dihydrolipoyllysine-residue acetyltransferase
ccgattgggtacctcgagcgtctcgtttttttttttttttttcaagatggggttcctttcttttttgattgccacgaatttgcgggggaggaaaacccaaaattgccccccaataaggcttgttaccgttgatcctacttaacaagggcattttcaaaacggaaaaaacgggctctgggctcttggtttggaaacccccctctttgggggcctggttttttaacatgacaaaaaattgggttaggcctcatccatcctaacttcacagaagcattgaagttgggttcccaatgtttcccttgaatgctttcaaaaattccccaccgattgccccatctataaccctggggccacagctcagggttgctgacttgattgaaccaatttcaaactgaccttcaggggaaccaggtttccccctcttctcagcaaaaccaatggccaaaattgctgactgggggggatttttgatgggccaaaattttttaattccgaagggaccccccaaatttgatacagtgaaggggccgcccccgaaacctgggggtttaaggctattaccccttggttttgagccaactgtttccctccctcagaatttggcccaagtcccttcttggtctgcccccctatttccgggaaaaaacaacccctgtttccgtcttgtacaccccccgtttaagtctcccctgtgggggtttggccgcaaaaaaaaaaatttccccccgtgaagcggttacccctgggaggggcccttttccaaaggggccaaaaaatttccacccctcttgtgtgaacaagaatcctcttataccccgattattttctccttcccccacccaaaagacaatacccttggcagaggggggc

SEQ ID NO: 64939 - DNA, 632 bp, Zea mays
  misc_feature: Ceres CLONE 1535218
  misc_feature: Encodes the peptide sequence at SEQ ID NO. 64940
agtggatcccccgggctgcaggaattcgtctcacccctagaaaaactcccggctcatacttctgctgtagcgtctccggcgccgccgccgcatctaatgcagttccctccgccgcagcccgtaggcctgatggatctccagaacgacattgatctgctcaacccggcggcagaactcgagaagctcaagcacaagaaaaagagactcgtccagtcgcccaactccttcttcatggatgttaagtgccatgggtgcttcagcataaccactgttttcagccactcccacagtgttgttgtgtgccctggctgccaaactgtcctctgccaacccacacgaggaaaggcaaggctcactgagggctgctctttctcaggacagcagactagagcggatgtggacttcaagttttgactctatgccagatactaacgtcatgaactgccctttaactaaaattttccggaagacgttcaccagacactatgtgtgtccagataggcaccttccaaacttatatcgggtttggactggattgtgaacgaactaaaggaccctatgaagttaaaaaaattgacgccgcggccttctgcacctccttaccctcccatggttcccccccggccggatgg

SEQ ID NO: 64940 - protein, 94 aa, Zea mays
  misc_feature: Ceres CLONE 1535218
  misc_feature (30)..(84): Pfam Name: Ribosomal_S27e Pfam Description: Ribosomal protein S27
MDLQNDIDLLNPAAELEKLKHKKKRLVQSPNSFFMDVKCHGCFSITTVFSHSHSVVVCPGCQTVLCQPTRGKARLTEGCSFSGQQTRADVDFKF

SEQ ID NO: 64941 - DNA, 536 bp, Zea mays
  misc_feature: Ceres CLONE 1535221
  misc_feature: Encodes the peptide sequence at SEQ ID NO. 64942
gctctgaactagtggatcccccgggctgcaggaattcgtctcacccctagaaaaaagcgcgatcacgcgcgtcacccgaaagggaatcgggttaagatttcccgagccgggacgtggcggcagacggcgacgttaggaagtccggagacgccggcgggggcctcgggaagagttatcttttctgcttagcggcccgccaaccctggaatcggttcagccggaggtagggtccagcggccggaagagcaccgcacatcgcgcggtgtccggtgcgcccccaggcggcccttgaaaaatccgggacgacccgaattcccgtccgcgccccggttcgttactcattaaccggcatacagggtctcccagggtggaaccggcccctcggggccaatggggacacccttgttaagggctagggggaaattcgggaaaaacggattcccctacttcccgaaaaagggttgggccctcaaggggtggggtttgggggtcccgggccccaaaaccgtttggggttttttgggggaaaattctct

SEQ ID NO: 64942 - protein, 48 aa, Zea mays
  misc_feature: Ceres CLONE 1535221
MGTPLLRARGKFGKNGFPYFPKKGWALKGWGLGVPGPKTVWGFLGENS

SEQ ID NO: 64943 - DNA, 764 bp, Zea mays
  misc_feature: Ceres CLONE 1535225
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
nttttggtgttcnnncctgctccagttgtcgtgtggctgnnntattaaannaaaagggggctcacgcggtggcggccgctcttttcagtggacccccgggctgcaggattcgtctcacccctagaaatgcaactgagcattggtaagctcctgagatcgagatgacagttttgacttaattcgtcctttgggtattacatactttggtgtcccaattccatcatgataaaaataaagctactcatggtagttctactctcaagtcctttttgggggcttaaagggattaaattttgtttactcctaaaaaaaaaaaaaaaaaaacccggcaccccccccagggggtcccccaccattcccccgccttttatatggggggggataaaattttgggagtttcctccatggaggacagtcgtttttaaaacacctcccccccttgggaaaaaacccctggggcgcttaccccccaaaaacaatatctgcccttggtgagaggaaattcctcgcccttttatgtgtgtggccccccagctttttttttttatgaagaaaaagccccccccccgagaaaaggcccccccttcttcttaaactaaaatgcccaacccccccgattatttatgtttgcgagaggaaaaaacaagggtgcggatgtagattatatattttttaattttacaaaaaacatccgctccatatatataatcttgcttgaaaaatcccgcgcctccctttcgtgttgctaccaaacactccggggg

SEQ ID NO: 64944 - DNA, 659 bp, Zea mays
  misc_feature: Ceres CLONE 1535227
gctctagaactagtggatcccccgggctgcaggaattcgtctcacccctagaaaaaagctaatttgctatgctttgcgcacttatgtttttagggctttctagtggaaccggtgcccctgttctgattctaaaattgatgctatgaaagagcctatgaagtataactactaccccctttgttttctgtcgaccgcattccatgatttggttcgaacctttcgatgtcatacttctatatgataatacattcagttgattttaacatctggatatgaatactaccttcagaaaaaaagaaaaaaagacgatacgttcgaggtacccatttcgccctatactcactccacagaccgcggggctggtggatcaacgttttacaacaccaagaactgggaaaaccctggccgttacccactttaatcgcctttgaagaacatcccccctttcgccagcgtgggagaaataccaaaaaacccccccacccaatccccccttccccaacagtttgcccaggccctgaattgggcaaacgcaaaattcctaggcataaacttttttttgtaacaaatcccgatcaaaatttttggaaaaaacccccctccttttttttcacccccaaaatccccaaaatcgcgccccatcccccttgtacccatcc

SEQ ID NO: 64945 - DNA, 614 bp, Zea mays
  misc_feature: Ceres CLONE 1535229
  misc_feature: Pfam Name: Ribosomal_S27e Pfam Description: Ribosomal protein S27
  misc_feature (182)..(182): n is a, c, t, g, unknown, or other
  misc_feature (198)..(198): n is a, c, t, g, unknown, or other
  misc_feature (409)..(409): n is a, c, t, g, unknown, or other
  misc_feature (412)..(412): n is a, c, t, g, unknown, or other
  misc_feature (465)..(465): n is a, c, t, g, unknown, or other
  misc_feature (519)..(519): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
tccccgcggtggcggccgctctagaactagtggatcccccgggctgcaggaattcgtctcacccctagaaaaactgttttcagccactcccagactgttgttgtgtgccctggctgccaaactgtcctctgccaacccacaggaggaaaggcaaggctcactgagggctgctctttccgcangaagggagactagagncgatgtggtctttcagttttgctctatgccagatactagcgtcatgaactgcccttttagctaagatttttccataagttgttctccgagcaacttttgtgtggcatggtttgctacttcccaaactaaaatctgggttgggttggaattgggaagaaactaagggccctttggaattttattttggaaggttgaacaaatttttgggggnaanacccccccctttaaaaaaaaaaaaaaaaaaataataccccaaatttctgaatntttccgggttttcctttcccctattcgcgcccgtctgtttttcacaatagcccnctaacaccaccgcccccagagagttttttnnnaaaaacaaacaaccccccccccctattggagagaataatagtgaccccccccccccccccccc

SEQ ID NO: 64946 - DNA, 528 bp, Zea mays
  misc_feature: Ceres CLONE 1535230
  misc_feature (402)..(402): n is a, c, t, g, unknown, or other
ctccccgcggtgggcggccgctctagaactagtggatcccccgggctgcaggaattcgtctcacccctagaaaaaaattccaaccaacccattccccaattcagtatcaggcctttgcgaattgcgacagcgagagcgggaagaggaaactcgaaactcggcgagcgggatggcaaccggcccgggagcacgtggcggcggcggtcgaggagacgccggagaagaagcggccagcacaaccgagcttccccgcaccctcaagctgggacgaaagaaggttgcctccaactcgagggtgcacgattttgaggtaatttttttgttttccccccaacctggtgaagggaagttttaagaaccaaggaaaaacagcttacccccggtcccctggaaagccccatncccggggggaggcccccgccatccctccaaaaatttccatttggggggaaacccggggttttctcccccaaaaacccttaaaaaaacccttttttgccccaaaaaagtgtccaggggggccccttt

SEQ ID NO: 64947 - DNA, 553 bp, Zea mays
  misc_feature: Ceres CLONE 1535239
  misc_feature (160)..(160): n is a, c, t, g, unknown, or other
  misc_feature (237)..(237): n is a, c, t, g, unknown, or other
  misc_feature (257)..(257): n is a, c, t, g, unknown, or other
tccccgcggtggcggccgctctttcactagtggatcccccgggctgcaggaattcgtctcacccctagaaaaagctacccggagaaggtcaaccccggcagggagggcgtcggccagaacttccgcagcatcggcaagaacgtcaaccccatcgacgtcnaagttcaccggcaaggccaccttcgactaatcacacttcacgtacgccgcacgcccccagccggggatccaaaattnaaagacttcccttcttctanttaattacagtataatggtgattttaccttgcctggggaccggggggggggggggtagattttgaaaagggcaaaaaaacccctgggagaaatttttaaacaaaggtcctccttatattaaaagggagaattggggggggcctgggaaaaaaaaagccccttttgaaaagggcctttaaaaaaaaaaaaaaaaaaagaagagccccggggggccccaatctcccccaaaaggggggggttttatcccccccccccccggggccggcctttttttaacccgcgggggggggggggaa

SEQ ID NO: 64948 - DNA, 651 bp, Zea mays
  misc_feature: Ceres CLONE 1535248
  misc_feature: SWISSPROT Homolog: EC 3.2.1.23 Beta-galactosidase
  misc_feature (58)..(58): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (73)..(73): n is a, c, t, g, unknown, or other
gggcggccgctctagaactagtggatcccccgaggctgcagggaattcgtctcacccnctagannanannaanaaaaaaaaaaaaaaaaaaaaaaaaaaaaaaaaaaaaaaaaaaacctttggttaactatggcgctgacagtctggactagcagtgttatgtgcgctgctggaccttgcgcgcaatgctggggccaatttgttcgttaatgccaaaaattgtgttacagggcgggttaaaaaaaaaaaaaaaaacaagaccctcgaggtccccatttccccctatagggagtcgtattacgcgcgctcacgggccgtcgttttacaacgtcgggacgggaaaaacccgggcgttccccaacttaatcgccttgcagcacatccccctttcgccagtgggcgtaataccaaaaaggcccgcaccgatcgcccttcccaacatttgcccaccctgaagggcaaagggaaattgtaagcgttaatatttggttaaaatccgcgtaaaattttggttaaaccagctcatttttttaaccaataggccgaattcggcaaaaccccttataattcaaaagaatagaccgagatagggtggagtgttgtcccagttgggaacaggagcccacttttaaggaacgtgaactccaacgg

SEQ ID NO: 64949 - DNA, 794 bp, Zea mays
  misc_feature: Ceres CLONE 1535249
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (794)..(794): n is a, c, t, g, unknown, or other
ttgtttttttgnnnnttgtggtgtggtcnnnnnncnagaggataatttgtttgttaaaaacaatacaccacccgcggtggacgctctagtatagtggatggcccgggcagcaggagttcgtctcacccctagaaaaattttttaccagccaccgcatctcccaggctccccgcgcttccttccgtcgccgccgccgcttcgcaatccttgggtaaggtgcacggatcgctggcccgcgtcaggaaggtccgcgggcagactcccaaagtggcaaatcagacaagaagaaagaagccccgcggccgctcatttcaaaagatgcaatagaaccgcagcttcgtcaccgacttcttaagctccagaaaaaaacacgagcctaactcaaatccaaaaagtaagtgcgactccttaaggactcacaatgacctaagacaatagctctcgttcattcccaaggtaagtgatagtacatccagcccaaggtatatagaggtattattatttcggaggtatacagtcctacaattttcggatggaaaagctagaagaattttttcggtacacgccgtctccatttgcccatctaaaaggatctgaattttacacagagaatatgaatgataaacgtagcctaataataacttctctcgccccctcgtttaatcaaagtttacaatactataaaaaataataaaaataaaataagtaagaagcatggaaatcaataatactacggaagacaccctaatatcaacactgtaaaagtaaaagtaaataaaatcaagagaatctgn

SEQ ID NO: 64950 - DNA, 631 bp, Zea mays
  misc_feature: Ceres CLONE 1535257
  misc_feature: Translation starting site: 116
  misc_feature: SWISSPROT Homolog: EC 3.2.1.23 Beta-galactosidase
  misc_feature (631)..(631): n is a, c, t, g, unknown, or other
ggcggccgctctatactagtggatcccccgggctgcaggaattcgtctcacccctagaaaaaatcccccctcctcgacgccggcgccgtctccgcctctgccttctccgatagccatggccgccgcgggacccgggctctactccgagatcgggaagaaggcagagattcgagctgccgcgaccagtaggctattcgattactttgtcatatatgatcatagatactttgtgctatacctatttatctcctattcatgttattcgattacatatacaagcagtgaaagcggttactaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaan

SEQ ID NO: 64951 - DNA, 671 bp, Zea mays
  misc_feature: Ceres CLONE 1535266
  misc_feature: Encodes the peptide sequence at SEQ ID NO. 64952
  misc_feature (671)..(671): n is a, c, t, g, unknown, or other
gcggtggcggccgctctataatagtggatcccccgggctgcaggaattcgtctcacccctagaaaaaaagcatcccttctcccgatcacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaagggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccgccgaggccgtgatgcgcacccacgaccacatcttcgcgtctcggacgtggtccatggcctcccacatcctctgctacaaccactgcgaagtggccttttcgccgctcgggcgaatactggcagcagaccaggaagcttgagaacacgccacctgctttgcaaacaagaaggtctactccttcccgccagggccgcaaggaagaaggggtgccttcgtcgaggaaaaactctccgctaaggccgcccn

SEQ ID NO: 64952 - protein, 157 aa, Zea mays
  misc_feature: Ceres CLONE 1535266
  misc_feature: SWISSPROT Homolog: EC 1.14.13.68 4-hydroxyphenylacetaldehyde oxime monooxygenase
MALQAAYEYLQQAVGHGAWSSTQTLTLLLIAVPTVLLLLASLAKSTSSSGKGKPPLPPSPPGTLPIVGHLHHIGPQTHISLQELVAKYGHNGFLFLRAGAVPTLIVSSPSAAEAVMRTHDHIFASRTWSMASHILCYNHCEVAFSPLGRILAADQEA

SEQ ID NO: 64953 - DNA, 823 bp, Zea mays
  misc_feature: Ceres CLONE 1535268
  misc_feature (286)..(286): n is a, c, t, g, unknown, or other
tctctgtttttttttcccctattctccctcgtttactttcttcgcccccaccacctttacttacccccactgggactccccgcggtggcggccgctctagaactagtggatcccccgggctgcaggaattcgtctcacccctagaaaatttaaagacaccgagtcggagtcggacggaggactggcaggcacaaccgaagccaccgcttctagttctcgggttcatcgccagcaatccagaccacataatgggacagccggtgaccaaggaggagggagaaggacnccgacgccgaacttggactgccccccggggtctcgggtcccccccccaacacaacaacttgtgggaacaataactgtggcccccaaggcggcgggggcaacccccccccctggcccatttttccccagaggggaacctttcccggtcttccccccttgggaaactgcccgaagacccccccctcttttggggcccccggggggggggaattccttttcccccccccggggacccgccggggttccccccccggggtccccccccccaaattaccccctccccgggtggacaaggggtgtttttccgaagagggggccacgggggccccaaaaaaaagacaatatttttattgcgacggggggcacacattccataaaaaaaagaacccccccacacaactcggggtgataaaaaaaagagggctcggccccttgttttttaaccacactttaaaaggaaaccccccatctgcgggtgcgccaacaaaaaataacatggttcttttttttcacaaagataaaagaatgtgtcccccat

SEQ ID NO: 64954 - DNA, 679 bp, Zea mays
  misc_feature: Ceres CLONE 1535272
  misc_feature: Encodes the peptide sequence at SEQ ID NO. 64955
tccccgcggtggcggccgctctagaactagtggatcccccgggctgcaggaattcgtctcacccctagaaaaagtgccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcggggtcacctccgacgacgtgggcctcgacgccgaccgctgcaaggtgcttgtgaacttcgagcaacagtcccccgaatttgcgcagggcgtggccgggcctttccccaaacggccccaaggaaaatgggcggggggaccaggggcccatttgttggggaccccccccaaaaaaaccccccaaggtgaggccgctcccccccagggggtggccccaagggtgggggcccccccctccccggggtgccacaaaaaaccccccgctcccttgtgaaagacccccc

SEQ ID NO: 64955 - protein, 168 aa, Zea mays
  misc_feature: Ceres CLONE 1535272
  misc_feature (4)..(103): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MAAESFLFTSESVNEGHPDKLCDQVSDAVLDACLAQDPDSKVACETCTKTNMVMVFGEITTKATVDYEKIVRDTCREIGVTSDDVGLDADRCKVLVNFEQQSPEFAQGVAGPFPKRPQGKWAGGPGAHLLGTPPKKTPQGEAAPPQGVAPRVGAPPSPGCHKKPPAPL

SEQ ID NO: 64956 - DNA, 615 bp, Zea mays
  misc_feature: Ceres CLONE 1535274
  misc_feature: Encodes the peptide sequence at SEQ ID NO. 64957
gctctatactagtggatcccccgggctgcaggaattcgtctcacccctagaaaacgaagtagcactgggaatgctcagttacaagcttaagttaatttgctgtctttttattttgggattttgtgctgcagagtgcagtgattttgtaccgtgatgtacgtgcaactatttatgatagttcgtgcgggctctgttcaaaaaaaaaaaaccgagaccctcgaggtacccacttcaccctatagtgagtcattttccgcaagctcactggccgtcgtttttcagcgtcctgactgggaaaaccctggcgttaccccacttagtcgccttgaagcacatccccctttcgccgggtggattaatagcgaataggcccgcaccgatcgcccttcccaacagttgcggcaacactgtatggcgaatggaaattgtaagcgttaatattttgttaaaattcgcgccaaattattgttaaatcagctcatttttttgaccaataggccgaaatcggcaaaatcccttatgcttcagaagactagtccgccatagggttgagtgttgttccagtttggaacaagagtcctctattaaagaacgtggactccaacctctaagggc

SEQ ID NO: 64957 - protein, 71 aa, Zea mays
  misc_feature: Ceres CLONE 1535274
  misc_feature: SWISSPROT Homolog: EC 3.2.1.23 Beta-galactosidase
MYVQLFMIVRAGSVQKKKTETLEVPTSPYSESFSASSLAVVFQRPDWENPGVTPLSRLEAHPPFAGWINSE

SEQ ID NO: 64958 - DNA, 651 bp, Zea mays
  misc_feature: Ceres CLONE 1535277
  misc_feature: Encodes the peptide sequence at SEQ ID NO. 64959
  misc_feature (499)..(499): n is a, c, t, g, unknown, or other
  misc_feature (539)..(539): n is a, c, t, g, unknown, or other
  misc_feature (630)..(630): n is a, c, t, g, unknown, or other
tccccgcggtggcggccgctctagaatagtggatcccccgggctgcaggaattcgtctcacccctagaaaaaccctcccaataagcacgtctgtttctccccagctccaagccggacgacgcagcgtagcagcagagagccagagaccagagatggccgccctcgccgccgcctccacggccgccttcgccgcgaagccgcgcgcgcgcctctccttggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcgcccgacagcgcctccgcgctcgccatcaacgccaccatcgagaagactangcgccggtttcgagactacggcaagttcgggctgctgtgncggcgcgaacgcctgccgcacctcatcgtcagcggcgaccaggggcactggggcgagttcgttaccccggggcttgttcttctttaaatcngcgggttggatcgggggggtg

SEQ ID NO: 64959 - protein, 157 aa, Zea mays
  misc_feature: Ceres CLONE 1535277
  misc_feature (42)..(157): Pfam Name: PSI_PsaF Pfam Description: Photosystem I reaction centre subunit III
  misc_feature (116)..(116): Xaa is any aa, unknown, or other
  misc_feature (129)..(129): Xaa is any aa, unknown, or other
MAALAAASTAAFAAKPRARLSLACSAATGDSSSVSLASSVKTFSAALALSSVLLSSAATSPPPAAADIAGLTPCKESKAFAKREKNSIKKLTASLKKYAPDSASALAINATIEKTXRRFRDYGKFGLLXRRERLPHLIVSGDQGHWGEFVTPGLVLL

SEQ ID NO: 64960 - DNA, 679 bp, Zea mays
  misc_feature: Ceres CLONE 1535278
  misc_feature: Encodes the peptide sequence at SEQ ID NO. 64961
  misc_feature (580)..(580): n is a, c, t, g, unknown, or other
aaagctggagctccccgcggtggcggccgctctagaactagtggatcccccgggctgcaggaattcgtctcacccctagaaaaaagcaccaacgagcacctctaagccaaagcaagttgctaggtcctttgaaccagcaactgaagcttcctcgtctcatcatcgagaccagtaagcaacatggcggctaatctcaagtgggctcctgttctagccctcgtcgtcgtcgttgctgccatggttggcaccacgagcgccggcaacatcgcagtgtactggggccagaacggcaacgaaggcagcctggcggacgcctgcaactccgggctctacgcctacgtcaacatcgcgttcctcacaaccttcggcaacggacagaccccagtcctcaacctcgccggacactgcgaccccggctctggcagctgcaccggccagagcagcgacatccagacctgccagtcgctgggcatcaaagtgctcctctccatcggcggcgccagcggcagctacgggctctcctccaccgacgacgccaacagcgtggccgactaccctgtgggacaacttcttgggcggnagcgggtcgtcccgcccgctcgggcccgccgtgctcgacgggttcgacttcaaaatcaagaacggcagtcgggcaataaaatgaaccggcaaacccctc

SEQ ID NO: 64961 - protein, 166 aa, Zea mays
  misc_feature: Ceres CLONE 1535278
  misc_feature (27)..(166): Pfam Name: Glyco_hydro_18 Pfam Description: Glycosyl hydrolases family 18
  misc_feature: SWISSPROT Homolog: EC 3.2.1.14 Chitinase
  misc_feature (134)..(134): Xaa is any aa, unknown, or other
MAANLKWAPVLALVVVVAAMVGTTSAGNIAVYWGQNGNEGSLADACNSGLYAYVNIAFLTTFGNGQTPVLNLAGHCDPGSGSCTGQSSDIQTCQSLGIKVLLSIGGASGSYGLSSTDDANSVADYPVGQLLGRXRVVPPARARRARRVRLQNQERQSGNKMNRQTP

SEQ ID NO: 64962 - DNA, 1164 bp, Zea mays
  misc_feature: Ceres CLONE 1535287
  misc_feature: Encodes the peptide sequence at SEQ ID NO. 64963
agcaaatgcactcgtttcaggcctgacgtccgtctccaactcgactactatactaccgccgcgctctgctcctgcaccagccgggtcagctgaactgagcatcatatcatggagggaggagccgttcccaagccatcggagaagagggtggccctcgtcacgggcgggaaccggggcatggggttcgagatatgccggcagctggcgtccagcggcctcaccgtcgtcctcaccgcgcggagcgagacgcggggcgccgaggcggcccgcgagcttcacggcttcggcctgcctgacgtcgtgtcccaccagctggacgtcacggagcccaccagcgctgctcgtctggctgatttcgtcaggaccaagttcggcaagctcgatgtgttggtcaacaacgcgggaatcatgggggtgacgatggaggttggcgacgacgaggcagccgtcaaagaaatgatggtaggcaaggaccagaacgagattgcagagtggctgaagcagcggaccacgcagagcgccgagcaagcggaggaatgcgtcaggatcaactaccacggcaccaaaaccgtcacggaagcgctcctcccactcgtgcagtcgtcctcctcctcctcctccggcgggaggatcgtcaacgtcacttcatccttcggcctactcaggtttttcagcggcgaggagctccggcaggagctgagcagcgtcgacacgctgaccacgcagcgcctggacgagctgtcggcgctgttcctggaggactacaggagcggccggctggagccccgcggatggccgaccgaccgggtgtacgcggcgtaccaggtgtccaaggcgctcgtctccgcctacgccagggtcctcgccagggacaaccccgcgctgcgggtcaactgcgtgcacccgggctacgtccagacggagatgaaccgcaacaccggggacctcacggccgcggaaggcgccagggtctccgtcgccgtcgctctcgccgaccagggcggcgtcaccggcgcttacttcgatcgcactcaaatagcttcgttcgtgtaatcctcgagtgctacgcacgcgtagagaagaacacgcaccacgtttaccatgtatttctaccgcaaataatagagctctatgcttgatgcttcacaaaaaaaaaaaaaaaaa

SEQ ID NO: 64963 - protein, 314 aa, Zea mays
  misc_feature: Ceres CLONE 1535287
  misc_feature (13)..(198): Pfam Name: adh_short Pfam Description: short chain dehydrogenase
  misc_feature (10)..(100): SWISSPROT Homolog: EC 1.1.1.184 Carbonyl reductase (NADPH)
  misc_feature (235)..(308): SWISSPROT Homolog: EC 1.1.1.102 3-dehydrosphinganine reductase
MEGGAVPKPSEKRVALVTGGNRGMGFEICRQLASSGLTVVLTARSETRGAEAARELHGFGLPDVVSHQLDVTEPTSAARLADFVRTKFGKLDVLVNNAGIMGVTMEVGDDEAAVKEMMVGKDQNEIAEWLKQRTTQSAEQAEECVRINYHGTKTVTEALLPLVQSSSSSSSGGRIVNVTSSFGLLRFFSGEELRQELSSVDTLTTQRLDELSALFLEDYRSGRLEPRGWPTDRVYAAYQVSKALVSAYARVLARDNPALRVNCVHPGYVQTEMNRNTGDLTAAEGARVSVAVALADQGGVTGAYFDRTQIASFV

SEQ ID NO: 64964 - DNA, 812 bp, Zea mays
  misc_feature: Ceres CLONE 1535293
  misc_feature (812)..(812): n is a, c, t, g, unknown, or other
cgacttttaatttccccgtcttcccctcttatatttttctcccccccttcccctatagtggcgctccccgcgttggcggcccgtctaaaaatatggatcccccgggatgcaggagttcgtctcacccctagaaaaaaatcccattcctgatctctcctcccttcttcactgcagcagcatgccagcagcacgccacccgccccactcctgcctccgatccgctgcttactcgccacccggagatggccaccgccgccgccttctccgtctcatcaccggcggcattagaccgtccccatattctcccgtgtgtttggagcaggagttaactacgctagaactataaccggctgccgacatctgcccccccctgaagaactttggtcgtgtcctgatgtgccctgtagaggatgttttccgtctcccccgaactgccactggctttttttcaatacatttttttggcccccccccggatgccttccaaatgacatataataccgacactcaaacctttaatctagggacgccccgtgccccattccgaaaattaaccaccctcctctccttcaccatagtttaactgtgtttatctagaaaaacgcttcaaaaactcctatatgattgatatcaacgcggaaaaaagacaaaaagatttttttatcccctatagaaaaagttttaacacccccttcttcaccaccttgttttcgtccccacattcacttttaacttcgggaaacacggaacacccccacttgattattcattaccatagtggtcaaagaattacaccacaatatttcgtaatn

SEQ ID NO: 64965 - DNA, 717 bp, Zea mays
  misc_feature: Ceres CLONE 1535294
  misc_feature: Translation starting site: 151
caccgcggtggcggccgctctagaactagtggatcccccgggctgcaggaattcgtctcacccctagaaaaacaccagggcacgacgagcgttgcgtcgtgagtgtttgtgtttcagagctgagactgagagagagagagagaggtggtgatggctctgcaggcgcaggggacgcgggtgccgctggtcctggcgctcttcctcctcctggccggttgtggcagcgaggcgcagccgctggtgccggcgctgtttacgttcggtgactcgtcggtggacgtcgggaacaacgactacctccacaccatcatcaaggccaacttcccgccctacggcagggacttcgccaaccacgtcgccaccggggaggttctgcaacgggcagctggcgaccgacatcccccccgacacgctgggggtcactacctatcctggcgcgtacctcagcccacaggcgtcggggcagaacctcctcatcggcgccaatttcgggtcgccggggtctgggtctacgaccccccgggacttatgttttccggaatcccgctttcccagcagcttggagtccttccgggaataccaaaaaaaacttggccgccgggggcccggccccgggcaagggccccttcctttctccaagggggggggctttttaatttgttagggcccgggggcccaggaattttttggtggaaaaattcctaaataaaacacccc

SEQ ID NO: 64966 - DNA, 710 bp, Zea mays
  misc_feature: Ceres CLONE 1535298
  misc_feature (261)..(261): n is a, c, t, g, unknown, or other
  misc_feature (278)..(278): n is a, c, t, g, unknown, or other
ctccccgcggtggcggccgctctagaactagtggatcccccgggctgcaggaattcgtctcacccctagaaaaatcctgcacacactgcaatctccgtccatccctccgtttccttttttcctctgttgccatcagttcagtagtagcctgcagctctcccaccttctcgctgcgctgtactgtgctggtgcaaagaagatccctgttcccgcttttagatcacctttgtgcatgcttttccctgtggtccgtgggcgaangaagccaaaactgcatnatgccccttcgcctctctctctatctattatgctgcctgtatcgcaatcacgagcgagcaaggttggtcctccttcctggaaaacggcaaacttacacggccaacgggtccccttttgggctttttaattttccagggacggggaaggggccctgtaacaaacccctctcaaagccttaaaggaaggggttccccaattttcacaaaccagggcttttttaaaaaaagacccggagcttgtttaaacctcttcaagggggggcgcgggcccccccaaaaaaatgggggtgtttcccggtttccaaaaccccccgtgttggccccccccggggaaacccctggggctccaaaacccggcggaggagcctttttcccctctccaaaaaaatatcctcccctggggttcccccccctcccaaacaaaaacaaaaa

SEQ ID NO: 64967 - DNA, 680 bp, Zea mays
  misc_feature: Ceres CLONE 1535302
  misc_feature: Encodes the peptide sequence at SEQ ID NO. 64968
ccccgcggtggcggccgctctattctagtggatcccccgggctgcaggaattcgtctcacccctagaaaaacccataatcccatcccatttaactgccgccagctcgccgcatgtccttttggatcccatcaaccgtgcgacgccgaccgtgcccaggtttgcctggctataagaccggaggtggatccggactcgcctgcaggggtcgcgtcgcgtctcgcgtgggggaaacgccgccgaaaaccactgggtgcccgctctcgctcggcacgtcctgcgcgcgcccacgcccacgcgactggtcacaagcgctagccagagttcttcacgcgcctcgcgcctgcctgcagccgcaggggaatcgatcgtggcaagggcttgcagtcgcagctactggtaccacaccgatggcggccgccgcgagggtgtctgatgtgaaggccgagggccctcctgcggggcgcctgcacggcgcttgccgccggcggccgccctgctggtggggctcagcacccaaaacgaaaacggtgctgctcttccgggaaaaagccccccgtcaaggacgtccaggccctctggggggcttggcataggcggccggggaaaccgggggttacccccctgttgaaactgcccaaagggcctttaacctcggcccggtttgagaggcccgcccccc

SEQ ID NO: 64968 - protein, 61 aa, Zea mays
  misc_feature: Ceres CLONE 1535302
MAAAARVSDVKAEGPPAGRLHGACRRRPPCWWGSAPKTKTVLLFREKAPRQGRPGPLGGLA

SEQ ID NO: 64969 - DNA, 820 bp, Zea mays
  misc_feature: Ceres CLONE 1535304
  misc_feature: Encodes the peptide sequence at SEQ ID NO. 64970
  misc_feature (482)..(482): n is a, c, t, g, unknown, or other
  misc_feature (484)..(484): n is a, c, t, g, unknown, or other
  misc_feature (820)..(820): n is a, c, t, g, unknown, or other
tgaggtccccacatcgccaaactacttttataaacctccatttatatcaaaaacaggagctccccgcggtggcggccgctctatactagtggatcccccgggctgcaggagattcgtctcacccctagaaaaaggcaaggcaactcagccaagctcgtgagagcagaggaactctctttcctcacactccaaagcagcaagaccatctggcaaagctgcgctagaggccagcatcaggccataataggccagagagcagacgaggcatggcgacgtccgtggcctgcgccttcttcttcttcgacgcggcggagccgctgggcgagggcgggcggcggcggcagcggcaagcgctggacgcctgcgcgctctgctccaagccgctggcccgcaacaaacgacatctttctttacagggggcgacacccccttactgcagcgaaggactggcccctcctaagcaaaccccacccccaaccccncnggaaaaagggatacattgcggggattcagggccatccaaccccgcgggaaatgtaaaacactcggaaacaggggggcggggatcctggtggttctgcccaaaacaaggggcggaaaagatttacctctgggccccctcttagctttcaagaagagaaaaagccaagcgcctaaaacccccggcgtgaggcctcaaaagaattggtgtaaaaggccacatggcccttgcccatttcccctgggttctccaacgttatttaaaaatcccccctcccccgccggaagaggccacccatacctccaatgggtctaacgaggaaaatttccacgcgggtgn

SEQ ID NO: 64970 - protein, 119 aa, Zea mays
  misc_feature: Ceres CLONE 1535304
  misc_feature (73)..(73): Xaa is any aa, unknown, or other
MATSVACAFFFFDAAEPLGEGGRRRQRQALDACALCSKPLARNKRHLSLQGATPPYCSEGLAPPKQTPPPTPXEKGIHCGDSGPSNPAGNVKHSETGGRGSWWFCPKQGAEKIYLWAPS

SEQ ID NO: 64971 - DNA, 870 bp, Zea mays
  misc_feature: Ceres CLONE 1535305
  misc_feature: Encodes the peptide sequence at SEQ ID NO. 64972
  misc_feature (42)..(42): n is a, c, t, g, unknown, or other
cctccctttggcacatccgcgcacccacccccctcttttttnttttcaaccccccctcaaaaccgggagctccaccgcggtgggcgggccgcttctttaactagttggatccccccgggctgcagggatttcgtcctcccccctagaaaaaaaaaaaaaaaaaaaaaaagcccccgttccccttattttctccgcctggcgctttccgcctccccgaagtggcgccgccgttctccatctccacccttccatcctccggggggcccctgcactacggccatcgcactcccctcgctagcccttttcctctgtccccacctttgcccgcgcatcctccgtgcggccgtcgcggtttcttcgctggatctgcgcccgatcaccggcgggttcccgctattcagcatggctgctgcctcctccgccacctccgtccacgatttccccgtcaaggatgctagccgggaaaagatgtgggaccttaagcacctacccccccccaaggtttctggctcataggtcaatgtttgcaatcctcagggttggctttaccccatttccaaccttcccccgaagcttgaacccattttggtttggaaaaagttaccaggggaccccgggggttttttgaaaatccctttggcatttccccaatggcaaacccggtttccggtggggccaaggaacccctgggcgcccttaattgaagggaaaattggtccccagttttgggcttggtacctcccccctcccaagggggtggaagaatacccaaattttttcccacaaagggtttaaaaggtcaaatggggggaaacataaacgtgggcccccactttttccaaggttcccctggaaattcccctcctaaag

SEQ ID NO: 64972 - protein, 171 aa, Zea mays
  misc_feature: Ceres CLONE 1535305
  misc_feature (14)..(14): Xaa is any aa, unknown, or other
PPFGTSAHPPPSFXFSTPPQNRELHRGGRAASLTSWIPPGCRDFVLPPRKKKKKKKSPRSPYFLRLALSASPKWRRRSPSPPFHPPGGPCTTAIALPSLALFLCPHLCPRILRAAVAVSSLDLRPITGGFPLFSMAAASSATSVHDFPVKDASREKMWDLKHLPPPKVSGS

SEQ ID NO: 64973 - DNA, 782 bp, Zea mays
  misc_feature: Ceres CLONE 1535312
  misc_feature: Encodes the peptide sequence at SEQ ID NO. 64974
  misc_feature (21)..(21): n is a, c, t, g, unknown, or other
cggcgatgcctcgtcgccgantccaccgcgtctatcttccgacccccaaatacccaaaactggcactccccgcggtggcggccgctctagaactagtggatcccccgggctgcaggagttcgtctcacccctagaaaaaattaattactttccccccaaaaaaaagccccccaccgcctcgacctcgattcctccgcccccatcgccgtcgtctcctcctccgcctccctgtctgtccgctccgcacctcccctaaaaaacccccccggccattgccgcaccgagctccccttcctcaaatgccccaggcccggacgcctcgacgcccagctccgtgctcgcatggctagcggcgtcctccatcgctccgcctccctatgtctccgcccggccgccggctcctccgccgactccggccggggccaccgcgcggttatgatcggtgattcgaggaagtgcgccgcccccctgcggctgggaggatctagcaggagagagttattaatctggcacaatgggcctccagagatcaatttggccttgaccccgacaacttcttgaatttttaaaatggataccattaaaagaggtaaggccccaagaccatggccccaattccatttgaattttgaaaagcgaagaaatccttgggaacttttttaaaccgcaaaaaaactaatgtgggaaaaaaaattttctccaaatgttaaccacgaaccccccttgggtttggagcaaaggcataatccccccaaaaagagttccactgggtggggggttgg

SEQ ID NO: 64974 - protein, 72 aa, Zea mays
  misc_feature: Ceres CLONE 1535312
MASGVLHRSASLCLRPAAGSSADSGRGHRAVMIGDSRKCAAPLRLGGSSRRELLIWHNGPPEINLALTPTTS

SEQ ID NO: 64975 - DNA, 739 bp, Zea mays
  misc_feature: Ceres CLONE 1535314
  misc_feature: Encodes the peptide sequence at SEQ ID NO. 64976
  misc_feature (45)..(45): n is a, c, t, g, unknown, or other
agtacccgaacacccctaaacccaccgccccaagcgactcttttnccccccctccccccaaactgggagctcccgcggtggcggccgctctagaactagtggatcccccgggctgcaggaattcgtctcacccctagaaaaacagtggccagaggcccagagcttcgtcaaagacacgccgaaaagagggggaggcgactcggccgaggtccggttccgaactccggtcctccgatttgcgcgtccggatctaccagccatggcatcatcttcggacccatggatgaaggagtacaatgaagcatccagacttgctgatgacatcacttccatgattgctgatagagggtcccttccacaatcaggcccagaaattatgcggcatacttcagccatccggagaaaaataactattcttgggactagactggatagcttggagtccttgcttggcagaattcctcccccccccggtggctgacatgagatgcctaagcgcccagacctgttttccagtttgaagtcttaagcaaaccagatggcgacaagtttccaccctgtcaaactttgctaaccggggaggatctggcttggtcccgaataaaaaaggcacatgaccctgagccacaatttgccgggggttagataaaccaaagggaaattgttgttccctttcggaagggcaaaatttttcataagaaccacagattgaggggccctttgaaaaaacctggcaaaa

SEQ ID NO: 64976 - protein, 73 aa, Zea mays
  misc_feature: Ceres CLONE 1535314
MASSSDPWMKEYNEASRLADDITSMIADRGSLPQSGPEIMRHTSAIRRKITILGTRLDSLESLLGRIPPPPGG

SEQ ID NO: 64977 - DNA, 895 bp, Zea mays
  misc_feature: Ceres CLONE 1535317
  misc_feature: Encodes the peptide sequence at SEQ ID NO. 64978
  misc_feature (38)..(38): n is a, c, t, g, unknown, or other
  misc_feature (47)..(47): n is a, c, t, g, unknown, or other
  misc_feature (48)..(48): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
aacgacccggaacaggcactcaccaactccatttcttntttttcaannaaannnnnncccccgctcaccacggaggcggccgctctattactagtggatcccccgggctgcaggaattcgtctcacccctagaaaattctgttacgaatatgatattttttggacatttctaataatagcaagccttattcctattttggtattttggatttcaggacttttagccccggttagtgaaggaccagacaagctttctagttatgaatcccgtatagaacccatggggggggcttggttacaattccgaatacacatatacatgttttgcgctaggttcttgctggcttttgatgtgggaaaccaatctttctcctacccctcgggcgaatgacttcccgaccgtattggggccgtatcaaggtttttagccggcggcattattgtaacacggacgcccaaacccccaaatggcttgggtttatatttaaaaccggcgccccccccccggcaagtcctttgcgaactaggtcctcttcaggtggacctcccttccgtcagagaaataaagaacaccaccgaacgcgatgacgcgattttctattttcgcaagtcgaaatttcttgagagtctctcaaactggcccgttttccccgttcgtcgccgcccgcccaaaaacggaccatccccgttacttcgttttttgttccctgaaccgccgcaagcactcgcgatttccactccacttacacgcgccataaacgcatacatcccaatattaggggaacccccggccccggatagcccccccccgccgcccccacctttcactcccccaccccgccccccttttttaccctacccccccgaaacttcccccatcttgcccacccccccc

SEQ ID NO: 64978 - protein, 36 aa, Zea mays
  misc_feature: Ceres CLONE 1535317
MGGAWLQFRIHIYMFCARFLLAFDVGNQSFSYPSGE

SEQ ID NO: 64979 - DNA, 843 bp, Zea mays
  misc_feature: Ceres CLONE 1535318
  misc_feature: Encodes the peptide sequence at SEQ ID NO. 64980
ggccccggcccaaccccgcccccaaccccccccacacaaccaaccacaacacacaactccccccggtggcggccgctctatactagtggatccccgggctgcaggaattcgtctcacccctagaaaaacaaacgcgtcgcatccgctccacaggatcctctgcgccaccgcaaccgtgtgaccgcccgtgccgccggcgatcccgatccgccgacccgtccagccccgctcgcagacatgtcgccgtcggagccgacgcgggaggagagcgtgtacatggccaagcttgcggagcatgcggagcggtacgaggagatggtcgagttcatggagcgcgtcgcgcgctaccccgggggccgcccggcggcggggagaagatctccggtggaggagcccaaccttgctgtccgtggtcctcccacaacgtcaaccggtcccccgccagggccttcgtgtttttcttacccccccctccttccgaccataaaggaggtaaggccggcgtggaaccgaaggcggcccccccccttttcacataccgcccccctttcggcttcccaagaataagaaggcggcaaatctttggcctccgatttctggcccaacagaccttcccccgggggcgtccatttgaacttcccaatccttcgggccccattcctcgcgggttggcacccccaaatttcccagggtcttctcccccctccccggattcaaggtggtggccctcccccaaagggaaccctttgcctcaactttaaacatctcaggcgtgaaatataggaaatttatgccttgttgcacagcctccacttgaaaaggccctttacaaactttgtcctc

SEQ ID NO: 64980 - protein, 109 aa, Zea mays
  misc_feature: Ceres CLONE 1535318
MSPSEPTREESVYMAKLAEHAERYEEMVEFMERVARYPGGRPAAGRRSPVEEPNLAVRGPPTTSTGPPPGPSCFSYPPLLPTIKEVRPAWNRRRPPPFSHTAPLSASQE

SEQ ID NO: 64981 - DNA, 676 bp, Zea mays
  misc_feature: Ceres CLONE 1535321
  misc_feature: Encodes the peptide sequence at SEQ ID NO. 64982
  misc_feature (483)..(483): n is a, c, t, g, unknown, or other
  misc_feature (516)..(516): n is a, c, t, g, unknown, or other
gcggtggcggccgctctataactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctggaacaccgccgggctgtccgcggacccggaggcgttcgcgcgaaacagggcgctgggagtgatccacgggcggtgggcgatgcntggtgcgctgggctgcatcaccccggaagtgcntgaaaaatgggtgcgcgtggacttcaaggagcccgtgtggtttcaagcccgcgcgcagatcttctcggaggggcggctggactacctgggcaacccccaccctgtgcacgcgcaaagcatcttggccgtgctcgggtttcagggcaccctcatgggcctt

SEQ ID NO: 64982 - protein, 176 aa, Zea mays
  misc_feature: Ceres CLONE 1535321
  misc_feature (69)..(176): Pfam Name: Chloroa_b-bind Pfam Description: Chlorophyll A-B binding protein
  misc_feature (112)..(112): Xaa is any aa, unknown, or other
  misc_feature (123)..(123): Xaa is any aa, unknown, or other
MASTIMAATSRIVAAKTPFLGQGRAAAAAANASPLRDVAAAAAGGRITMGNDLWYGPDRVKYLGPFSAQTPSYLTGEFPGDYGWNTAGLSADPEAFARNRALGVIHGRWAMXGALGCITPEVXEKWVRVDFKEPVWFQARAQIFSEGRLDYLGNPHPVHAQSILAVLGFQGTLMGL

SEQ ID NO: 64983 - DNA, 622 bp, Zea mays
  misc_feature: Ceres CLONE 1535324
ccccgcggtggcggccgctctagaactagtggatcccccgggctgcaggaattcgtctcacccctagaaaaaaagccaggccactctaccaccgcacgctcaactcaaacccccgtcccgaacgcagaagaccggcggcagcggcggggtgtgtgtggactgaactgaaaccaattgccatcaatccaggcatccatccatccacccgcacccgccccgctgacggaggcaatggcccggctcgtgctctccgagtgctgcggcctcgcgccgctccgacgcctgcgcgccggccggagcgccattgcggcgccgtcaccccccgcgctctccgcggcgccgcgccgtcatcccgcagtcgcgtccatccaccgcgactgggcgctacgcgtctccgcgcccatccgcctcgcctctgcagccgtcgaagatgacaagccgagcgccgcgccggggcaggtacgaggactcgtccgctgtcggggagtccaaccgggggcgcgcgcccgacgtctggctgggcgtagatccacgcctacatccccaagcactgctgggtcaaagtacccctgacgctccatgagctacgagctgcgcgacgtcaaccatcgtcgtgggcctc

SEQ ID NO: 64984 - DNA, 600 bp, Zea mays
  misc_feature: Ceres CLONE 1535329
  misc_feature: SWISSPROT Homolog: EC 3.2.1.23 Beta-galactosidase
  misc_feature (598)..(598): n is a, c, t, g, unknown, or other
  misc_feature (600)..(600): n is a, c, t, g, unknown, or other
ggcggccgctctagaactagtggatcccccgggctgcaggaattcgtctcacccctagaaaaagatgcgatgccgggaaccaccggtcgtgcgtcctctctcctcgtgcgcttcgcccgtctccacagttggtgcaggttcaaacatggacctctgcgcatcaaagaaaagccggacaccagatcttccaagaactaaagattttctcagattatcagcagcgttttaggttgtagaatcctctctgtgtaattatatataactgctcaactcttctgaaaacattttatgtaaatataacaaggtagcttcaaatattgcaacaaacatattaaaaaaaaaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgtaaaantn

SEQ ID NO: 64985 - DNA, 645 bp, Zea mays
  misc_feature: Ceres CLONE 1535342
  misc_feature: Encodes the peptide sequence at SEQ ID NO. 64986
ctggagctccccgcggtggcggccgctctagaactagtggatcccccgggctgcaggaattcgtctcacccctagaaaaagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgtcagctatggaaacgttggccatgcttctcaagtaatgaaataattccgttgtcacctcatgctacatacagcagattggtgttacgagttaaatcctgtgaaactttagcattctgtaaccgtggatgtcgagtttatggagttccttgtgtggcgcctcaagtcaagttctcgtcaaagattgtaatctgatggcttccattgtgacttgtaggcggctgcaataaacttacttgatgcaattattgcagtcgaatcctgtgaacctgtgatgttccagtggaaacggtagatggctcgatcgtaaaaaaaaaaaaaaaacgagacgctcgaggtacccaattcgccctatagtgagtcgtattacgcgcgctcactggccgtcgttttaccacctcgtgactggaaaaacc

SEQ ID NO: 64986 - protein, 72 aa, Zea mays
  misc_feature: Ceres CLONE 1535342
  misc_feature (5)..(69): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
GAPRGGGRSRTSGSPGLQEFVSPLEKVMTMQVGEVARIQCTPDYAYGAGGFPAWGIQPNSVLVFEIEVLSAQ

SEQ ID NO: 64987 - DNA, 634 bp, Zea mays
  misc_feature: Ceres CLONE 1535343
gctggagctccccgcggtggcggccgctctagaactagtggatcccccgggctgcaggaattcgtctcacccctagaaaaatttgttgagcttcgcctagtgtatgggatggcccactggttcaaatccggctcagtgcctgatctaccaaaatgggacactaacgaaagctaccccgatcaattgtgatgatgtgtatttgtgggtgtgttctggaacgacactccacatgagacgtctgcgaagtaccgcaattcaccctatatagactcgtatcacactcgctcactgaccgacttgtacccacttcctgactgataaaacccaggcgtaccccaaattaaacaccatgcaacacatcgcccatatcgacagctggcctaatatcgaaaaggccctgcaccgatcgcccttcccaacagtagctcagcctgtctggcgaatggaaattgtgagcctttatatgttgttaaaattcgcgttaaatttttgttaaatcacgctcatttttttaaccaataggccgaaatcggcaaaatcccttataaatcaaaacaatacaccgacatagggttgagtgttgttccagtttggaacaagagtccactattaaagaacgtggactccaacgtca

SEQ ID NO: 64988 - DNA, 626 bp, Zea mays
  misc_feature: Ceres CLONE 1535347
  misc_feature: Encodes the peptide sequence at SEQ ID NO. 64989
  misc_feature (582)..(582): n is a, c, t, g, unknown, or other
caccgcggtggcggccgctctagaactagtggatcccccgggctgcaggaattcgtctcacccctagaaaaagcggacgcaacgcaacaccgcccactctctgtcactgacgatcgaagtgaggagcgcactgaagccagccgccgatgagtcgcctcctctcgcggcagcaccttgccgccgtccgtcgatctgcaccctttgcgtgcgtgtccaggtggctgcacacgccgtcattcgcgacggtttctccgcaagaggtttcaggttccagcccagcggaagtgcagaattttgtgcagggcaactggacagcttctgctaactggaactggatagtcgatcccctgaacggcgacccactctgggggggggtggaggttcagggaacaaaaataaaacccttcctgggagagtttatctaaatgccccaaagcatgggacttcgccaccccactttaagctcccgaaaaggttcctcaatgtttgagaaaatttcctgccaaaacttgccccatttcctggggcccacccggcgggccttaaaatttcctttgcccaaaccttacccccagagggttnttccccaaaaaactaccaaaaaagctttttgggaaagattcccg

SEQ ID NO: 64989 - protein, 92 aa, Zea mays
  misc_feature: Ceres CLONE 1535347
  misc_feature: SWISSPROT Homolog: EC 1.5.1.12 1-pyrroline-5-carboxylate dehydrogenase
MSRLLSRQHLAAVRRSAPFACVSRWLHTPSFATVSPQEVSGSSPAEVQNFVQGNWTASANWNWIVDPLNGDPLWGGVEVQGTKIKPFLGEFI

SEQ ID NO: 64990 - DNA, 833 bp, Zea mays
  misc_feature: Ceres CLONE 1535349
  misc_feature: Encodes the peptide sequence at SEQ ID NO. 64991
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (833)..(833): n is a, c, t, g, unknown, or other
nnnggggnngggggggggcaaatcgtcctntnnnnttataaannnnnnatatattaatctcacccggtggcgggcgctcttttctagtggatcccccgggctgcaggaattcctctcacccctagaaaaaaggttgtgatgaatcatgttgttgttgaagatggttgccacatccaaggttctgttgtatgtaataatgttcaactgcaagaacgggcagttctgaaagattgccaggttggagctggttatattgtgactgctggcagcgagcacaaagcagaatccctagcaagaaagtacagtgagctttgactgttttgttagatcctgaatgtctcttgggttcacctggagatgcatccctcttataaaaaagggtagcaattgttgtccaaatttataatattttttttccccccccggcggggggggggggggggggaaatcttttttttatctttttctgcccccagggatcctatttctctcttataagtagagtttatatttattcgccggctgctcttggctcccctttttttttccaactcttttgctacttgtttaaataacttttggtttttttcttcatttttttatttcccgtatgtcatctcatctttccctctttttttcccggcctgttgtccacttatctcccatattgtccttgatactgttaccccttcttctacccctctctgatatcctattccttcatttctccatattctccactcctctttcactccttttatctttcctcctcgacgtcgtgttcggcggcatatatattctttctaataattacccatccctctcttcctctn

SEQ ID NO: 64991 - protein, 58 aa, Zea mays
  misc_feature: Ceres CLONE 1535349
MNHVVVEDGCHIQGSVVCNNVQLQERAVLKDCQVGAGYIVTAGSEHKAESLARKYSEL

SEQ ID NO: 64992 - DNA, 675 bp, Zea mays
  misc_feature: Ceres CLONE 1535353
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaatcagtccagcaggctccgcatccggctccgtaaaacgcacggcctgtacctgcactccccatttccacgctttctctctcctctccgcagctctctgcgtgcgcgcgcggctgctcgcgggccccaggtgtcatagactgcatgcggagtgggatgtggagtgttgctggaaacggagacggatacggagaggagagagaaactgttggccgcgcgttttagggatacggagagggagtctgctggagttggtcttagagcccggagagctggagaagctagctagcgtgcttacagaataacagcagccaagcaaagccaagggtgtgtatataatagacatgccttgggttgtgtcagctgcgactgtatgtatagtttaaacgaagatgaaatggtactgatggtgatattccgtgtttaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaata

SEQ ID NO: 64993 - DNA, 690 bp, Zea mays
  misc_feature: Ceres CLONE 1535354
  misc_feature: Encodes the peptide sequence at SEQ ID NO. 64994
ggagctccccgcggtggcggccgctctagaactagtggatcccccgggctgcaggaattcgtctcacccctagaaaaacccttgctcgtgacttcgtcgtcgctagagcctttactggattcgtgtcctcaccagctcgctcccaacttgatctcgtcgtcgttccgtacgtcatcaagaaatctcaagagttgagtgaagatgaagctaacaacctgaaattcaccaagtactcgacgaaaagtctgaactataaatcatcgtggttcttgcagagttcgcgtcgaatttaatcattgagggtgatgaagaagactttgatggagatttccacgatgaattctaagtctaacgatgcgtccgtcatcttcctggtgggagaatacccatatttaactctgccttactttgatggtgatacctggtaaagataccataattccaatgatgtaataaagtactctactctctttaaaaaaaaaaaaaaaaaaccaaaaaagaaaaaaaaaaaaaaaaacgagacgctcgaggtacccaattcgccctatagtgagtcgtattacgcgcgctcactggccgtcgttttacaacgtcctgactgggaaaaccctggcgttacccaacttatcgccttggagcacatccccctttcgccagctggcgtaatagccaagaggcccgcaccgatcc

SEQ ID NO: 64994 - protein, 40 aa, Zea mays
  misc_feature: Ceres CLONE 1535354
MKKTLMEISTMNSKSNDASVIFLVGEYPYLTLPYFDGDTW

SEQ ID NO: 64995 - DNA, 646 bp, Zea mays
  misc_feature: Ceres CLONE 1535358
  misc_feature (560)..(560): n is a, c, t, g, unknown, or other
gcggtggcggccgctctagaactagtggatcccccgggctgcaggaattcgtctcacccctagaaaaaattcccgttgccgttcgactccctctgctcttcctcggaaacggattccgccgtcccgtctagcaatagcaaacctctctctcttcagccttttgattcccacctctccattcccagcggctataaatccccgcgtcgccgctgcgccaacccccctccctctccttcctcacatcttccttcgtcagccgcagatgcgccagcatctctcccacgggcagcaggaggaggagcgagaggcacagtgacagacagagagagagcgcgcgcggggggagcccagcacagcacctacactagctagccaccaccaccaccaccaccgaccgaatcgggtgcgcgcggcgcgctgctcgtcagctccggccggccgcccggccgctttataaagccacccacccagccccgcccgatcgccatcgccatacccccgcctccgtccacggacacacacccgccttgccatgcggcaccctcccggcctcccccacntgtgtactccggcctcgccgccgcaaaacccgccgcgcaggccggttgctccgattgggagtgccaatcggagccaacagcgaggc

SEQ ID NO: 64996 - DNA, 637 bp, Zea mays
  misc_feature: Ceres CLONE 1535361
  misc_feature: Encodes the peptide sequence at SEQ ID NO. 64997
ccgcggtggcggccgctctagaactagtggatcccccgggctgcaggaattcgtctcacccctagaaaaattcaagaccaaggaggagacggaggagaagcgcgggcagttcacgctcgtcgtcggcggcctgctcgtcatcgccgtcgtcgtgcccatggcgcagtactacgcctacgtgtccaagaagtgagcgaaccatgaatggcgtgctagctgtgtacagtaatgttataccgaagagggttttttttaatctcccaggttgaagttcttcgatctgttggaattcttaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaataac

SEQ ID NO: 64997 - protein, 63 aa, Zea mays
  misc_feature: Ceres CLONE 1535361
RGGGRSRTSGSPGLQEFVSPLEKFKTKEETEEKRGQFTLVVGGLLVIAVVVPMAQYYAYVSKK

SEQ ID NO: 64998 - DNA, 630 bp, Zea mays
  misc_feature: Ceres CLONE 1535365
ggagctccccgcggtggcggccgctctagaactagtggatcccccgggctgcaggaattcgtctcacccctagaataattccatacaaccgcgcactccatacgcgcacgcgctgttcgttcctcggccgctctatccacacacgtccttctccgcctcaacaaatctgaccctgccgtgcggttccttaattccccttctccgggactgtcagatctccgcggcagctggagatgagcaactgctgcctgacgcccaaagcagccgacgacgccggcggcggcaagatacccaaagagcctaagcagatcataggtaagaagccgaaccccctctccatcgattacaaccgctcagggcacgcgagcgcgccaaacctgctggtgctgccgcacccacggcgcgggacatcgcggcccggctcgtactctgcacatgactcaggcgcagccagttctcagctacctacctccgcacagaccgcgcctcatgggaagcgctggcctgcacgtctctccccgagtaaaagtccgcaccgccttccacctcatagacgtcgcccggtaggggggaaatccttgcgactctccacaaagcaccccaccgtcctctcgctccaaggacacgaac

SEQ ID NO: 64999 - DNA, 651 bp, Zea mays
  misc_feature: Ceres CLONE 1535375
  misc_feature: SWISSPROT Homolog: EC 3.2.1.23 Beta-galactosidase
ccccgcggtggcggccgctctagaactagtggatcccccgggctgcaggaattcgtctcacccctagaaaaaccctagaaaaacaattaatgggttgtaggctgctgttgatgcggctgcttcgttcgtgttgccccgtctgattatgtactgtaacccttggctgtcaacgtactgtgctaaaaaccactggttctgtgtggattcatgctgccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttccaacagttgcgcagcctgaatggcgaatggaaattgtaagcgttaatattttgttaaaaattcgcgttaaattttttgttaaatcagctcattttttttaacccaataggccgaaatcgggcaaaatcccttataaatccaaaagaataaacccgaaataggggttaaagtgttggttcaagtttgggaccaagaaattccactatttaaaaaccgtgggactcccacccctcaaaggg

SEQ ID NO: 65000 - DNA, 647 bp, Zea mays
  misc_feature: Ceres CLONE 1535377
  misc_feature: Translation starting site: 358
  misc_feature: SWISSPROT Homolog: EC 3.2.1.23 Beta-galactosidase
gctggagctccccgcggtggcggccgctctagaactagtggatcccccgggctgcaggaattcgtctcacccctagaaaaatttttccctatggtgccatcataggacttgcttagcgatttaaaactcgattatgtgccacctaaaatgggcagatggaacaatgaaatcatactgtgccctttatccgttgctattgttcaaaaaaaaaaaaaatattaataggtgtttcctaaaaaaaaaaaaaaaaacgagaacgctgtaaaaaaaaaaaaaaaaacgagaccctcgaggaacccaattccccctatagtgagtcttattacccgcgctcactggccgtcgttttacaacctcatgactggaaaaaccctggcgttacccaatttaatcgctttgcaaaaaatccccctttcgccagctggcgtaataccaaaaaggcccgcaccgataacccttcccaaaaattgcacaccctaaatggcgaatgaaaattgtaagcgttaatattttgttaaaatccgcgttaaatttttgttaaatcagcccatttttttacccaataggccgaaatcggcaaaatcccttataaatcaaaagaataaccgagaaagggtttgacgtgttgttccaatttgagacaacaa

SEQ ID NO: 65001 - DNA, 647 bp, Zea mays
  misc_feature: Ceres CLONE 1535378
  misc_feature: Encodes the peptide sequence at SEQ ID NO. 65002
  misc_feature (532)..(532): n is a, c, t, g, unknown, or other
ccccgcggtggcggccgctctagaactagtggatcccccgggctgcaggaattcgtctcacccctagaaaaaaactagcaagcgccgcatccctcgcctcttcccgacttcccccctcgattcgatccgagcttacttctagggttcttggccccgctccaccgtcgcccatggcagacgatgccaaccgagcggccttcatggagctgcagtcccggatgatagataccaccgcgaagatcaagcagttacaaacccaaatgcgttctaaagaaggggaaaagaagcgtgcctaccttactttggaggaacttcgccagttgccagatgataccaacacctacaagactgtcggaaaagtgtttattctggagccgaaatcagttctgttcaatgagcaggagcaaaagcttaatgacagtgagagtgcgatagcttcaatgcagacatccaaagactaccttgagaaacagcagggcgaagtggagaacaatattcagggagctgcttcaacaggacccaggaacttgcngcgtcagatcctctcaatgaccgttcaaatgagagttgtttttctctcccatttatttttcttagataatttgtaaatgtcgcagtttgatcaagtcatggctgtaggtcttgcc

SEQ ID NO: 65002 - protein, 145 aa, Zea mays
  misc_feature: Ceres CLONE 1535378
  misc_feature (11)..(116): Pfam Name: Prefoldin_2 Pfam Description: Prefoldin subunit
  misc_feature (121)..(121): Xaa is any aa, unknown, or other
MADDANRAAFMELQSRMIDTTAKIKQLQTQMRSKEGEKKRAYLTLEELRQLPDDTNTYKTVGKVFILEPKSVLFNEQEQKLNDSESAIASMQTSKDYLEKQQGEVENNIQGAASTGPRNLXRQILSMTVQMRVVFLSHLFFLDNL

SEQ ID NO: 65003 - DNA, 638 bp, Zea mays
  misc_feature: Ceres CLONE 1535382
  misc_feature: Encodes the peptide sequence at SEQ ID NO. 65004
ggagctccccgcggtggcggccgctctagaactagtggatcccccgggctgcaggaattcgtctcacccctagaaaaaactcttaagagtcaaaactcaacagcagcaggggcgaccgagctctgcgtgcgcggggagagctcggagaaggcagcatcatgggcgccgggatcatggtcctatcggcgctcttggcggcgctcgcggcagccaccgccggcgtgacggcgcagctgccgcaggactactacgcggcggtgtgcccggacctggagagcatcgtgcgcgccgcggtgtccaagaaggtgcaggcgcaacccgtcgccgtgggcgccaccatccgcctcttcttccacgactgcttcatcgagggctgcgacgcgtctgtgatcctggtgtcctcggggaacaactcggcggagaaggaccacccgagcaacctctccctggccggcgacggcttcgacaccgtcatccaggccaaggcggccgtggacgccgtgccggcgtgcgccaaccaggtgtcgtgcgccgacatcctggcgctggccactcgggacgtcattgagctggctggcggaccgtcctactcggtggagctggtgaggctggactggctggtgtccatgtccaccaac

SEQ ID NO: 65004 - protein, 160 aa, Zea mays
  misc_feature: Ceres CLONE 1535382
  misc_feature (42)..(160): Pfam Name: peroxidase Pfam Description: Peroxidase
  misc_feature: SWISSPROT Homolog: EC 1.11.1.7 Peroxidase
MGAGIMVLSALLAALAAATAGVTAQLPQDYYAAVCPDLESIVRAAVSKKVQAQPVAVGATIRLFFHDCFIEGCDASVILVSSGNNSAEKDHPSNLSLAGDGFDTVIQAKAAVDAVPACANQVSCADILALATRDVIELAGGPSYSVELVRLDWLVSMSTN

SEQ ID NO: 65005 - DNA, 670 bp, Zea mays
  misc_feature: Ceres CLONE 1535388
  misc_feature: Encodes the peptide sequence at SEQ ID NO. 65006
ggagctccccgcggtggcggccgctctagaactagtggatcccccgggctgcaggaattcgtctcacccctagaaaaaaaaaagctccccattcctcttccccttctcacccggcactcgaactctgcggacctgcaaaccctagctttcgctccatggccgacggcgatcgcggagccggcgccagcacctgcaccggcactggctaacgagaagctccatgtccgggcggcggcctacatggatgagacgcgcccgacgccaccgctggagccctccgggggtccggacgaggagaagcgcccgccctaagaagtagaagcggaggtggagatgcacccgccgcgggaaccaaccggggagcctcccattgatctcccgggggtgaatgtggtggtggacattaaggctaacgaactgcacaatgaaaggggggatcgtgcaaaggagaagcgcgacaacgataaagggatggtgaaggaggaatacaacaaaaaaaaacgagacgctcgatgtacccaattcgcccctaaaatgagtcgtatttcgcgcgcctcaatggcccccttttttacaaccgtatgaactgagaaaaccctggcgtttccctcacttaaatcgcctttgaggaaaaccccccttttccccaccttgcataatagtggaaaaa

SEQ ID NO: 65006 - protein, 83 aa, Zea mays
  misc_feature: Ceres CLONE 1535388
MHPPREPTGEPPIDLPGVNVVVDIKANELHNERGDRAKEKRDNDKGMVKEEYNKKKRDARCTQFAPKMSRISRASMAPFFTTV

SEQ ID NO: 65007 - DNA, 632 bp, Zea mays
  misc_feature: Ceres CLONE 1535401
  misc_feature: Encodes the peptide sequence at SEQ ID NO. 65008
ctccccgcggtggcggccgctctagaactagtggatcccccgggctgcaggaattcgtctcacccctagaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacagtggtggccgtggaggcggggctcggcggggccccctatatttttggggggggggggcccccccgggggggggcgggcccccttttggggggggcggccacttgtgtgggggggggtgggggccccccctccaggggggtccaccaccctgggcggggcggacaacat

SEQ ID NO: 65008 - protein, 153 aa, Zea mays
  misc_feature: Ceres CLONE 1535401
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYSGGRGGGARRGPLYFWGGGAPPGGGGPPFGGGGHLCGGGWGPPLQGGPPPWAGRTT

SEQ ID NO: 65009 - DNA, 829 bp, Zea mays
  misc_feature: Ceres CLONE 1535402-R
  misc_feature (1)..(1): n is a, c, t, g, unknown, or other
ncgattgggtactcgagcgtctcgtttttttttttttttttgaaagacaagtaaacatgtcttttcttttgcaatacggaatctttcttaaaatatttgtttttcttcctggaaaccgttcaacgaaaatttttcttcggcctcttcttttcgttgtcctcggggtccaaaatgtggcattggtacacttaacccgaaccattggtaacttcaaagggaaagcggttttcctccggcaacccggcttttgtaagcggtttgaaccccacaagaatcctggttaccgcgttgggccgcaccttgaaaacttttttccagccgcgttcttgccggggaacaacttgcttccgcccgccggccaggtgggggtgaaccccgaacgcgcgcgcttctttccggcccttcttgcattccctgaattcttccacgcggcgaagcaaccgttgctccagcaccgcaaacaccgccaggtgcacttgcaccgaatggttgtcttccgtaaggttaatcacttccaaaacctccaacttgccttccttgggcgtttccgtcaccgggtccttgtacaagcgcgctttcaggtaaggtgcttcggttcttccttgccggccctggggtactcaaactggggaatgtgtccccgcgtttggccgccttgggccccgtccgggcctgggggtagttgcggcattaagcgtccccggggacggttcaaactttgtcccggggtccttccggggggcgccccttgaaaccaacaaaacttttattcaccgggcaaattggttcttccgccccttttcttccccgcgggtgtcccccccggggg

SEQ ID NO: 65010 - DNA, 601 bp, Zea mays
  misc_feature: Ceres CLONE 1535402
  misc_feature: Encodes the peptide sequence at SEQ ID NO. 65011
ctggagctccccgcggtggcggccgctctagaactagtggatcccccgggctgcaggaattcgtctcacccctagaaaaaagcaccgaagtccgagctctccaccgaggaaacctccccgctctctctctcctcaggtcatcagtcccctatcctcctcctcctcttcttccccacatcgtcagtgaggtcctcggggttgcagcggcaataatgggggagaggaggaggtttcctgctagcgctcgcttgctcgccctcgccgtggcgatggtgttgcaggcggcagcggtggtgctcgtcctgggcgaggcgagtgacggcggggccatgcttgtgggctcgcggcagctggagaagttcgtggacgagctgccggacatgccgaggctgcgcggctacggcgtcacggagggcggcgcgctcgtcgccggcaacctcaccatcggcatgtacgataccagctggaaattccaccgcgaccttccggcgacgcgcgtcttcgcctacggaaccagcaaggagaccgccacggtgccgggccccaccatcgaggccatggcggggcgtccccacgcaacgtgacgtggggcgaccacctc

SEQ ID NO: 65011 - protein, 123 aa, Zea mays
  misc_feature: Ceres CLONE 1535402
MGERRRFPASARLLALAVAMVLQAAAVVLVLGEASDGGAMLVGSRQLEKFVDELPDMPRLRGYGVTEGGALVAGNLTIGMYDTSWKFHRDLPATRVFAYGTSKETATVPGPTIEAMAGRPHAT

SEQ ID NO: 65012 - DNA, 771 bp, Zea mays
  misc_feature: Ceres CLONE 1535403
  misc_feature: Encodes the peptide sequence at SEQ ID NO. 65013
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (41)..(41): n is a, c, t, g, unknown, or other
  misc_feature (55)..(55): n is a, c, t, g, unknown, or other
nnnttttnnnnnnnnnntttttgtctctcgaggcctctcanaaaaaacaaaattnaaaaatctggagctccccgcggtggcggccgctctagaactagtggatcccccgggctgcaggaattcgtctcacccctagaaaaagcaccaatcggcgggcccccacctctggctcggcttccaaatccaaacggccgtgggctcgcctcaggccacttcggtccctcctcgagctccatccaatcctccctccccgtcgtgccggcatcgcgcgcagggaggaccggccggacggccggcccgcccgcccgccgccatgccgggatcgcccaaggtctttttcgcctcctccgcctcgcgccgctccgggtcgctgcaccggctgctctcgacgccggtcttctccgcggcctgcctccttcatcggcctcgccgggttcgacgccgccgcgcttcaccctcttacgctcccacgtgcgtcacttcacagtccgcctgaccccgattcccgtcggcccgtttcccccgcccaaaatcaccgtggggacccccattccccaggggaaaggaatccaccaggggggactcctcccgtagcctccccggccctccgctttaccacttggtttccccgccggctcccccctcataagtccattgacccctccccctccgcgatagcatgccccccggggatgcgggctccccattggggcggctcactcctattcccctcgccccccataattttggcgctacccggacggtagaccg

SEQ ID NO: 65013 - protein, 60 aa, Zea mays
  misc_feature: Ceres CLONE 1535403
MPGSPKVFFASSASRRSGSLHRLLSTPVFSAACLLHRPRRVRRRRASPSYAPTCVTSQSA

SEQ ID NO: 65014 - DNA, 694 bp, Zea mays
  misc_feature: Ceres CLONE 1535404
  misc_feature: Encodes the peptide sequence at SEQ ID NO. 65015
  misc_feature (527)..(527): n is a, c, t, g, unknown, or other
  misc_feature (532)..(532): n is a, c, t, g, unknown, or other
  misc_feature (579)..(579): n is a, c, t, g, unknown, or other
  misc_feature (638)..(638): n is a, c, t, g, unknown, or other
ggagctccccgcggtggcggccgcttctagaactagtggatcccccgggctgcaggaattcgtctcacccctagaaaatcgtacctgcgtgggagctatagatgcactcgtgttgtgtgtataaatcattctgtatataaacttcacttgtaatggttgatgttgttggcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttngagtngttgtccagtttggaacaagagtccactattaagaacgtggactccnacgtcaaaggcgaaaaccgtctatcagggcgatggcccactacgtgaaccatccccctnatcagtttttttggggtcgagggtgccgtaaagcctaaatcggaccctaaaggaac

SEQ ID NO: 65015 - protein, 84 aa, Zea mays
  misc_feature: Ceres CLONE 1535404
  misc_feature: SWISSPROT Homolog: EC 3.2.1.23 Beta-galactosidase
MVDVVGKKKKKNETLEVPNSPYSESYYARSLAVVLQRRDWENPGVTQLNRLAAHPPFASWRNSEEARTDRPSQQLRSLNGEWKL

SEQ ID NO: 65016 - DNA, 640 bp, Zea mays
  misc_feature: Ceres CLONE 1535405
gactgatcgcgtgtagatggagagcgagatcgtgtcgttcgagcgcggtagtgtatcgtagatttcgtcgtacccctagaaaaaatcacaacaaaaggcgcaagcaccgcacggagagcaagcaagatagcaaccaccgcactaccactacctaacaatggcccgcgcctacgtgtttctcgtcgtgctcctcctggccgctgtcatcgtggcaccgtttcacgggagcgacccgtgtcgacctcgttgaaggcaggttcatggcgtccgccgacgcccccgaaggccgccccactttacccggggcttaattccgcctcttaaccgaattcctcctcggaaggcccctccgagagcaattctttggaattaaatattttggccttttaacacaaaaattttggtttccttttatggggcgccccaaatttcttacttttttcggggttgcaagggaaaaattcccaattttccgggaataatttactcgcccccagaggaaatgggctttcccccccccccccacaaaaaaaacccttgttttttttataaaaaaaaaaaaaaaaacccaccccccccctcccggggggacccccttttctccccctatcataggtggggctttattattccccccccc

SEQ ID NO: 65017 - DNA, 864 bp, Zea mays
  misc_feature: Ceres CLONE 1535410
  misc_feature: Pfam Name: Ycf9 Pfam Description: YCF9
  misc_feature (1)..(1): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (460)..(460): n is a, c, t, g, unknown, or other
  misc_feature (822)..(822): n is a, c, t, g, unknown, or other
ncccccnnnggtggggtaanttatcgnnnnnnnnggggagggnnngaaaataaaggagaggaggggtggtgaggatacccaaaattgaaacttcccggctggaggaatgcgtctcacccctaaaaaaaatgaatattgctttcaattagctgtttttgcattaattgcgacttcctcagttttagtaattagtgtaccccttgtatttgcttctcctgatggttggtcaaataataaaaacgttgtattttccggtacatcattatggattggattagtctttctggtagctattctgaattctcttatttcttgaatttgtttagtatttattcaccccgagagaaaagaaaaaaaaaaaaggagaagtttctaagtaacccaaattcgccctaaagcagagtcctatttttttcccccccccccccaggagagggggggagggggaaccctcacttcncaaaattttttgggggccccctcgatgtaaaaacgaaaacaacaaacagttgtgcccccttttcccggcccgcgagggccccaaaaaaaagagaataaggggccccccaccccgcattggggcacccagaccccaaccaagatggacggaacagccctgaaagcccaacgaaaatgggaacacggcgacaaacagggtaaaaaagatttttgcatcacaaaattccccacaaagaaaaataccgtgcccagagcaagcacaagccgccaggcagcaaacaaacagaagagagggaaacaaaacagccaaaaataacccccctatattaaaacgcgaaacctatattcaggtccccgtccatncagcagctgcacacgtaacagaggcgccaccggacatacggg

SEQ ID NO: 65018 - DNA, 623 bp, Zea mays
  misc_feature: Ceres CLONE 1535414
  misc_feature (199)..(199): n is a, c, t, g, unknown, or other
  misc_feature (209)..(209): n is a, c, t, g, unknown, or other
gctggagctcaccgcggtggcggccgctctagactagtggatcccccgggctgcaggaattcgtctcacccctagaaaatagctttaatctgtctcgttagtgtgtcgtgttcgtgtagtaccatgccacagctacgccatgccgtgtgctctgtcacgtggggggccacttatgggtctcctgctgccctgcaatggntctgaaaaanaaaaaaaaaaaaaaaaaaaaaggaaaaaaaaaaaaaaaacgagaccctcaaggtaccaaattccccctatagggaatcgaattaaccgccttcactggccgtcttttaaaacgtcgtgaattggaaaaacctggggttaacccaataaaaccccttgaaaaaaacccccttttgcccctggggggaaaaaaaaaaaaggccccaaccatacccttttccaaaaatttccccccccaaaaggggaaaagaaaatttaaccccataaaattttttaaaaaaaaccggcaaaatttttttaaaaaaaccccccttttttttaaacaaaagggggaaaaaggggaaaaattcctttaaattaaaaaaaaaaaacccccccggggggggggggggtttttcccctttttataaaaaaaa

SEQ ID NO: 65019 - DNA, 690 bp, Zea mays
  misc_feature: Ceres CLONE 1535418
tggcggccgctctagaactagtggatcccccgggctgcaggaattcgtctcacccctagaaaaaagggcgacgttctgttgtggatgccttatatgtgttgtcgaacaaactagcaaaagcaagtagccatcggatgtcccacctgggatgggattaaggctctacatttgtttttcctccttactccccgtcctagcatgtatgaggtgtagtcactttatactctagtcacatgatataaagtgtgtattgtttgtagacctgcgtacaatgatccagcagtatggagatatttaaataaaaaagaaaaaaaaaaaaaaaacgaaacgctcgaggtacccaattcgccctatagagagtcgtattacccccccctcactggcccgtctttttacaaccccccgggaacgggaaaaaccttggcgttaccccaactttaatccccttggaagaaaatcccccttttccccagttggggttatatccgaaaaagggcccccccaccaatttcccctttcccaacaattttcccccacccttttatggcaaaatggaaaattttaaaccctttaaaaatttttggaaaaatttggggtgacacaatttttttgaaaattgcctctttttttgttttcacccaaagtccgccaaatattcgacaatatctcccttaataatataaagaaaat

SEQ ID NO: 65020 - DNA, 634 bp, Zea mays
  misc_feature: Ceres CLONE 1535424
  misc_feature: Encodes the peptide sequence at SEQ ID NO. 65021
tggcggccgctctagaactagtggatcccccgggctgcaggaattcgtctcacccctagaaaaagtccgcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcataggagggctaacttcagagtaaaagcggctaaggagctgtacttcaacaaggatgggtcagctatcaagaagctccagactggagtcaataagcttgcagacctagttggagttacactcggaccgaatggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgtaaaggtcgtaacagct

SEQ ID NO: 65021 - protein, 143 aa, Zea mays
  misc_feature: Ceres CLONE 1535424
MASTFGATSTVGLMAAPTGKNVRLHRRANFRVKAAKELYFNKDGSAIKKLQTGVNKLADLVGVTLGPNGRNVVLESKYGSPKIVNDGVTVAREVELEDPVENIGAKLVRQAAAKTNDLAGDGTTTSVVLAQGLIAEGVKVVTA

SEQ ID NO: 65022 - DNA, 664 bp, Zea mays
  misc_feature: Ceres CLONE 1535426
  misc_feature: Encodes the peptide sequence at SEQ ID NO. 65023
  misc_feature (450)..(450): n is a, c, t, g, unknown, or other
ggagctccccgcggtggcggccgctctagaactagtggatcccccgggctgcaggaattcgtctcacccctagaaaaacgcgaagaagggcggcgggccggacacatggctgggccgcgcggccatggtcggcttcgcctccgcgatcgccgtcgaggtggccaccggcaagggcttccttcagaacttgggcgtgggtactccggcgccgacgctggcgctggccgtgtcggggctcgtcgtcggcctcgccgtcttcttcctgctgcagtcgggaggaggcacgcgagactgacgactgatggaacccatgagctgagctgagcacgcgtcgaacatcgtctccccactcgacatcagttgctgtgctgtaatggttggtgaagatgaaaacccaggatatatatcatcatcatgtcatgtgtaacaaagacgacaactctcatgtgnttggtgttgtcaaaaaaaaaaaaaaaaaaaaaataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagagccc

SEQ ID NO: 65023 - protein, 56 aa, Zea mays
  misc_feature: Ceres CLONE 1535426
MVGFASAIAVEVATGKGFLQNLGVGTPAPTLALAVSGLVVGLAVFFLLQSGGGTRD

SEQ ID NO: 65024 - DNA, 636 bp, Zea mays
  misc_feature: Ceres CLONE 1535428
  misc_feature: SWISSPROT Homolog: EC 3.2.1.23 Beta-galactosidase
tccccgcggtggcggccgctctagaactagtggatcccccgggctgcaggaattcgtctcacccctagaaaaatagaaaaaaataaataaaatctctccgtgtgtgcacgtacgcttgcatgtgcatggtagcatgtatgtacgacgtcgtccatgtatgtgtgtgtgacgtgtgagacagagagagagagagagagagagagagacaggatcgatcgagagacggtcatgtccttttggctgtttggtttattcatatcacaacttttgagtgtataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaacaataggccgaaatcggcaaaatccctttataatcaaaaaatagaccgagatagggtttgagt

SEQ ID NO: 65025 - DNA, 699 bp, Zea mays
  misc_feature: Ceres CLONE 1535433
  misc_feature: Translation starting site: 142
  misc_feature: SWISSPROT Homolog: EC 3.2.1.23 Beta-galactosidase
ctccccgcggtggcggccgctctagaactagtggatcccccgggctgcaggaattcgtctcacccctagaaaaactgcgacgggaaggggcgcgtgctcagcgaggaggagcgcgccaaggagagcgtctacatccagaagatggagagggagcggcaggagaagctcaagaagaggctcgagcaggagaaggccgactccgacaaggccaagcccgccgacgccgacaagaaggccgagggatctgcctagctaggattggcatggcactgttggaaggcaatcacttttcgcatgtatccgaatccgatggtcagctttgtgaatgaataaattctgtacaacgtacacagcactggatatgctgctgcttcgggatgctgcatgtcgaagctgaagacgacattcatatcttcgacactagaaataaataacgagacgctcgatgtacccagttcgccatatagtgagtcgtaatacgcgcgctcactgggccgtctttttacaacgtcgggactgggaaaaaccgggcgttagccaacttattcgccttggcaggaattccccctttccgcgagtgggcgtaattgcgaaaaaggcccgaacagatccccctttccaaaagttgggcccaacccgaaaggggcaaagggaaatttgcacccttcaaaatttttgggaaaacattcccggtaaatt

SEQ ID NO: 65026 - DNA, 653 bp, Zea mays
  misc_feature: Ceres CLONE 1535443
  misc_feature: Encodes the peptide sequence at SEQ ID NO. 65027
  misc_feature (460)..(460): n is a, c, t, g, unknown, or other
ctccccgcggtggcggccgctctagaactagtggatcccccgggctgcaggaattcgtctcacccctagaaaaatcccctccccacatcgggaaccgccgccgacgccgcaggaggagacgcatcgaggttagcacgcgaagaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgcacttcagtaggccacttttcatggttctagtggtatttgatccagcgtttgccactaaaataaatcagacagtcgttttgtgaaccctatatgatggnagcttatttgctgaaatatctacctactatttggagctgagcgaaaaaaaaaaaaaaaacggaccccccgggggaccaatttcccccttaagggggtcgtattacgccccctcctgggccgccgttttaaacagtcgggacgggaaaaaccgtgggttttcccaatttaacgccttggggaaacctccccttt

SEQ ID NO: 65027 - protein, 129 aa, Zea mays
  misc_feature: Ceres CLONE 1535443
PRGGGRSRTSGSPGLQEFVSPLEKSPPHIGNRRRRRRRRRIEVSTRRSDHEGQVEEEAHEEAQEEAQKDEAEIQVGRSRWIVDLMTCVGTYISSDALVCLWRDVNLPWCHGPPSVERLACTSVGHFSWF

SEQ ID NO: 65028 - DNA, 657 bp, Zea mays
  misc_feature: Ceres CLONE 1535449
  misc_feature: Encodes the peptide sequence at SEQ ID NO. 65029
  misc_feature (235)..(235): n is a, c, t, g, unknown, or other
ctggagctccccgcggtggcggccgctctagaactagtggatcccccgggctgcaggaattcgtctcacccctagaaaaaacggccacatcatcggcgccatagccatcggcctcactcactagctgtctagctagcttccagccgcagcagcttgtcgtgcggatagatagaagcgccaagccactcgctgggccggggtacggttgttgttctgtgactctcgcacaatgcgngccatggtggaggaggaggagctcatcagaggggcggcgcccgagccggagccggagccgcacctcctggtggtgaccttcccggcgcagggccacatcaacccggtgcggcacctcgcgcgccgcctgctgcgcgccacgggggcgcgggtcaccgtctccacggccgtgtccgcgctccgcaagatgttcccgggcgagcaggcgggcgcggagggccaccgcgacgccgcggggggtgtggtacgtgccctactccgacggctacgacgacggcttcgaccgcgacgcgcacgacgccacgcactacatggagcagatcaagctcgtgggcgccgccacgactgggtgccgtcctcgaccgcctcccgcggcgtgggccgccccgtcacggctcgtcgtgtaacgctgctgctttgtcg

SEQ ID NO: 65029 - protein, 139 aa, Zea mays
  misc_feature: Ceres CLONE 1535449
MVEEEELIRGAAPEPEPEPHLLVVTFPAQGHINPVRHLARRLLRATGARVTVSTAVSALRKMFPGEQAGAEGHRDAAGGVVRALLRRLRRRLRPRRARRHALHGADQARGRRHDWVPSSTASRGVGRPVTARRVTLLLC

SEQ ID NO: 65030 - DNA, 670 bp, Zea mays
  misc_feature: Ceres CLONE 1535450
  misc_feature: SWISSPROT Homolog: EC 3.2.1.23 Beta-galactosidase
  misc_feature (585)..(585): n is a, c, t, g, unknown, or other
  misc_feature (593)..(593): n is a, c, t, g, unknown, or other
cgcggtggcggccgctctagaactagtggatcccccgggctgcaggaattcgtctcacccctagaaaaatagaatgtgcctttgtggtgagtaaagatgtccatttcatatggcctttgtgatgagtatgtctgcattgaaaagttagtgctttcattcttgataatggacacttcgatttgattcatattcacatccattgaatctttatattcggttcttgtatacccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggnttgagtgnttgttccagtttggaacaagagtccactattaaagaacgtggactccaacgtcaaagggcgaaaaaccgtctatcag

SEQ ID NO: 65031 - DNA, 695 bp, Zea mays
  misc_feature: Ceres CLONE 1535452
agctccccgcggtggcggccgctctagaactagtggatcccccgggctgcaggaattcgtctcacccctagaaaaatgaggctgtgcaagaggttgctgctgccgagtagtttgtttgctacttctatatctaggctgaatctggacatgaggctgcttatgacccgaactcacccttgtctacttgttttcatccgcccctcaagatccgtctggaaacaagtttaaaactgagattaccctcaacatgcccctaatattactcgtggtgatcttcccccttccgccagatggcttaatcgagacgatcccggtacccaattcgctctccaacgattcctattacgcgaggtcaatggaaatcgttatacatcatcatttctggaaaatccctgtcattcccagctaaatcgccttgtttctcatccccctttcgccagctggcgtaatccctattagcccgcaccaatcgccccttccagcatttagcgctcctccaatgcgaatcggaaattcccaactttaaaaacttgggtcaccaatcgcgattgggcttataatcaactctacctggttttttggaccaattatgggaaccatccgccaaattccctttatattcgggaacaaagggcccgaaaacccctttaaatggtaccccccaggggggcccccccattttcccctttttaagg

SEQ ID NO: 65032 - DNA, 583 bp, Zea mays
  misc_feature: Ceres CLONE 1535457
cgcggtggcggccgctctagaactagtggatcccccgggctgcaggaattcgtctcacccctagaaaatagtactgtgtattgtattgtacgtgctagtagtaaactgctgccttcttccttctcttctctcccccaccactctgctgttttgctccttctcatcgtcatcgccgtcatcgcgtcggctgtgagttgtgacctgtatgtaattaagccatcatccacacgtctaatctcgcttcgctatctgtcgaacgttaacaaaagatagaacatagctcagggtaccaattcgccaagagtgagtgtattggcgccatactggcgtcgtttacacgtcggactggaaaacctggcgttaccaactaatcgcttgaagagatccccattcccagctggcgactacgaatagcccgcccgatgggcataacaacggttcccaccctaaatgccaatggaaatgcacccttaaaattttggaaaaatcccataaatttttttaaaatcccctctttttttttaccaaaggccaaaatgggaaaaaaccttttaaaatccaaaatttttccaaaataggggtt

SEQ ID NO: 65033 - DNA, 642 bp, Zea mays
  misc_feature: Ceres CLONE 1535458
  misc_feature: Encodes the peptide sequence at SEQ ID NO. 65034
  misc_feature (203)..(203): n is a, c, t, g, unknown, or other
  misc_feature (208)..(208): n is a, c, t, g, unknown, or other
  misc_feature (210)..(210): n is a, c, t, g, unknown, or other
  misc_feature (343)..(343): n is a, c, t, g, unknown, or other
  misc_feature (344)..(344): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (414)..(414): n is a, c, t, g, unknown, or other
  misc_feature (455)..(455): n is a, c, t, g, unknown, or other
ctccccgcggtggcggccgctctagaactagtggatcccccgggctgcaggaattcgtctcacccctagaaaaactcgatggtctcgtactcttgtcacgttccttcctgactgcccccacttctcctccggcggcgcggcggcgggttacctcccaacagcccgaccatgaaagccgacatcgctttcaggtatgagatccncccgngnatccgcccagttcctccgcgacggcgcctacaccagggtcgcgctccagttccccgacgagatgctgaaggatgctgctgcggtggcgagggcgttgcggcgggagcttgcctccggcggcgcccgacagtgnngggttagggtgttcgtgatgggccccgaannnncggggggttaaccaaacttccccttggccttgggccntttttggggaaaaaaccaaaaaaagggggggggggggggcntcggttttttatataatctatagcaagttggcttccccgacccggcgtcactccgcgttgtttctatttcgtcgtcctctgtgtcggggctcgagttcctgggtggatgcgttgatgtggtgagggtatgttcgagggggcgaccgaacgcagataccgaatatactagtcattaatcccataccat

SEQ ID NO: 65034 - protein, 64 aa, Zea mays
  misc_feature: Ceres CLONE 1535458
  misc_feature (4)..(4): Xaa is any aa, unknown, or other
  misc_feature (6)..(6): Xaa is any aa, unknown, or other
  misc_feature (50)..(50): Xaa is any aa, unknown, or other
  misc_feature (51)..(51): Xaa is any aa, unknown, or other
  misc_feature (61)..(61): Xaa is any aa, unknown, or other
  misc_feature (62)..(62): Xaa is any aa, unknown, or other
MRSXRXSAQFLRDGAYTRVALQFPDEMLKDAAAVARALRRELASGGARQXXVRVFVMGPEXXGG

SEQ ID NO: 65035 - DNA, 663 bp, Zea mays
  misc_feature: Ceres CLONE 1535459
  misc_feature: Translation starting site: 130
  misc_feature: SWISSPROT Homolog: EC 2.7.1.90 Diphosphate--fructose-6-phosphate 1-phosphotransferase
  misc_feature (538)..(538): n is a, c, t, g, unknown, or other
  misc_feature (644)..(644): n is a, c, t, g, unknown, or other
ctccccgcggtggcggccgctctagaactagtggatcccccgggctgcaggaattcgtctcacccctagaaaaaaaactaaaccagcccagatcagcgaaacacactccgctctcccgagaccggacacatggcggcggcggcggtgacgtccaacggcggcgcagtgaccacaaatgggacggcgcccagccggctggcctccgtgtacagcgaggtgcacacgaaccggctcctgcacacccttcccctcccctacgtcctccgctccaacttctcggtcgtcgacggccccgccagctccgccgcgggcaaccccgatgagatcgccaagctcttccccaacctgttcggccagccctcggcgtcgctggtgccgtcggccgatcccgctgcgaccaggccgctcaagatcggcgttgtgctctccggaggacaggcgccgggcggccacaatgtcatctgcggcatctttgactatctacaggagcgtgcaaaatgcatcacccttgtatggatgtaagggaggcccagctggnatcatgaagtgcaagtatgtagaactcacttcagactttgtgtatccctacagaaatccacggtggattttgatatgatctgcagcgcatcggactagaatcgagncacccggagcacttttagc

SEQ ID NO: 65036 - DNA, 650 bp, Zea mays
  misc_feature: Ceres CLONE 1535464
  misc_feature (650)..(650): n is a, c, t, g, unknown, or other
gctggcgctcaccgtggtgactagccgctctagaactagtggatcccccgggctgcaggaattcgtctcacccctagaaaaaatgtatttagtatttccttatgcacatgggatgcaatgacttggactgttggttgggaattgtttcccagctgttaatttattgtttcctttgctggtgagctatcaaactaaacatgcattcatccaggaaattcattattgtaaatcgatacaataatatgttgaatgatggatctccatgtatactttgaaccaaattttattctcttccaaagttttttggaagtatttggtagttacatggaagtttggttcttggtgacagaataatcatttgtgtttagtttcctgtcagtttacgtgattgaattgcacctcagttcacattactagctattctgtcatacaaccaatgcaatatgctgcccttcctacaagggaaccttcaggttggacaccattcacattggtactgtctgatcacttcctgacattcaattctctgtttgtgctgtatgtaccaggtagcagaaactgttctgctgcagtctgacaaagtggagggcttaggagcttctgcttcttttatgtctgaacaatctttgctttatttgggattgttaggn

SEQ ID NO: 65037 - DNA, 699 bp, Zea mays
  misc_feature: Ceres CLONE 1535467
  misc_feature: Translation starting site: 249
gctggagctcaccgcggtggcggccgctctagaactagtggaacccccgggctgcaggaattcgtctcacccctagaaaaaagccacgacgtaagacagcccgtcagcccctctcgtgtttgatccggcttctcctccaagcgcgtgcgctatactcctcctcgacgagagcgagagcttctgcatcagaactacacatcacaagcttgatcagctcgagtgccgacacaacctcacaaccaagtttcatgactgatctcgacgtccagcttccgtctgcctttgatccgtttgctgaggcatatgctgaggactctggtgctggtcctggaacgaatgattatgtgcatgtgcgcatccagcagcgcagcggctgatagagtctgactacagtccagggtctgaaagacggagttctgctataacaagatcctcaaggatctgaagaaggaattctgctgcaatggtactgtagttcaggacccagagctaggccaggtcattcagctccaaggtgatcagcgcaagaatgttgctactttcctagttcaggctgggattgcgaagaaagagaacatcaagattcacgggttctaagggacctgtaaatgcttgtgccctatattgtgtgcctccacatattgtggagcttgaagcatcgacagttgctagtcattgctttacttatataagaacata

SEQ ID NO: 65038 - DNA, 577 bp, Zea mays
  misc_feature: Ceres CLONE 1535469
  misc_feature (174)..(174): n is a, c, t, g, unknown, or other
  misc_feature (303)..(303): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (478)..(478): n is a, c, t, g, unknown, or other
  misc_feature (479)..(479): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
cgctctagaactagtggatcccccgggctgcaggaattcgtctcacccctagaaaaaaggaatctaactcagggccagccttcttgaagctggttcaagaaaagcttagtcctgcagagtacacagagtttgttgaatacatgaaggccttaaaattgaaaactatgcataccnaaggactcactttgaagcaataactaagcttttttcgtccccaggaaagactttccacttccttgaaagggttccagggtttttttgttgccaaataaacccctccttcccaatgaaaagaaacccccnccnnnngttgaaaaaatttattaagtttctcaaacccaaaacccccctttttttttttttcccccccccaaaaaaggagggagaggggggggggnnnnnnnttttttttttttcttttnnnnntttccccccccccccctgttggtttataggaaaaacaaaaaatcnnncctcnntnnnncccaaaaacctcagcctcgccccggggccgcgccgccccgaccccccccacctttcccatcacccctcaccctcctcagcatgactccatcac

SEQ ID NO: 65039 - DNA, 592 bp, Zea mays
  misc_feature: Ceres CLONE 1535472
  misc_feature (73)..(73): n is a, c, t, g, unknown, or other
  misc_feature (252)..(252): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (383)..(383): n is a, c, t, g, unknown, or other
  misc_feature (384)..(384): n is a, c, t, g, unknown, or other
  misc_feature (394)..(394): n is a, c, t, g, unknown, or other
  misc_feature (510)..(510): n is a, c, t, g, unknown, or other
agctggagctcacgcggtggcggccgctctagactagtggatccccgggctgcaggattcgtctcacccctangaaaaattatttctagctgagtttgactcagctggtggggtgtcgacgtgtggtaggttggttatgtgtctgcatcagctcacttgccccggatggcggtctttgcccttggcttggtttctccgtgctagctatcgttatatgtgattgcgagtgattgcgaggccgtgtttggttcnttattttttctgaccacttttctgaaattgactgtgggaagatctggctgtgaggagatctgagtatcttaccattacctgggggggtttttccccccccccgggggggggggggggnnnnnnnnnnnccnnccccccccangtccccaattcccccaaaaagagccttttccgcgcccccccggccccccttttataactccgggacggaaaacacccgggtttccccaactataatcccttatagaaaatcccccntttccccccttggggtaaaaagaaaaaaagcccccccacaatcccccttcccaaaaattatcccacccccaaaaggcaaaaa

SEQ ID NO: 65040 - DNA, 676 bp, Zea mays
  misc_feature: Ceres CLONE 1535475
  misc_feature: SWISSPROT Homolog: EC 3.2.1.23 Beta-galactosidase
ctggagctccaccgcggtggcggcccgctctagaaactagtggatcccccgggctgcaggaaattcgtctcaccccctagaaaaaagtcagtaagattgagtgcccacgatctgtagatcttttgacttgatgcgttgtgctacggcatgagattcggtcggatatatgtatcacgtgcacgggtcagacgcctatgtatcgtgtctacggcgtgcatacgtctccctactacatcgagaattatatacgtcgcatcatgcatacttgctatcgtacagtttgatcgtctacatatctctgctagatatgaatgtgtgtgtggttcattgcacgatttcacaccaacggtgatcaacacgctgtaggtacgcaattcctctgatctgcagacgaattacacgcgctaactgctcgacgttctacaacctcctgactgtgaaaaccatgacgctccctaactgactcgccttgcacaacatcctccttgcgacagctggcgtattaccgaagaggcccgcattgatcgaccttcccattagttgcgctggctgaatggcgaatggaaattgaccgctttaatatcttgttaaaattcccgttagattggtgaaagaacatctcatttgttaatccaataggccgatatccgtaaaatccctgataaatcagaacatt

SEQ ID NO: 65041 - DNA, 744 bp, Zea mays
  misc_feature: Ceres CLONE 1535478
tccccgcggtggcggccgctctagaactagtggatcccccgggctgcaggaattcgtctcacccctagaaaatgctctcattaggacttgggtcactgctaattatgttcccaacgactaatggggttggaggttgtcgaaacaccagatgaggaaacttttggtatctttttgttcgtgtagcaccatcaaagtgcgcgcttggtcgcttcccttcctccttgttggggatgtaccccaccttccaaaataaactaccccttacaagggatgctcaacatatagattagtcgaggatttaatctacaaaattttgtatgcccccctgggtctccatttcccccttattttttggtcccattcccccccccccccaccaggggggtgggtttcttatcatcttttttgtttgttgtgttgtccccccccccccctaatgacccatttaatctaactttcatgcccctattttatcccctttttcttaacccctttttcctcccccttcctgtgagattgcctcatctccccttctctaccccttttgcccccatctttcttcccatgtccctccttattctcctccgaagttaatcaaacctcgtatcctcgtatactctatcctattccccgttatattcctcttttactcccctttttccctatctacttgcctttgactaccatccttatacgttctcccctctttatcttcactcttcgatcatcccccccccctctcag

SEQ ID NO: 65042 - DNA, 660 bp, Zea mays
  misc_feature: Ceres CLONE 1535479
  misc_feature: Encodes the peptide sequence at SEQ ID NO. 65043
  misc_feature (383)..(383): n is a, c, t, g, unknown, or other
ctccccgcggtggcggccgctctagaactagtggatcccccgggctgcaggaattcgtctcacccctagaaaaaccctagaaaaaagatatgacccaaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggtttgcctagaagcagccaccctttaaagagtgcgtaatagctcactgatcgagcgcccttgcgctgaagatgaacggggctaagcgatctgccgaagctgtgggatgtcaaaatgcatccgtaggggagcgttccgccttanagggaaacaaacgcgaaagcgggggcccacgaagcggaagcgagaatgtcggcttgagtaacgaaaacattggtgagaatccaatagccccgaaaacccaaggtttcctccgcaaggttcgtcccacggaggggtgagtcaggcccctaagatcagggccaaaagggcgtagccaatgggacaccggggcaatatttccggtacttccccctttgttggtcccgaggggacggaagaaagctagcgttagcccaaaaaaatgcgttattaggtttaa

SEQ ID NO: 65043 - protein, 69 aa, Zea mays
  misc_feature: Ceres CLONE 1535479
  misc_feature (25)..(25): Xaa is any aa, unknown, or other
MNGAKRSAEAVGCQNASVGERSALXGNKRESGGPRSGSENVGLSNENIGENPIAPKTQGFLRKVRPTEG

SEQ ID NO: 65044 - DNA, 643 bp, Zea mays
  misc_feature: Ceres CLONE 1535484
  misc_feature: Encodes the peptide sequence at SEQ ID NO. 65045
  misc_feature (249)..(249): n is a, c, t, g, unknown, or other
ctcaccgcggtggcggccgctctagaactagtggatcccccgggctgcaggaattcgtctcacccctagaaaaaatattatattgtagatatatctgtatggtttccttcctagtatgtggcatatgatgtataataataatacgtcgaacgctcatggtactgtgctgtgtgtgccatgtgcataggggtgggtgcctcagggtcagggattcgtgtgcgctatgccgcagcttggatctcgccgtgngccgtgtcgtgtgtttcctcctgctctgctatgtatgtcatcactgacggtgtgtggaggttgggttcatatatatgcttgtaatgttagctggtttgaggtgtggactacaagagtagttttgttcagtgtctggtatctagtagctgaacccccccccttgaactctgtgaactgtgatgtgggataatgctaagaagatgaatagatgatcgttgggttgtcttgtcaaaaaaaaaaaaaaaacgagacgctcgaggtacccaattcgccctatagtgagtcgtattacgcgcgctcactggccgtcgttttacaacgtcctgactgggaaaaccctggcgttacccaacttaatcgcccttcagcacatcccccttttcgccagctggcg

SEQ ID NO: 65045 - protein, 71 aa, Zea mays
  misc_feature: Ceres CLONE 1535484
  misc_feature (9)..(9): Xaa is any aa, unknown, or other
MPQLGSRRXPCRVFPPALLCMSSLTVCGGWVHIYACNVSWFEVWTTRVVLFSVWYLVAEPPPLNSVNCDVG

SEQ ID NO: 65046 - DNA, 644 bp, Zea mays
  misc_feature: Ceres CLONE 1535505
  misc_feature: Encodes the peptide sequence at SEQ ID NO. 65047
  misc_feature (644)..(644): n is a, c, t, g, unknown, or other
ctggagctccccgcggtggcggccgctctagaactagtggatcccccgggctgcaggaattcgtctcacccctagaaaaagcctcattcgtccattccccagccttccagagcccgccgccgccggccgctgctcccccgacgcgggggaagccaccggcggtagcgctcgcttcgccgcgccaaaaacctagtggctccgagttccccgccgcctccgtggcttctatggcgaacccgggcctagggcttggactcgcgccaccgggcgccgagccctccgccggagcgccgccctcttcacgtcgcgcgccgcgcttggccaaacggcgccacgtgcccgcctcctcccgctcccgcgcgccgcaggcctcagccggaatatggaacccgtttggtggtggcggaggtacggatagacagaccggaggctttgtgtttggtgctgcttcggcagtgagccaacagcctttggagccagcagtgtcgggagcttcacccactgaggcgcccttcgtgtttgggagcatgagggagagcctgcctcggtttgacgagggatcgcgcgcttcatcaaagctccctgataagatggagaagttgaacctgcgaacatcaagtgaggttggcgatggtcttggtcan

SEQ ID NO: 65047 - protein, 138 aa, Zea mays
  misc_feature: Ceres CLONE 1535505
MANPGLGLGLAPPGAEPSAGAPPSSRRAPRLAKRRHVPASSRSRAPQASAGIWNPFGGGGGTDRQTGGFVFGAASAVSQQPLEPAVSGASPTEAPFVFGSMRESLPRFDEGSRASSKLPDKMEKLNLRTSSEVGDGLG

SEQ ID NO: 65048 - DNA, 580 bp, Zea mays
  misc_feature: Ceres CLONE 1535508
  misc_feature (82)..(82): n is a, c, t, g, unknown, or other
  misc_feature (83)..(83): n is a, c, t, g, unknown, or other
  misc_feature (214)..(214): n is a, c, t, g, unknown, or other
  misc_feature (386)..(386): n is a, c, t, g, unknown, or other
tccccgcggtggcggccgctctagaactagtggatcccccgggctgcaggaattcgtctcacccctagaaaaataattaagnntgatgaggcgtcctgtgcgcgtccgggcgaggaatgcatgcatggcgctggcggaaggtataaaatatgctactggtattttaagctatatcgaggtgtgcctgtctctagtcatttattatggtgtttangaatggtctacacagttcgtaacggtgtatcgtggatgcatgttgccgcgagcaaagtacgtatgcatgaccgaatgtgggcgcctctggctggttactcctcccaaggaaaaaggggtggggcctttaatccaaatgtttccccccccaacccgggaagaggatcttttcntttccaaaaaaaaaaaaaaaacggacccctcccagggaccccatttccccccaaaaggggggcggattttaccccccccctcccggggcgccctttttttaaacacccccccggggagcagggaaaaaacccccgggggtttttcccacccaattttattacccccccgtgatgaaaaaaaaaaccccccctct

SEQ ID NO: 65049 - DNA, 688 bp, Zea mays
  misc_feature: Ceres CLONE 1535513
gcggtggcggccgctctagaactagtggatcccccgggctgcaggaattcgtctcacccctagaaaaaccgcacgccccgccgttccaccacgtcactgtcccccgccgccccgcccctcgtcgtcgacgtcctcggtttcggttcattaggtagatcgagtcttagcgtccgtctctgcgcctctacgctgagacgatttgtttgggttaattaagttagctttcgtggagatttcgccccggggcatcaataaaatgttggcatgcgtggtgggatgctatcctttttttttattttatttaattttatttttagcttggatcagttggggtttttgaacattgctagtgtccgggtgattgggaagggctaaaggtatggccttccaaggccaaagttttcaaagaaaggccttggggccaaaacttccaattggggtaaaaaaggccctttcatttgaataaaaaaaaaaaaaaaaaaaaaaaacctctcgggggaccccaatttccccccttattggggtcgcttttttcgccggcccccccgggggcgccccttttttaaacacccccgggagggggagaaaaccccggggggtttccccccaatttaataacccttgtggaagaaaaagccccccccttttccaccagggggggggatataaaaaaagaaacgcccccccc

SEQ ID NO: 65050 - DNA, 751 bp, Zea mays
  misc_feature: Ceres CLONE 1535514
  misc_feature: SWISSPROT Homolog: EC 3.2.1.23 Beta-galactosidase
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (719)..(719): n is a, c, t, g, unknown, or other
tttatggtgggttaagaaagaaggagagcgccgaccnnaccacnnnnnnnnnaatactggaggtccccccggtggcggccggctcttctttagtggatcccccgggctgcaggaatttgtctcacccctagaaaatctgcatttgcgtgggctagtgacttggattttgccggaatgattctgatttggatttgcacaataatgtatgagcgtggattacacgtgcacgcatttgtatgtacgcgcgtatacgtcggacctacgtacctggatttgtgtgcgtgcttcgtaccgaatattaataagaataaacaaatatgactcgtgtcgtacctaaaaattatagttctgacaatacccagactccgagacgctctatgtacccaattcgccctatagagagtcgtattaaaacctcttaccggccctcgtttaacaacgtcctgactggcaaaaccctgtggctccccaccttaaacgctgtgcaaaacatccccctttccccagctggcttaatagcgaataaggccccgcaccgaaacgcccttcccaacagttttcgaggcccgtatgggcgaacggaaattcgaaacggtgttaacattttgttaaaaacatcggcgtttaaatttttggttaaaaccccgcgtaatattttttttagcccaatactgccaaaaaattcgggccaaaaatccccctgtttcaaaccccaaaanaaaaaaaccccccgagaaagttcggcgtaccg

SEQ ID NO: 65051 - DNA, 663 bp, Zea mays
  misc_feature: Ceres CLONE 1535518
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaagttttttagagggaagtttgaaatagaagaatatgataggatagacaggcgacagctgcacttcagcggttcacccagcgcgccgctctcgtgcgacaattgggcgtcccgcgtccgccgtcgccctgcccagcccttcgccggtcctttcccaggccttcgacgcgtccttcgccgtcgaagagtccccagcagcaccatgcccttttctcggcccgccgttggtttcttagttagactggttggggtccggccaagctgctgtcctccttcccgtgcatttgcagctgtcagagctcaaaagattcagcttcccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaat

SEQ ID NO: 65052 - DNA, 652 bp, Zea mays
  misc_feature: Ceres CLONE 1535521
ctccccgcggtggcggccgctctagaactagtggatcccccgggctgcaggaattcgtctcacccctagaaaaagtatttcctggagagtccgtgattcccgttgagtttaatcatagctcgggtgggatgagatgatacttacgaggattcccctggtgacggcgagcgaaccgggggcggccctggttgagaatcgggcggtctccccgccctgattgtattctggagaggcgtcctcagcgactgaccgggcccaagttctctggaaagggacgcctgggagggtgagagccccgtccggcccggaccctgtcagcaccatgaggcgccgtcaacgagtctggttgtttgggaatgcagcccacatcgggcggtaaactccgtccaaggctagatgcgggcgacagaccgatagcgaactagtaccgcgatggacagatccccctttcaccagatcgagacgctcgaggtacgcacttcgcgcatatacgagtccaattattgcgcgctctgtgatgcgccatggacatcgtcagcgactaggataatgctggcgtcagcctaacttaatcgccttgccgcacatctcctcttcgccagctgccgtaatagcgaagatgcctgtaccgatcgcccattccacgattgcg

SEQ ID NO: 65053 - DNA, 684 bp, Zea mays
  misc_feature: Ceres CLONE 1535522
  misc_feature: Translation starting site: 160
  misc_feature: SWISSPROT Homolog: EC 3.2.1.23 Beta-galactosidase
  misc_feature (506)..(506): n is a, c, t, g, unknown, or other
  misc_feature (527)..(527): n is a, c, t, g, unknown, or other
  misc_feature (529)..(529): n is a, c, t, g, unknown, or other
ctggagctccccgcggtggcggccgctctagaactagtggatcccccgggctgcaggaattcgtctcacccctagaaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacngttgttgtgactgtgtgccananaaaaaaaaaaaaaaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttg

SEQ ID NO: 65054 - DNA, 679 bp, Zea mays
  misc_feature: Ceres CLONE 1535533
  misc_feature: Encodes the peptide sequence at SEQ ID NO. 65055
ctcaccgcggtggcggccgctctagaactagtggatcccccgggctgcaggaattcgtctcacccctagaaaaaatcaaggaggttgaaggcgaactagagagaagaggaagatgttggcggcgacggatccgatgctgtggcacaaggtggccgccgtctccggggttgccgctttggggctcggcacctacggcgcgcacatgttccgcctccagaacccgtgtacaaagaggtttgcacacggcgtccctgtacccatctgtccacaccgcgcgctgctcggggcgcccatcacccagcgcccccacgttttcggaaggctcctcactgcctggaatcctgctcctctcctggaacgtggctacaaccgtggctttatccttgaagacagggaagtttttctttcccccgggacccatttggggggggttttgcctttttattgggctgctttgggccccaaccccccccctttccggaataaaaaatgggggctttttccaaagaaaaaaaaaaaaaaaaccggggccgccccgggggccccccaatttccccccttataggggggccctaaatttaccccccgcctccctggggccccctttttttcaaccccccttggaccgtggggaaaacaccccggggttttccccacctttaaatccgccctttgggcc

SEQ ID NO: 65055 - protein, 150 aa, Zea mays
  misc_feature: Ceres CLONE 1535533
MLAATDPMLWHKVAAVSGVAALGLGTYGAHMFRLQNPCTKRFAHGVPVPICPHRALLGAPITQRPHVFGRLLTAWNPAPLLERGYNRGFILEDREVFLSPGTHLGGVLPFYWAALGPNPPPFRNKKWGLFPKKKKKKTGAAPGAPQFPPL

SEQ ID NO: 65056 - DNA, 668 bp, Zea mays
  misc_feature: Ceres CLONE 1535538
  misc_feature: Encodes the peptide sequence at SEQ ID NO. 65057
  misc_feature (79)..(79): n is a, c, t, g, unknown, or other
  misc_feature (354)..(354): n is a, c, t, g, unknown, or other
  misc_feature (355)..(355): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (411)..(411): n is a, c, t, g, unknown, or other
  misc_feature (423)..(423): n is a, c, t, g, unknown, or other
  misc_feature (424)..(424): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (445)..(445): n is a, c, t, g, unknown, or other
  misc_feature (453)..(453): n is a, c, t, g, unknown, or other
  misc_feature (486)..(486): n is a, c, t, g, unknown, or other
  misc_feature (524)..(524): n is a, c, t, g, unknown, or other
tactctggagctcaccgcggtggcggccgctctagactagtggatcccccgggctgcaggaattcgtctcacccctagnaatagtcccccggcgctactcccccgctccagggtccaaggaaagatggcgtcccatattgttggataccctcgcatgggccccaagagggagctcaagtttgccttggagtctttctggaatgggagagcaccgccgaggatctggagaaagttgccactgaactgaggtctagcatctggaaacaaatgtcagaagctgggattctttttctccccaggaagagcgtcctcctacttcgaccgggtttttgaaaaccacgggccttgtttggnnctgtcccatattttttccccccccccccgggggggggggggggggttnnnnnnttntttttttttttnntnnngggaaaataccaactgnacccggcnttgggaatgaccgggggggtttaataacaactncccctttttttgggccgaaaacttgcccaaagccccanttttccatgcccctctccaaaaaggtgtgttcttagggcaagggggccagggcgccggcgtctttctcacggcctaagtgttgatgggacccagggccattgggccccccccataaacttacaaaggaggggagaatatgtctc

SEQ ID NO: 65057 - protein, 40 aa, Zea mays
  misc_feature: Ceres CLONE 1535538
  misc_feature: SWISSPROT Homolog: EC 2.1.1.14 5-methyltetrahydropteroyltriglutamate--homocysteine S-methyltransferase
MASHIVGYPRMGPKRELKFALESFWNGRAPPRIWRKLPLN

SEQ ID NO: 65058 - DNA, 620 bp, Zea mays
  misc_feature: Ceres CLONE 1535544
  misc_feature: Encodes the peptide sequence at SEQ ID NO. 65059
  misc_feature (502)..(502): n is a, c, t, g, unknown, or other
ctccccgcggtggcggccgctctagaactagtggatcccccgggctgcaggaattcgtctcacccctagaaaaactctctcactctctctaatcacaatttcgacactgatcggtactctctagtgtccgactcgtcacagttttagcgagagagacagagagcgagcgagggagaggaggatgggttccacttccacgggaccggtgagcgggttcgcggcgccggagcgggacatcgacgatctgccgcggaacgacgcctactacacggcgctcactccgctctggttcctcgagcgcgcggcgctggcgcatccgggcagggcctccgtcgtgcacggccccgtgcgctacacctgggctgacacctatcgccgctgccgccgcctcgcatccgccctcgcgcgcctatccgtcggccacggaagcacggttgctgtgatagctcctaatgtcccggctgtctatgaagctcacttcggtgtccaatgtcaggagctngtgtgaactgcgtcaatattcggctaaacgccgagacattagcattcctccttgtacactccgtgggcagatgttgtgatggtggaccaagaattctgcaccctagccgttgtatcgc

SEQ ID NO: 65059 - protein, 108 aa, Zea mays
  misc_feature: Ceres CLONE 1535544
MGSTSTGPVSGFAAPERDIDDLPRNDAYYTALTPLWFLERAALAHPGRASVVHGPVRYTWADTYRRCRRLASALARLSVGHGSTVAVIAPNVPAVYEAHFGVQCQELV

SEQ ID NO: 65060 - DNA, 651 bp, Zea mays
  misc_feature: Ceres CLONE 1535545
ctccccgcggtggcggccgctctagaactagtggatcccccgggctgcaggaattcgtctcacccctagaaaaaaatccttaggtccctagccgtcgcgccgccgttcggcctcctaatctggcggcgccttccttcctcgccgctcatctcagttctcggcgcagacgtggaaggcctcatccccggcggcggcggtttgtgctccagcctccagcgagcaagacatagagcactcggagggatcccacgccgctgggccaggcaagggcactggacgcgggcgtctgaaagaagccggctaggaggaccacgagtccacggctgggcagtggccgggcgctgcgcctgcgctgggcgtgtgggcggcccgtggtggggctggcctcggcccccggggtcgctagcggccggctgctgagaaccgtgaaccaataatttggcaacaagacgcccctgacccctgtggacggctccgttctttgtgacgtggtcgccagtccagtcggcgctctcagatggcccgcgggttatggctcctctcccgcgaaggtggggaggctgcggccgctgcttgttcaggggcaggcgaggggcatctctgcctccaccaggagcagctccatggtctgcgtcgttggcagcggccccc

SEQ ID NO: 65061 - DNA, 651 bp, Zea mays
  misc_feature: Ceres CLONE 1535547
  misc_feature (48)..(48): n is a, c, t, g, unknown, or other
  misc_feature (358)..(358): n is a, c, t, g, unknown, or other
gcggtggcggccgctctagaactagtggatcccccgggctgcaggaantcgtctcacccctagaaaaaacaccacaccacgcggcagcggggcgggcaccagaagcagacggcgagcgagcgacacacctctcatctgcccgcccctctcctccgtccagcctctccccctctcctctcctctcctctcctcccaaaacaagagcagcgagacgcgcgcgcgcgcgccacgagctggtggaacctcgccgcctcccgcggcagatctcgcgccgagccctggtttcgacgcgagatccgcgcccgccgtccgccgctcgccgcctccgtcccgaagcattaccaggattatacttccnccttgaagatggggatggggattactagcgtttgagagcccaccaggggctctggaacagcggatactattcacagttgtttggaattggaggagttctcatcactcttaccattcttaatgcttccacgggttactttgggggaattggtggccccattggctccataatttgtgggcccttcccaaggacaagttccaagaaaaaaaggaacaccgaaaaggcccggtgaagaaatgaacattgggtaggatgctctggattatcatggaccaactgccttagcaaaggga

SEQ ID NO: 65062 - DNA, 645 bp, Zea mays
  misc_feature: Ceres CLONE 1535548
  misc_feature: Encodes the peptide sequence at SEQ ID NO. 65063
ggagctccccgcggtggcggccgctctagaactagtggatcccccgggctgcaggaattcgtctcacccctagaaaaaaccttatcatcgcccacgtacacacccaattcctcgcaactgggctcccccgcctccacgaaccacgacactgccccccgcctcaagttcgccgtctccattcctcagctctcctctcctctgtagtctgcctgtacctattggctgaagcagagctgacccccactttatcaagagttgctcaacaatggacactggctgcctgtcatctatgaatattactggagctagccaggcaagattttttgcggggcaacttcctcctcaaagatgttttgcaagtagtcactatacaagctttgccgtgaaaaaacttgcctcgaggaataaaggaaggagatcacaccgtaaacatcctgccttgcaggttgtctgcaaggattttccaagacctccactagaaagcacaataaactatttggaagctggacagctctcttcattttttagaaacagcgaacgccccagtaagccgttgcaggtcgtggttgctggtgcaggattggctggtctatcaacagcgaagtatctggcaaatgctggccataaacccatattgcttgaggc

SEQ ID NO: 65063 - protein, 126 aa, Zea mays
  misc_feature: Ceres CLONE 1535548
  misc_feature: SWISSPROT Homolog: EC 1.4.3.2 L-amino-acid oxidase
MDTGCLSSMNITGASQARFFAGQLPPQRCFASSHYTSFAVKKLASRNKGRRSHRKHPALQVVCKDFPRPPLESTINYLEAGQLSSFFRNSERPSKPLQVVVAGAGLAGLSTAKYLANAGHKPILLE

SEQ ID NO: 65064 - DNA, 653 bp, Zea mays
  misc_feature: Ceres CLONE 1535550
  misc_feature: Translation starting site: 155
  misc_feature (251)..(251): n is a, c, t, g, unknown, or other
  misc_feature (372)..(372): n is a, c, t, g, unknown, or other
  misc_feature (397)..(397): n is a, c, t, g, unknown, or other
ctccccgcggtggcggccgctctagaactagtggatcccccgggctgcaggaattcgtctcacccctagaaaaactccactgccagtgccatcccattcccatccgagctgcagcgctcgacgacggggagaatagcgtggcgtgggcggcgccatgaagtacagcaaggaagataagcccgagagggcgggcggcgcctgcgcatggtccagggcggtgccggtggcgctcgtcgtcgtcgtgctctgcngcttctccttctacctgggccgcatctacagcacgggacggagcctgctgggactccatcaggccgggcgcgacggctcttctcgccctcgggggccggcacgaacgaccgggcgttcctncgaagacaggcaagctctggccggnaactggcgtgcaccggcgcccgtggcgtttccccgaatggcccgcccattaaccaagaatatacccccctggaccaaaccccaaagcttggcggaaggtaacggcacctaccgcccttaacttaattggaaagggactgccccgccgcccccccgaccgggagaattttgcctgtgggccccccccccagggggttcaaagccccccttttccggtggccccataaccaaggaaacctgtgctggtcaccggaacc

SEQ ID NO: 65065 - DNA, 619 bp, Zea mays
  misc_feature: Ceres CLONE 1535555
ctcaccgcggtggcggccgctctagaactagtggatcccccgggctgcaggaattcgtctcacccctagaaaaagacggcgtgcttccgcctgccgccgccggcgagctgcttgcccgcagcatgactccgcatcctggccgcctcgtcctaccaccggcggctccttctccctgaaccccgccgcgcgccaggtaccacgcctccctccgcagtcacacgagcacgcggccgtcctctgccgcaccgcgccgcctccagacgcctcgctcgtcaggtctctccacctccgcctgcgaacgttcggcccagctccggcgagttcctccgaaattccggatctgctggagcgccagcaaggcggtctctccaaccctccggagtccagaccagcaagggttctgatctcccatgccacagcttataacgttgaaggattcataaagccacagaactagatgatacttgcataatgcagtcctcaggtatttggaatgcgcatgctggttcatcacagtcagagggttcgggtctggatatggagaggaactgatgcaatcataattattgtccatctcctctgcaaccaattgcctcggctggtcagcactctgaaagca

SEQ ID NO: 65066 - DNA, 643 bp, Zea mays
  misc_feature: Ceres CLONE 1535573
  misc_feature: Encodes the peptide sequence at SEQ ID NO. 65067
tccccgcggtggcggccgctctagaactagtggatcccccgggctgcaggaattcgtctcacccctggtgtaaatacccgaagcggccaccgccgcctccttcctggcatcctcctctcactctcgctcgtgctgcgctcgctacctcgcttctcattcacttcaaggagagcgtggagaggcgacgaaaggcggatgttcttcgagagcttccgcgtctagagcccccacgtgcggtactgaccgacggaaatcgagtcagagttccggtgcgacacttctgagctggtcactcgatggcaaggacggcgcctcacgcggggtcgtcccccacaagcccgtcgagtacctctgtcggaccagacccgccgtccccaaactcgcggagatgcgttgtcgtggtgcggacgcgcttctgcgtcacgctgacggctggtgtctctgcctctcggaggggatctcatggcctaccttcgacacggtgcttcaagccgactacttcagctccctcgcccaggcctcacgttcagagtcggactccccttcgagtaggcaggctatgcgccgttccaaatccccctggcttgttctccccagacgaccttgtgatctgaggctggcaattagcatcctgctcgtggcc

SEQ ID NO: 65067 - protein, 85 aa, Zea mays
  misc_feature: Ceres CLONE 1535573
MRCRGADALLRHADGWCLCLSEGISWPTFDTVLQADYFSSLAQASRSESDSPSSRQAMRRSKSPWLVLPRRPCDLRLAISILLVA

SEQ ID NO: 65068 - DNA, 640 bp, Zea mays
  misc_feature: Ceres CLONE 1535574
  misc_feature (504)..(504): n is a, c, t, g, unknown, or other
ctcaccgcggtggcggccgctctagaactagtggatcccccgggctgcaggaattcgtctcacccctagaaaaagctcgagctcagctcaagtaaccacagaaaatggcgtcacttctccgccctctcgtcctcgtgctcctgatcgcctcctgcacagcgcagcagtcaccgccggcgcagcccccgccaacgccgaacgcgccaccggccaactcgccgccccaggcgcctccagccggcaacccgccgccggcaggcaacccgccacccgcgcccaccgccactccacctccggccccgaccactccgcccccggccccgaccactcctcccccggctcccacaacgccgcccccggcgccgacaactccacctccggcccccaccacgccgcctccgtccccaccagcgtcgccaccgcccgctcccaacactccgccaccgtctcccccggtaagcccgccgcccgctcccgccacccgccaccgtctccgcccatggngccacctcccgccacggccccctcaacccgccaccccgccgccaccgggccggcccaaggccggccccgaacgggggccccaactccccccgcccgaggcaaccaccgcgttgtgtcccccaaaaagccccaagag

SEQ ID NO: 65069 - DNA, 712 bp, Zea mays
  misc_feature: Ceres CLONE 1535575
  misc_feature: Encodes the peptide sequence at SEQ ID NO. 65070
  misc_feature (80)..(80): n is a, c, t, g, unknown, or other
  misc_feature (182)..(182): n is a, c, t, g, unknown, or other
  misc_feature (185)..(185): n is a, c, t, g, unknown, or other
  misc_feature (190)..(190): n is a, c, t, g, unknown, or other
  misc_feature (407)..(407): n is a, c, t, g, unknown, or other
  misc_feature (409)..(409): n is a, c, t, g, unknown, or other
  misc_feature (415)..(415): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (436)..(436): n is a, c, t, g, unknown, or other
aaccctggagctcaccgcggtggcggccgctctagaactagtggatcccccgggctgcaggaattcgtctcacccctagnaaaacccccagacccaagtcctgtcaaggcctcaacacacacacacacttctctcgcttgacctacccccctccgccccccgccgggcctgcagggtgttcnacncttcncccgcccgcccgagcgccgccacggcatggcttcctccatctccgccgccgctaaggcctccgcggcctttgcccaaaagaaggagctggcccgccccttccccccaccgaggggagatcgagccctcggaccatgctcttgccccgtgcgcccccttcacgtgacccgggtttttttttttccccccccccccgggggaaaagaaaagggggaatntntataantattannnnttaatatccttnacaaaaaaaaaaaaaaaccccccctccctagaggggggggggagaaccttcttcatcaaacattacacgtccttcttaacacaagcaacgtctaacgagcccccgagacccctacggatcttttcaaaaaatagtcctctcggttcagcatccccacgaccctgggaacccccaaaaaaccactccctccgccccccccacacccaggaattcataccccagagacgaagagcctctcgcttccccatctattgactatcttccccagcttaagtg

SEQ ID NO: 65070 - protein, 63 aa, Zea mays
  misc_feature: Ceres CLONE 1535575
MASSISAAAKASAAFAQKKELARPFPPPRGDRALGPCSCPVRPLHVTRVFFFPPPPGGKEKGE
